United States Patent 11,639,524 (NORMALIZATION AND BASELINE SHIFT REMOVAL BY ROTATION IN ADDED DATA DIMENSIONS) - sequence listing, part 2

SEQ ID NO: 31357 - DNA, 21 bp, Artificial Sequence
  Synthetic
aacctaatctttgcaaacctt

SEQ ID NO: 31358 - DNA, 22 bp, Artificial Sequence
  Synthetic
agctgtaggaatagattttggt

SEQ ID NO: 31359 - DNA, 18 bp, Artificial Sequence
  Synthetic
taaggccctgacatttgc

SEQ ID NO: 31360 - DNA, 25 bp, Artificial Sequence
  Synthetic
ctgtgtattgaatatctgaatccaa

SEQ ID NO: 31361 - DNA, 22 bp, Artificial Sequence
  Synthetic
caatactctataagcgtttcca

SEQ ID NO: 31362 - DNA, 18 bp, Artificial Sequence
  Synthetic
catttgggattgcttggg

SEQ ID NO: 31363 - DNA, 21 bp, Artificial Sequence
  Synthetic
ttacagatgaaacagagcatc

SEQ ID NO: 31364 - DNA, 18 bp, Artificial Sequence
  Synthetic
gcagcactaactcctgta

SEQ ID NO: 31365 - DNA, 25 bp, Artificial Sequence
  Synthetic
ctcagcactagaatttatagagttt

SEQ ID NO: 31366 - DNA, 18 bp, Artificial Sequence
  Synthetic
ttagagactgcagcgttg

SEQ ID NO: 31367 - DNA, 22 bp, Artificial Sequence
  Synthetic
ttaaattttgcaagtgctgttg

SEQ ID NO: 31368 - DNA, 18 bp, Artificial Sequence
  Synthetic
gcagcagcattagcatct

SEQ ID NO: 31369 - DNA, 21 bp, Artificial Sequence
  Synthetic
aatattgcatcttgtagtgca

SEQ ID NO: 31370 - DNA, 18 bp, Artificial Sequence
  Synthetic
tcctccagatcgaaggcg

SEQ ID NO: 31371 - DNA, 18 bp, Artificial Sequence
  Synthetic
gaagcctattgcgccagc

SEQ ID NO: 31372 - DNA, 20 bp, Artificial Sequence
  Synthetic
gacggtctgcaagagtatta

SEQ ID NO: 31373 - DNA, 22 bp, Artificial Sequence
  Synthetic
ggaatattggaagcagaactga

SEQ ID NO: 31374 - DNA, 22 bp, Artificial Sequence
  Synthetic
ttggtagtttcaatgatcactc

SEQ ID NO: 31375 - DNA, 20 bp, Artificial Sequence
  Synthetic
ttccgtgtagatacctgatc

SEQ ID NO: 31376 - DNA, 23 bp, Artificial Sequence
  Synthetic
taatttttcctctgaggcctaat

SEQ ID NO: 31377 - DNA, 19 bp, Artificial Sequence
  Synthetic
ttgaacacctccagatgtc

SEQ ID NO: 31378 - DNA, 20 bp, Artificial Sequence
  Synthetic
gaacctgttttggatcaaca

SEQ ID NO: 31379 - DNA, 22 bp, Artificial Sequence
  Synthetic
ccatagatatcctgctccattt

SEQ ID NO: 31380 - DNA, 21 bp, Artificial Sequence
  Synthetic
gcttgcaatgtttagtactgt

SEQ ID NO: 31381 - DNA, 25 bp, Artificial Sequence
  Synthetic
cagctattactattggaaagtgttt

SEQ ID NO: 31382 - DNA, 23 bp, Artificial Sequence
  Synthetic
ttctcttgttagctattattggg

SEQ ID NO: 31383 - DNA, 25 bp, Artificial Sequence
  Synthetic
ctattgtaatccattctagtgatct

SEQ ID NO: 31384 - DNA, 19 bp, Artificial Sequence
  Synthetic
attagcgcttcataccctt

SEQ ID NO: 31385 - DNA, 21 bp, Artificial Sequence
  Synthetic
agtctaactttttgcccaaat

SEQ ID NO: 31386 - DNA, 22 bp, Artificial Sequence
  Synthetic
actcacccctaaagatacaatc

SEQ ID NO: 31387 - DNA, 18 bp, Artificial Sequence
  Synthetic
ccttacacctgcttcaca

SEQ ID NO: 31388 - DNA, 20 bp, Artificial Sequence
  Synthetic
cttcatcttctcctatgcca

SEQ ID NO: 31389 - DNA, 20 bp, Artificial Sequence
  Synthetic
gcatcatctaggaagcctaa

SEQ ID NO: 31390 - DNA, 18 bp, Artificial Sequence
  Synthetic
attctgaaaccgctggtg

SEQ ID NO: 31391 - DNA, 19 bp, Artificial Sequence
  Synthetic
tcgcgagagaccagatctt

SEQ ID NO: 31392 - DNA, 20 bp, Artificial Sequence
  Synthetic
tcaacaggagcttctatagg

SEQ ID NO: 31393 - DNA, 21 bp, Artificial Sequence
  Synthetic
ctaatgggatttcttcaccaa

SEQ ID NO: 31394 - DNA, 22 bp, Artificial Sequence
  Synthetic
cccaacctaattatatctgcaa

SEQ ID NO: 31395 - DNA, 21 bp, Artificial Sequence
  Synthetic
tgactcaaaaggtgctatagg

SEQ ID NO: 31396 - DNA, 19 bp, Artificial Sequence
  Synthetic
tgggatctccatcattcct

SEQ ID NO: 31397 - DNA, 23 bp, Artificial Sequence
  Synthetic
cattaggattttcagtatctgga

SEQ ID NO: 31398 - DNA, 18 bp, Artificial Sequence
  Synthetic
cctgctttgtcttgcaaa

SEQ ID NO: 31399 - DNA, 25 bp, Artificial Sequence
  Synthetic
catgagatcccattttaaaattcac

SEQ ID NO: 31400 - DNA, 19 bp, Artificial Sequence
  Synthetic
ggtcaagttcactggagaa

SEQ ID NO: 31401 - DNA, 22 bp, Artificial Sequence
  Synthetic
aatacatgagtgtctgaacttg

SEQ ID NO: 31402 - DNA, 18 bp, Artificial Sequence
  Synthetic
atgactcttcagcagcca

SEQ ID NO: 31403 - DNA, 19 bp, Artificial Sequence
  Synthetic
aatttctctggagcaagct

SEQ ID NO: 31404 - DNA, 22 bp, Artificial Sequence
  Synthetic
gactcccaatatactttcgttt

SEQ ID NO: 31405 - DNA, 21 bp, Artificial Sequence
  Synthetic
aaattgccttgtaagatcagt

SEQ ID NO: 31406 - DNA, 23 bp, Artificial Sequence
  Synthetic
ggctttaaaaaacaaagatgcaa

SEQ ID NO: 31407 - DNA, 23 bp, Artificial Sequence
  Synthetic
gagcttctggatttataatgtct

SEQ ID NO: 31408 - DNA, 19 bp, Artificial Sequence
  Synthetic
gggaaggcttagtaacgaa

SEQ ID NO: 31409 - DNA, 20 bp, Artificial Sequence
  Synthetic
tccaaactaagcgttcttca

SEQ ID NO: 31410 - DNA, 23 bp, Artificial Sequence
  Synthetic
ggtaaatcattacaaggtttagc

SEQ ID NO: 31411 - DNA, 19 bp, Artificial Sequence
  Synthetic
gctttagttttgcgccttt

SEQ ID NO: 31412 - DNA, 20 bp, Artificial Sequence
  Synthetic
cgccttttttgtaccagagt

SEQ ID NO: 31413 - DNA, 20 bp, Artificial Sequence
  Synthetic
agctcaccatcttttattgc

SEQ ID NO: 31414 - DNA, 21 bp, Artificial Sequence
  Synthetic
acagttgcaattcattgtctt

SEQ ID NO: 31415 - DNA, 23 bp, Artificial Sequence
  Synthetic
tcaatatctggtgtttcatttcc

SEQ ID NO: 31416 - DNA, 20 bp, Artificial Sequence
  Synthetic
ggaggaatcacaaccaagca

SEQ ID NO: 31417 - DNA, 18 bp, Artificial Sequence
  Synthetic
gttagctgcttcctgagt

SEQ ID NO: 31418 - DNA, 18 bp, Artificial Sequence
  Synthetic
acaaccaataggcagcca

SEQ ID NO: 31419 - DNA, 22 bp, Artificial Sequence
  Synthetic
caactattgtagcagtgttgtt

SEQ ID NO: 31420 - DNA, 21 bp, Artificial Sequence
  Synthetic
gttcataactaggtaaggcac

SEQ ID NO: 31421 - DNA, 19 bp, Artificial Sequence
  Synthetic
atctttgcactggataggg

SEQ ID NO: 31422 - DNA, 20 bp, Artificial Sequence
  Synthetic
gatgtctgataccagcatga

SEQ ID NO: 31423 - DNA, 21 bp, Artificial Sequence
  Synthetic
acttctttctaagctggacaa

SEQ ID NO: 31424 - DNA, 23 bp, Artificial Sequence
  Synthetic
attatatgctgatgctatgccta

SEQ ID NO: 31425 - DNA, 23 bp, Artificial Sequence
  Synthetic
tgtttttatgtttgtcctcttct

SEQ ID NO: 31426 - DNA, 22 bp, Artificial Sequence
  Synthetic
ttcattactccagcttggtatc

SEQ ID NO: 31427 - DNA, 20 bp, Artificial Sequence
  Synthetic
ttgatcagtaaaaccagtgc

SEQ ID NO: 31428 - DNA, 20 bp, Artificial Sequence
  Synthetic
gaggcatataagggtgagaa

SEQ ID NO: 31429 - DNA, 19 bp, Artificial Sequence
  Synthetic
tgttgctggtaaccatcaa

SEQ ID NO: 31430 - DNA, 23 bp, Artificial Sequence
  Synthetic
ttcaacttaccattctttgtgta

SEQ ID NO: 31431 - DNA, 24 bp, Artificial Sequence
  Synthetic
tctaactctattatggtgagttct

SEQ ID NO: 31432 - DNA, 21 bp, Artificial Sequence
  Synthetic
ccaccaacatgtattccaaat

SEQ ID NO: 31433 - DNA, 23 bp, Artificial Sequence
  Synthetic
agattcagctaatttcacttcaa

SEQ ID NO: 31434 - DNA, 20 bp, Artificial Sequence
  Synthetic
ccttgctcattgatgaagtg

SEQ ID NO: 31435 - DNA, 18 bp, Artificial Sequence
  Synthetic
tccctctccttcatgact

SEQ ID NO: 31436 - DNA, 21 bp, Artificial Sequence
  Synthetic
acaagatgcattaagtaaggc

SEQ ID NO: 31437 - DNA, 18 bp, Artificial Sequence
  Synthetic
ttgaaacctggcctatgg

SEQ ID NO: 31438 - DNA, 20 bp, Artificial Sequence
  Synthetic
tgctaataaagtcctgcaga

SEQ ID NO: 31439 - DNA, 20 bp, Artificial Sequence
  Synthetic
atttctttccgggatcatct

SEQ ID NO: 31440 - DNA, 20 bp, Artificial Sequence
  Synthetic
atgatgacatcctgtgcttc

SEQ ID NO: 31441 - DNA, 18 bp, Artificial Sequence
  Synthetic
ttgggtcaaatgcaacac

SEQ ID NO: 31442 - DNA, 21 bp, Artificial Sequence
  Synthetic
ccttacatatatccacagcct

SEQ ID NO: 31443 - DNA, 19 bp, Artificial Sequence
  Synthetic
cgattgattgctcgtcttt

SEQ ID NO: 31444 - DNA, 19 bp, Artificial Sequence
  Synthetic
aatgacatctctgtgctgg

SEQ ID NO: 31445 - DNA, 24 bp, Artificial Sequence
  Synthetic
cattttcccaatttctaatgatcc

SEQ ID NO: 31446 - DNA, 20 bp, Artificial Sequence
  Synthetic
ttgccttgttgtagttgaac

SEQ ID NO: 31447 - DNA, 20 bp, Artificial Sequence
  Synthetic
aaatgcaactcaacatcctt

SEQ ID NO: 31448 - DNA, 23 bp, Artificial Sequence
  Synthetic
tcgttttagtagtgaaacagttt

SEQ ID NO: 31449 - DNA, 19 bp, Artificial Sequence
  Synthetic
ccgcttacatttgctgttt

SEQ ID NO: 31450 - DNA, 17 bp, Artificial Sequence
  Synthetic
cgtcgtccgaccgaaga

SEQ ID NO: 31451 - DNA, 21 bp, Artificial Sequence
  Synthetic
aattggcttttgtttggattc

SEQ ID NO: 31452 - DNA, 20 bp, Artificial Sequence
  Synthetic
cttcacctggaactactgta

SEQ ID NO: 31453 - DNA, 19 bp, Artificial Sequence
  Synthetic
ctaaaagaatccgcttggg

SEQ ID NO: 31454 - DNA, 18 bp, Artificial Sequence
  Synthetic
ccacaggtttagcaggag

SEQ ID NO: 31455 - DNA, 25 bp, Artificial Sequence
  Synthetic
ccttttctggattataaacagactt

SEQ ID NO: 31456 - DNA, 19 bp, Artificial Sequence
  Synthetic
cctgttgctggtaaacaac

SEQ ID NO: 31457 - DNA, 20 bp, Artificial Sequence
  Synthetic
gatccaatggaaaggacccg

SEQ ID NO: 31458 - DNA, 18 bp, Artificial Sequence
  Synthetic
aggggtagccaggctgac

SEQ ID NO: 31459 - DNA, 16 bp, Artificial Sequence
  Synthetic
gcgcctgcgaggagat

SEQ ID NO: 31460 - DNA, 19 bp, Artificial Sequence
  Synthetic
cctctacccctgcaaacag

SEQ ID NO: 31461 - DNA, 20 bp, Artificial Sequence
  Synthetic
ggcactacactacactccct

SEQ ID NO: 31462 - DNA, 19 bp, Artificial Sequence
  Synthetic
gtttccggaagcagtcagt

SEQ ID NO: 31463 - DNA, 19 bp, Artificial Sequence
  Synthetic
gcatattcgagcatccgcc

SEQ ID NO: 31464 - DNA, 20 bp, Artificial Sequence
  Synthetic
ccacatgcctagagctgtgt

SEQ ID NO: 31465 - DNA, 17 bp, Artificial Sequence
  Synthetic
cctccgtgacgcatgtc

SEQ ID NO: 31466 - DNA, 20 bp, Artificial Sequence
  Synthetic
accaggtagaggtcgctaga

SEQ ID NO: 31467 - DNA, 16 bp, Artificial Sequence
  Synthetic
ggtctgaggcaccgca

SEQ ID NO: 31468 - DNA, 18 bp, Artificial Sequence
  Synthetic
gggggacagtgacagagc

SEQ ID NO: 31469 - DNA, 20 bp, Artificial Sequence
  Synthetic
aagttgggtccaagctgaag

SEQ ID NO: 31470 - DNA, 18 bp, Artificial Sequence
  Synthetic
caggtggtcttggcagac

SEQ ID NO: 31471 - DNA, 20 bp, Artificial Sequence
  Synthetic
ccacctacgattacccacgt

SEQ ID NO: 31472 - DNA, 18 bp, Artificial Sequence
  Synthetic
ataagcccgccaggtact

SEQ ID NO: 31473 - DNA, 15 bp, Artificial Sequence
  Synthetic
agtgcacccgccaca

SEQ ID NO: 31474 - DNA, 18 bp, Artificial Sequence
  Synthetic
acacacccagtcccacac

SEQ ID NO: 31475 - DNA, 18 bp, Artificial Sequence
  Synthetic
gtttgtagttgggggccg

SEQ ID NO: 31476 - DNA, 18 bp, Artificial Sequence
  Synthetic
cggtgatgtgtgaggggt

SEQ ID NO: 31477 - DNA, 18 bp, Artificial Sequence
  Synthetic
acatccagacacgacggg

SEQ ID NO: 31478 - DNA, 19 bp, Artificial Sequence
  Synthetic
gctcaagtctgggtctcca

SEQ ID NO: 31479 - DNA, 20 bp, Artificial Sequence
  Synthetic
ggggagtactggaaaccgta

SEQ ID NO: 31480 - DNA, 20 bp, Artificial Sequence
  Synthetic
ccgcataccagcatgtcaaa

SEQ ID NO: 31481 - DNA, 19 bp, Artificial Sequence
  Synthetic
ccatattgtgggggcgtac

SEQ ID NO: 31482 - DNA, 19 bp, Artificial Sequence
  Synthetic
cgcatatcgctgctttccc

SEQ ID NO: 31483 - DNA, 22 bp, Artificial Sequence
  Synthetic
ctgatactttccatcacaacat

SEQ ID NO: 31484 - DNA, 20 bp, Artificial Sequence
  Synthetic
cgagtctttttcctgcaatt

SEQ ID NO: 31485 - DNA, 22 bp, Artificial Sequence
  Synthetic
ctcaattttacattggcatcaa

SEQ ID NO: 31486 - DNA, 21 bp, Artificial Sequence
  Synthetic
cagaaattggcaaactcatct

SEQ ID NO: 31487 - DNA, 20 bp, Artificial Sequence
  Synthetic
gcccatcttgtgaatctcaa

SEQ ID NO: 31488 - DNA, 20 bp, Artificial Sequence
  Synthetic
ggtcaattgatccaaaggtt

SEQ ID NO: 31489 - DNA, 20 bp, Artificial Sequence
  Synthetic
tggaacacaacattgacaat

SEQ ID NO: 31490 - DNA, 18 bp, Artificial Sequence
  Synthetic
ttggagtctcccatggtg

SEQ ID NO: 31491 - DNA, 20 bp, Artificial Sequence
  Synthetic
gaaaactgacaccaaagagg

SEQ ID NO: 31492 - DNA, 19 bp, Artificial Sequence
  Synthetic
cactgcgtcatttttgaga

SEQ ID NO: 31493 - DNA, 22 bp, Artificial Sequence
  Synthetic
acatttccacattttgtcatca

SEQ ID NO: 31494 - DNA, 18 bp, Artificial Sequence
  Synthetic
agttctgcactggtctca

SEQ ID NO: 31495 - DNA, 19 bp, Artificial Sequence
  Synthetic
cgctgatgtggatatctcg

SEQ ID NO: 31496 - DNA, 19 bp, Artificial Sequence
  Synthetic
accactagttgcagtacaa

SEQ ID NO: 31497 - DNA, 25 bp, Artificial Sequence
  Synthetic
tggtatattagataaggtaccttct

SEQ ID NO: 31498 - DNA, 18 bp, Artificial Sequence
  Synthetic
atttcagggtcaaaggcg

SEQ ID NO: 31499 - DNA, 24 bp, Artificial Sequence
  Synthetic
ccaacatcatctacaaatatacgt

SEQ ID NO: 31500 - DNA, 23 bp, Artificial Sequence
  Synthetic
ctaatctttctgtttctgggtta

SEQ ID NO: 31501 - DNA, 22 bp, Artificial Sequence
  Synthetic
tgtggtgttaaaaagaactctg

SEQ ID NO: 31502 - DNA, 23 bp, Artificial Sequence
  Synthetic
gccaaactgttaatatacctgta

SEQ ID NO: 31503 - DNA, 21 bp, Artificial Sequence
  Synthetic
cagatgttatcgagatgttgt

SEQ ID NO: 31504 - DNA, 18 bp, Artificial Sequence
  Synthetic
acttcagtggttacagcc

SEQ ID NO: 31505 - DNA, 21 bp, Artificial Sequence
  Synthetic
tcctttcgatattcttccctc

SEQ ID NO: 31506 - DNA, 18 bp, Artificial Sequence
  Synthetic
aaacaacgcatgtgctgt

SEQ ID NO: 31507 - DNA, 19 bp, Artificial Sequence
  Synthetic
tactgtactgactgcaacc

SEQ ID NO: 31508 - DNA, 18 bp, Artificial Sequence
  Synthetic
aatcccatttctctggcc

SEQ ID NO: 31509 - DNA, 18 bp, Artificial Sequence
  Synthetic
acttgaccctctaccaca

SEQ ID NO: 31510 - DNA, 25 bp, Artificial Sequence
  Synthetic
actaatagtggatgatgaaagtgta

SEQ ID NO: 31511 - DNA, 21 bp, Artificial Sequence
  Synthetic
ggaaaatagggatgtccaact

SEQ ID NO: 31512 - DNA, 21 bp, Artificial Sequence
  Synthetic
cactagcattttctgtgtcat

SEQ ID NO: 31513 - DNA, 24 bp, Artificial Sequence
  Synthetic
gcaaatagatgtacaaatatccag

SEQ ID NO: 31514 - DNA, 21 bp, Artificial Sequence
  Synthetic
caacaaatgccattattgtgg

SEQ ID NO: 31515 - DNA, 18 bp, Artificial Sequence
  Synthetic
aggtagatgaggtggtgg

SEQ ID NO: 31516 - DNA, 20 bp, Artificial Sequence
  Synthetic
gtgattcagtagttgcacat

SEQ ID NO: 31517 - DNA, 25 bp, Artificial Sequence
  Synthetic
tcccatctctatatactatgcataa

SEQ ID NO: 31518 - DNA, 20 bp, Artificial Sequence
  Synthetic
gattacagctgggtttctct

SEQ ID NO: 31519 - DNA, 18 bp, Artificial Sequence
  Synthetic
aatgtctacgtgtgtgct

SEQ ID NO: 31520 - DNA, 18 bp, Artificial Sequence
  Synthetic
tgtttcagcagcgcattt

SEQ ID NO: 31521 - DNA, 19 bp, Artificial Sequence
  Synthetic
tgtgtgtcttctcggattt

SEQ ID NO: 31522 - DNA, 19 bp, Artificial Sequence
  Synthetic
agtcgttgacatctttgca

SEQ ID NO: 31523 - DNA, 18 bp, Artificial Sequence
  Synthetic
aaagtcatccatggctgc

SEQ ID NO: 31524 - DNA, 19 bp, Artificial Sequence
  Synthetic
agaaacatgggtcttgaca

SEQ ID NO: 31525 - DNA, 23 bp, Artificial Sequence
  Synthetic
tgttgaatacagattttgctagt

SEQ ID NO: 31526 - DNA, 18 bp, Artificial Sequence
  Synthetic
ttcagcttgcctctttca

SEQ ID NO: 31527 - DNA, 18 bp, Artificial Sequence
  Synthetic
tttggtgttgtccccagt

SEQ ID NO: 31528 - DNA, 24 bp, Artificial Sequence
  Synthetic
gtagaggtcttattttctcgattt

SEQ ID NO: 31529 - DNA, 20 bp, Artificial Sequence
  Synthetic
atcccaactaatttgcaggt

SEQ ID NO: 31530 - DNA, 21 bp, Artificial Sequence
  Synthetic
cctcgtttgaatttgcgtatc

SEQ ID NO: 31531 - DNA, 19 bp, Artificial Sequence
  Synthetic
atcaccacagcattgttga

SEQ ID NO: 31532 - DNA, 19 bp, Artificial Sequence
  Synthetic
attgcaaggaacaaccaaa

SEQ ID NO: 31533 - DNA, 22 bp, Artificial Sequence
  Synthetic
actttatgaactctttctccag

SEQ ID NO: 31534 - DNA, 18 bp, Artificial Sequence
  Synthetic
gacaggtcagaaacgcag

SEQ ID NO: 31535 - DNA, 20 bp, Artificial Sequence
  Synthetic
tgctgcgtatcgtctaatag

SEQ ID NO: 31536 - DNA, 23 bp, Artificial Sequence
  Synthetic
gtcattttgtgtaaatagttgct

SEQ ID NO: 31537 - DNA, 18 bp, Artificial Sequence
  Synthetic
acactgctatgacccagt

SEQ ID NO: 31538 - DNA, 22 bp, Artificial Sequence
  Synthetic
tcatatagagttagaagctgct

SEQ ID NO: 31539 - DNA, 23 bp, Artificial Sequence
  Synthetic
ccctttttgaatgtatgatctgg

SEQ ID NO: 31540 - DNA, 16 bp, Artificial Sequence
  Synthetic
accggcagaggctctg

SEQ ID NO: 31541 - DNA, 20 bp, Artificial Sequence
  Synthetic
gcaactgttgtttgttcaat

SEQ ID NO: 31542 - DNA, 18 bp, Artificial Sequence
  Synthetic
cccggcgtatctacatct

SEQ ID NO: 31543 - DNA, 21 bp, Artificial Sequence
  Synthetic
ttcaaatgcaggattctcaaa

SEQ ID NO: 31544 - DNA, 22 bp, Artificial Sequence
  Synthetic
aatgttctgcttcaataggatc

SEQ ID NO: 31545 - DNA, 21 bp, Artificial Sequence
  Synthetic
cacataatcatcgctgcttag

SEQ ID NO: 31546 - DNA, 21 bp, Artificial Sequence
  Synthetic
ctaccgatttctatgcctcta

SEQ ID NO: 31547 - DNA, 22 bp, Artificial Sequence
  Synthetic
cctatgtcaaacatatcaccat

SEQ ID NO: 31548 - DNA, 21 bp, Artificial Sequence
  Synthetic
gccaaagtcaagaattcacaa

SEQ ID NO: 31549 - DNA, 18 bp, Artificial Sequence
  Synthetic
acaagttggaacagtggt

SEQ ID NO: 31550 - DNA, 25 bp, Artificial Sequence
  Synthetic
tctctattgttatgctattctggat

SEQ ID NO: 31551 - DNA, 18 bp, Artificial Sequence
  Synthetic
atccatcattgccctctg

SEQ ID NO: 31552 - DNA, 20 bp, Artificial Sequence
  Synthetic
gactcttgtgagctgggttt

SEQ ID NO: 31553 - DNA, 18 bp, Artificial Sequence
  Synthetic
tttcctccactcctggtc

SEQ ID NO: 31554 - DNA, 19 bp, Artificial Sequence
  Synthetic
cctataagggcttctgtcc

SEQ ID NO: 31555 - DNA, 18 bp, Artificial Sequence
  Synthetic
attttgtacgaggccagc

SEQ ID NO: 31556 - DNA, 18 bp, Artificial Sequence
  Synthetic
gaaaaccccactgcagat

SEQ ID NO: 31557 - DNA, 18 bp, Artificial Sequence
  Synthetic
ctcccgctataccctgac

SEQ ID NO: 31558 - DNA, 21 bp, Artificial Sequence
  Synthetic
ctggtttcttttcaatgtcca

SEQ ID NO: 31559 - DNA, 19 bp, Artificial Sequence
  Synthetic
tccatttggtgttgtctcc

SEQ ID NO: 31560 - DNA, 20 bp, Artificial Sequence
  Synthetic
tctcgttgattcgttgaagt

SEQ ID NO: 31561 - DNA, 22 bp, Artificial Sequence
  Synthetic
aagtcctatagaacctatccac

SEQ ID NO: 31562 - DNA, 20 bp, Artificial Sequence
  Synthetic
tggatttgtgtatcccccct

SEQ ID NO: 31563 - DNA, 22 bp, Artificial Sequence
  Synthetic
gtcttgcaatatacacaggtta

SEQ ID NO: 31564 - DNA, 21 bp, Artificial Sequence
  Synthetic
tgtctaagtttttctgctgga

SEQ ID NO: 31565 - DNA, 22 bp, Artificial Sequence
  Synthetic
ggctggtaaatgttgatgatta

SEQ ID NO: 31566 - DNA, 23 bp, Artificial Sequence
  Synthetic
aaagatatttcttgtaaccgtgg

SEQ ID NO: 31567 - DNA, 23 bp, Artificial Sequence
  Synthetic
gtcttttaattgtgctatggtac

SEQ ID NO: 31568 - DNA, 23 bp, Artificial Sequence
  Synthetic
gggggttccttttaaaaatgatt

SEQ ID NO: 31569 - DNA, 18 bp, Artificial Sequence
  Synthetic
cttgtagggccatttgca

SEQ ID NO: 31570 - DNA, 23 bp, Artificial Sequence
  Synthetic
cccatatttttcacattcacttt

SEQ ID NO: 31571 - DNA, 18 bp, Artificial Sequence
  Synthetic
acaatgctgcttctccgc

SEQ ID NO: 31572 - DNA, 22 bp, Artificial Sequence
  Synthetic
actatctggaattgcaacagta

SEQ ID NO: 31573 - DNA, 23 bp, Artificial Sequence
  Synthetic
actgtaaagacaatatagcatgt

SEQ ID NO: 31574 - DNA, 18 bp, Artificial Sequence
  Synthetic
acatagttgcccgttgac

SEQ ID NO: 31575 - DNA, 23 bp, Artificial Sequence
  Synthetic
cgttacattactataggaagagg

SEQ ID NO: 31576 - DNA, 24 bp, Artificial Sequence
  Synthetic
atatccagtatctaccatatcacc

SEQ ID NO: 31577 - DNA, 19 bp, Artificial Sequence
  Synthetic
ggagaatacacacagctgc

SEQ ID NO: 31578 - DNA, 23 bp, Artificial Sequence
  Synthetic
cacaactgaaaaataaactgcaa

SEQ ID NO: 31579 - DNA, 19 bp, Artificial Sequence
  Synthetic
gcgtactgtattgtgcaga

SEQ ID NO: 31580 - DNA, 20 bp, Artificial Sequence
  Synthetic
ccatcttgccttttctgagt

SEQ ID NO: 31581 - DNA, 22 bp, Artificial Sequence
  Synthetic
ggctggtttctatttaaagtcc

SEQ ID NO: 31582 - DNA, 20 bp, Artificial Sequence
  Synthetic
gttatctccagtgatggtca

SEQ ID NO: 31583 - DNA, 20 bp, Artificial Sequence
  Synthetic
tcgataaaacctgtcgactc

SEQ ID NO: 31584 - DNA, 18 bp, Artificial Sequence
  Synthetic
gaagggccatttgagctg

SEQ ID NO: 31585 - DNA, 20 bp, Artificial Sequence
  Synthetic
cagattcgaaatcaatccgt

SEQ ID NO: 31586 - DNA, 16 bp, Artificial Sequence
  Synthetic
acgacccgctccagga

SEQ ID NO: 31587 - DNA, 16 bp, Artificial Sequence
  Synthetic
aatgccacccggggtc

SEQ ID NO: 31588 - DNA, 18 bp, Artificial Sequence
  Synthetic
aggagtcccgcacagaaa

SEQ ID NO: 31589 - DNA, 20 bp, Artificial Sequence
  Synthetic
cgtcccattaccacggtagt

SEQ ID NO: 31590 - DNA, 20 bp, Artificial Sequence
  Synthetic
ccgcatagaaggtgcaaaga

SEQ ID NO: 31591 - DNA, 19 bp, Artificial Sequence
  Synthetic
ttccggtgatgcaagcatt

SEQ ID NO: 31592 - DNA, 19 bp, Artificial Sequence
  Synthetic
gcctcagccaacttcatca

SEQ ID NO: 31593 - DNA, 17 bp, Artificial Sequence
  Synthetic
cgacccaactggcgaca

SEQ ID NO: 31594 - DNA, 16 bp, Artificial Sequence
  Synthetic
ggaatgccgctctcgc

SEQ ID NO: 31595 - DNA, 20 bp, Artificial Sequence
  Synthetic
ccacaacatccagaaagcca

SEQ ID NO: 31596 - DNA, 18 bp, Artificial Sequence
  Synthetic
acttcgtctcccctacgg

SEQ ID NO: 31597 - DNA, 18 bp, Artificial Sequence
  Synthetic
ttcccgagagtgccatgg

SEQ ID NO: 31598 - DNA, 20 bp, Artificial Sequence
  Synthetic
gggagatacagaggagcctc

SEQ ID NO: 31599 - DNA, 17 bp, Artificial Sequence
  Synthetic
catgtgcggccattggg

SEQ ID NO: 31600 - DNA, 18 bp, Artificial Sequence
  Synthetic
gtctgtggcacaaacgca

SEQ ID NO: 31601 - DNA, 20 bp, Artificial Sequence
  Synthetic
cggtcaagtcaggttcaagg

SEQ ID NO: 31602 - DNA, 17 bp, Artificial Sequence
  Synthetic
atagcgaggcccaccaa

SEQ ID NO: 31603 - DNA, 18 bp, Artificial Sequence
  Synthetic
gcccacctcacaggcttt

SEQ ID NO: 31604 - DNA, 18 bp, Artificial Sequence
  Synthetic
gcatggtgcctcccacac

SEQ ID NO: 31605 - DNA, 18 bp, Artificial Sequence
  Synthetic
gcatcaccgaacttcgcg

SEQ ID NO: 31606 - DNA, 20 bp, Artificial Sequence
  Synthetic
cgtgcagctcaccatcatag

SEQ ID NO: 31607 - DNA, 17 bp, Artificial Sequence
  Synthetic
gggcctcccaagagaca

SEQ ID NO: 31608 - DNA, 19 bp, Artificial Sequence
  Synthetic
gccttgaaacgcctcttca

SEQ ID NO: 31609 - DNA, 20 bp, Artificial Sequence
  Synthetic
ggtgattgggggaggtatga

SEQ ID NO: 31610 - DNA, 20 bp, Artificial Sequence
  Synthetic
ccctcgacatagtacctgca

SEQ ID NO: 31611 - DNA, 20 bp, Artificial Sequence
  Synthetic
caattgggtccgtgtactcg

SEQ ID NO: 31612 - DNA, 20 bp, Artificial Sequence
  Synthetic
ggcccatgtaatgagaccaa

SEQ ID NO: 31613 - DNA, 18 bp, Artificial Sequence
  Synthetic
tcataagttgcagtggcg

SEQ ID NO: 31614 - DNA, 18 bp, Artificial Sequence
  Synthetic
caactggtagcacttcgg

SEQ ID NO: 31615 - DNA, 23 bp, Artificial Sequence
  Synthetic
tttggactaagatactttcgttt

SEQ ID NO: 31616 - DNA, 19 bp, Artificial Sequence
  Synthetic
aattgccgtgtcaattcat

SEQ ID NO: 31617 - DNA, 22 bp, Artificial Sequence
  Synthetic
tgcacatttaacattgaggtaa

SEQ ID NO: 31618 - DNA, 22 bp, Artificial Sequence
  Synthetic
accatatatgcacattctctca

SEQ ID NO: 31619 - DNA, 21 bp, Artificial Sequence
  Synthetic
catgtatatccaacaagggtc

SEQ ID NO: 31620 - DNA, 18 bp, Artificial Sequence
  Synthetic
tagctgatcttgcagagc

SEQ ID NO: 31621 - DNA, 18 bp, Artificial Sequence
  Synthetic
ggcctccgtccgtacctt

SEQ ID NO: 31622 - DNA, 16 bp, Artificial Sequence
  Synthetic
gcccgctgtgaccgtt

SEQ ID NO: 31623 - DNA, 24 bp, Artificial Sequence
  Synthetic
tagtactaaatgacctaaacagtc

SEQ ID NO: 31624 - DNA, 18 bp, Artificial Sequence
  Synthetic
cttgaccgtttttgcacg

SEQ ID NO: 31625 - DNA, 18 bp, Artificial Sequence
  Synthetic
actgtgtgcgtgaaaccc

SEQ ID NO: 31626 - DNA, 18 bp, Artificial Sequence
  Synthetic
aatagtggctcgagtccc

SEQ ID NO: 31627 - DNA, 20 bp, Artificial Sequence
  Synthetic
tctcgaatgcaaatcacaaa

SEQ ID NO: 31628 - DNA, 18 bp, Artificial Sequence
  Synthetic
aggacaaaggccagtttg

SEQ ID NO: 31629 - DNA, 18 bp, Artificial Sequence
  Synthetic
tgattagcccacaggatg

SEQ ID NO: 31630 - DNA, 24 bp, Artificial Sequence
  Synthetic
ggaagacttatacttagtcagagt

SEQ ID NO: 31631 - DNA, 25 bp, Artificial Sequence
  Synthetic
ctctatggtagtattattcaaatgc

SEQ ID NO: 31632 - DNA, 22 bp, Artificial Sequence
  Synthetic
atcatgtattgtgccatttgag

SEQ ID NO: 31633 - DNA, 25 bp, Artificial Sequence
  Synthetic
attactactgtacaagttccattga

SEQ ID NO: 31634 - DNA, 22 bp, Artificial Sequence
  Synthetic
agaatcaacactataatctgcc

SEQ ID NO: 31635 - DNA, 24 bp, Artificial Sequence
  Synthetic
agagaatataccagaatacccaga

SEQ ID NO: 31636 - DNA, 20 bp, Artificial Sequence
  Synthetic
tttctggagatggatttcgg

SEQ ID NO: 31637 - DNA, 21 bp, Artificial Sequence
  Synthetic
ggcattccttttcttttggta

SEQ ID NO: 31638 - DNA, 22 bp, Artificial Sequence
  Synthetic
attgctttaataatcgaggtca

SEQ ID NO: 31639 - DNA, 20 bp, Artificial Sequence
  Synthetic
gctttgcagaacatgtcttt

SEQ ID NO: 31640 - DNA, 19 bp, Artificial Sequence
  Synthetic
ggactcgttgcttaagaga

SEQ ID NO: 31641 - DNA, 25 bp, Artificial Sequence
  Synthetic
cagttataaaccattcattaccaga

SEQ ID NO: 31642 - DNA, 18 bp, Artificial Sequence
  Synthetic
acttaaatctgcgtccgg

SEQ ID NO: 31643 - DNA, 20 bp, Artificial Sequence
  Synthetic
acaaattttgcctgactgtt

SEQ ID NO: 31644 - DNA, 21 bp, Artificial Sequence
  Synthetic
gtgattaacattggtggcaat

SEQ ID NO: 31645 - DNA, 23 bp, Artificial Sequence
  Synthetic
gcatctattgttttaggatcaga

SEQ ID NO: 31646 - DNA, 20 bp, Artificial Sequence
  Synthetic
gttctccttgttgtgctcgt

SEQ ID NO: 31647 - DNA, 25 bp, Artificial Sequence
  Synthetic
ccagttatactttcaaatagaggat

SEQ ID NO: 31648 - DNA, 18 bp, Artificial Sequence
  Synthetic
cgggaaacatcacctagt

SEQ ID NO: 31649 - DNA, 19 bp, Artificial Sequence
  Synthetic
acatattcgtccgtgttgt

SEQ ID NO: 31650 - DNA, 20 bp, Artificial Sequence
  Synthetic
cctcgatccatttgaaatcc

SEQ ID NO: 31651 - DNA, 18 bp, Artificial Sequence
  Synthetic
aattcagcggtatcccag

SEQ ID NO: 31652 - DNA, 19 bp, Artificial Sequence
  Synthetic
acacctgctctggttaaat

SEQ ID NO: 31653 - DNA, 20 bp, Artificial Sequence
  Synthetic
ctggtaacgtatcaccttct

SEQ ID NO: 31654 - DNA, 22 bp, Artificial Sequence
  Synthetic
atgttacatttttctccttcgt

SEQ ID NO: 31655 - DNA, 21 bp, Artificial Sequence
  Synthetic
tttctgtatttgtcgtccact

SEQ ID NO: 31656 - DNA, 25 bp, Artificial Sequence
  Synthetic
gttgatttctgtttaatgtccaatc

SEQ ID NO: 31657 - DNA, 20 bp, Artificial Sequence
  Synthetic
tcatcgtgttcaatgtcaaa

SEQ ID NO: 31658 - DNA, 18 bp, Artificial Sequence
  Synthetic
tgttgtccccagtgattg

SEQ ID NO: 31659 - DNA, 23 bp, Artificial Sequence
  Synthetic
tctcaattttcttccttgttgat

SEQ ID NO: 31660 - DNA, 20 bp, Artificial Sequence
  Synthetic
tttgctcatgttgattccca

SEQ ID NO: 31661 - DNA, 20 bp, Artificial Sequence
  Synthetic
ctcgtctgaatttgtgtgtc

SEQ ID NO: 31662 - DNA, 21 bp, Artificial Sequence
  Synthetic
ttctttatggctgacaaaggg

SEQ ID NO: 31663 - DNA, 20 bp, Artificial Sequence
  Synthetic
ttaatccgtccagactcgaa

SEQ ID NO: 31664 - DNA, 20 bp, Artificial Sequence
  Synthetic
ctagctaagtcaggcaaagt

SEQ ID NO: 31665 - DNA, 18 bp, Artificial Sequence
  Synthetic
aaacacacggatagctgc

SEQ ID NO: 31666 - DNA, 20 bp, Artificial Sequence
  Synthetic
atcatcctgtacctgaacaa

SEQ ID NO: 31667 - DNA, 19 bp, Artificial Sequence
  Synthetic
gatctttcctgttggctct

SEQ ID NO: 31668 - DNA, 21 bp, Artificial Sequence
  Synthetic
cgaagcattatagagagtcca

SEQ ID NO: 31669 - DNA, 19 bp, Artificial Sequence
  Synthetic
tcttgcgataggtagttcc

SEQ ID NO: 31670 - DNA, 18 bp, Artificial Sequence
  Synthetic
gcaattggttgtgcatct

SEQ ID NO: 31671 - DNA, 19 bp, Artificial Sequence
  Synthetic
acagatctcttgccctaga

SEQ ID NO: 31672 - DNA, 20 bp, Artificial Sequence
  Synthetic
tgttaaagctgctctggtac

SEQ ID NO: 31673 - DNA, 24 bp, Artificial Sequence
  Synthetic
gtattgatttgctgatactttagg

SEQ ID NO: 31674 - DNA, 21 bp, Artificial Sequence
  Synthetic
cagcctacaatcaataactgt

SEQ ID NO: 31675 - DNA, 23 bp, Artificial Sequence
  Synthetic
ccccatagacatctttagtcatt

SEQ ID NO: 31676 - DNA, 22 bp, Artificial Sequence
  Synthetic
gtaaaactttaacttcacccca

SEQ ID NO: 31677 - DNA, 19 bp, Artificial Sequence
  Synthetic
gtactttgggactgctcag

SEQ ID NO: 31678 - DNA, 20 bp, Artificial Sequence
  Synthetic
cgggtaagatgatctggtgg

SEQ ID NO: 31679 - DNA, 19 bp, Artificial Sequence
  Synthetic
attctctgatcgcctaagc

SEQ ID NO: 31680 - DNA, 25 bp, Artificial Sequence
  Synthetic
taataatatctagctctcctgtgtt

SEQ ID NO: 31681 - DNA, 22 bp, Artificial Sequence
  Synthetic
agtggtttctggtaatacagta

SEQ ID NO: 31682 - DNA, 18 bp, Artificial Sequence
  Synthetic
ttgtcaaaggcgggattt

SEQ ID NO: 31683 - DNA, 21 bp, Artificial Sequence
  Synthetic
accatcacctacatcatcaat

SEQ ID NO: 31684 - DNA, 25 bp, Artificial Sequence
  Synthetic
gaaagaataatgatgtttcttggac

SEQ ID NO: 31685 - DNA, 20 bp, Artificial Sequence
  Synthetic
agttgcaaagattcacagtg

SEQ ID NO: 31686 - DNA, 18 bp, Artificial Sequence
  Synthetic
caaatccaaccgctatcg

SEQ ID NO: 31687 - DNA, 21 bp, Artificial Sequence
  Synthetic
tcatacaacttctacaacacg

SEQ ID NO: 31688 - DNA, 22 bp, Artificial Sequence
  Synthetic
accttgtacaaataaaggacag

SEQ ID NO: 31689 - DNA, 18 bp, Artificial Sequence
  Synthetic
aagctgcacaatagcgtc

SEQ ID NO: 31690 - DNA, 21 bp, Artificial Sequence
  Synthetic
cccattgaaccatttctgaaa

SEQ ID NO: 31691 - DNA, 25 bp, Artificial Sequence
  Synthetic
ggtgctttatgttttgaatctatag

SEQ ID NO: 31692 - DNA, 25 bp, Artificial Sequence
  Synthetic
gatgaaagcctattcttttaattcc

SEQ ID NO: 31693 - DNA, 18 bp, Artificial Sequence
  Synthetic
ctttcgtcgtacctcctc

SEQ ID NO: 31694 - DNA, 23 bp, Artificial Sequence
  Synthetic
acaaatgttttacagaatccctt

SEQ ID NO: 31695 - DNA, 24 bp, Artificial Sequence
  Synthetic
tttctgttataatggctatttccc

SEQ ID NO: 31696 - DNA, 19 bp, Artificial Sequence
  Synthetic
cacgtcctgttgaaattgt

SEQ ID NO: 31697 - DNA, 22 bp, Artificial Sequence
  Synthetic
atcactagcagattctaagtct

SEQ ID NO: 31698 - DNA, 21 bp, Artificial Sequence
  Synthetic
ggttttcagtgtcccctaatt

SEQ ID NO: 31699 - DNA, 18 bp, Artificial Sequence
  Synthetic
aaaaggtcctggaatggc

SEQ ID NO: 31700 - DNA, 21 bp, Artificial Sequence
  Synthetic
aggatcgactttttctgaagt

SEQ ID NO: 31701 - DNA, 20 bp, Artificial Sequence
  Synthetic
tgtgtatgtccgatcctttc

SEQ ID NO: 31702 - DNA, 18 bp, Artificial Sequence
  Synthetic
tttgctgctgattctgca

SEQ ID NO: 31703 - DNA, 16 bp, Artificial Sequence
  Synthetic
gccgggtcgccatgtt

SEQ ID NO: 31704 - DNA, 18 bp, Artificial Sequence
  Synthetic
gaggtatcggttcgccac

SEQ ID NO: 31705 - DNA, 17 bp, Artificial Sequence
  Synthetic
tggggagaaagacggcg

SEQ ID NO: 31706 - DNA, 18 bp, Artificial Sequence
  Synthetic
tctacggagctggccatg

SEQ ID NO: 31707 - DNA, 16 bp, Artificial Sequence
  Synthetic
acgcacgggtgtttgc

SEQ ID NO: 31708 - DNA, 17 bp, Artificial Sequence
  Synthetic
cgacggctgacacacca

SEQ ID NO: 31709 - DNA, 17 bp, Artificial Sequence
  Synthetic
acatcaccaaccccgcc

SEQ ID NO: 31710 - DNA, 20 bp, Artificial Sequence
  Synthetic
gtggatgattaacgccctgt

SEQ ID NO: 31711 - DNA, 16 bp, Artificial Sequence
  Synthetic
aatggggacgtgcggc

SEQ ID NO: 31712 - DNA, 16 bp, Artificial Sequence
  Synthetic
gtcggggtggcacaga

SEQ ID NO: 31713 - DNA, 19 bp, Artificial Sequence
  Synthetic
gacttctgctctcggagga

SEQ ID NO: 31714 - DNA, 17 bp, Artificial Sequence
  Synthetic
gggagctgttgtgcctg

SEQ ID NO: 31715 - DNA, 16 bp, Artificial Sequence
  Synthetic
tggaagcgcgccttgg

SEQ ID NO: 31716 - DNA, 16 bp, Artificial Sequence
  Synthetic
atcgagcggcagcagc

SEQ ID NO: 31717 - DNA, 16 bp, Artificial Sequence
  Synthetic
ccgtgcacctgacgca

SEQ ID NO: 31718 - DNA, 20 bp, Artificial Sequence
  Synthetic
ccctgatcattacccccgtc

SEQ ID NO: 31719 - DNA, 18 bp, Artificial Sequence
  Synthetic
cagggctacgtgctcgac

SEQ ID NO: 31720 - DNA, 19 bp, Artificial Sequence
  Synthetic
cagtcttccgctgacaacc

SEQ ID NO: 31721 - DNA, 16 bp, Artificial Sequence
  Synthetic
gcgccacctccgcaat

SEQ ID NO: 31722 - DNA, 16 bp, Artificial Sequence
  Synthetic
taaccgcacccccctc

SEQ ID NO: 31723 - DNA, 20 bp, Artificial Sequence
  Synthetic
gcgcgacctgtgttaaaatt

SEQ ID NO: 31724 - DNA, 16 bp, Artificial Sequence
  Synthetic
cgagacgcacctccga

SEQ ID NO: 31725 - DNA, 20 bp, Artificial Sequence
  Synthetic
gaacaccttctttgccctct

SEQ ID NO: 31726 - DNA, 16 bp, Artificial Sequence
  Synthetic
gtgtggcgcgtcgttc

SEQ ID NO: 31727 - DNA, 18 bp, Artificial Sequence
  Synthetic
cctccgttggcgaatacg

SEQ ID NO: 31728 - DNA, 19 bp, Artificial Sequence
  Synthetic
cgtacaaatcgggggccat

SEQ ID NO: 31729 - DNA, 16 bp, Artificial Sequence
  Synthetic
tgggcgctcacgagac

SEQ ID NO: 31730 - DNA, 19 bp, Artificial Sequence
  Synthetic
aacgctctactgcagatgc

SEQ ID NO: 31731 - DNA, 16 bp, Artificial Sequence
  Synthetic
agggccaagcgacgga

SEQ ID NO: 31732 - DNA, 16 bp, Artificial Sequence
  Synthetic
acctcaacggggcctc

SEQ ID NO: 31733 - DNA, 17 bp, Artificial Sequence
  Synthetic
tcagtcccgtggccttg

SEQ ID NO: 31734 - DNA, 17 bp, Artificial Sequence
  Synthetic
acgaccgcaactacccg

SEQ ID NO: 31735 - DNA, 16 bp, Artificial Sequence
  Synthetic
gtatcggcgcgcatcg

SEQ ID NO: 31736 - DNA, 15 bp, Artificial Sequence
  Synthetic
tttcccgcgtgcgct

SEQ ID NO: 31737 - DNA, 18 bp, Artificial Sequence
  Synthetic
gatcgtctgccgttgtcg

SEQ ID NO: 31738 - DNA, 18 bp, Artificial Sequence
  Synthetic
cgcacacaaagtaggccc

SEQ ID NO: 31739 - DNA, 19 bp, Artificial Sequence
  Synthetic
cctccctgcgctttgatct

SEQ ID NO: 31740 - DNA, 16 bp, Artificial Sequence
  Synthetic
ctgtcgcgggcatacg

SEQ ID NO: 31741 - DNA, 16 bp, Artificial Sequence
  Synthetic
tgctggcgttcgtggc

SEQ ID NO: 31742 - DNA, 20 bp, Artificial Sequence
  Synthetic
tcgcatattaaggtgacgcg

SEQ ID NO: 31743 - DNA, 16 bp, Artificial Sequence
  Synthetic
tcccgccggatccaaa

SEQ ID NO: 31744 - DNA, 16 bp, Artificial Sequence
  Synthetic
tgcgctgggcctgtag

SEQ ID NO: 31745 - DNA, 16 bp, Artificial Sequence
  Synthetic
acggcgcactcgaagg

SEQ ID NO: 31746 - DNA, 19 bp, Artificial Sequence
  Synthetic
cccgctaaccaccaaggag

SEQ ID NO: 31747 - DNA, 16 bp, Artificial Sequence
  Synthetic
ggacaccggcgctact

SEQ ID NO: 31748 - DNA, 18 bp, Artificial Sequence
  Synthetic
cgatatgttgggccgcgt

SEQ ID NO: 31749 - DNA, 17 bp, Artificial Sequence
  Synthetic
accgagtacccgctctc

SEQ ID NO: 31750 - DNA, 18 bp, Artificial Sequence
  Synthetic
acgacccccaagttcacc

SEQ ID NO: 31751 - DNA, 18 bp, Artificial Sequence
  Synthetic
gcctaccagaagcccgac

SEQ ID NO: 31752 - DNA, 18 bp, Artificial Sequence
  Synthetic
gccgtgtaccaggacctg

SEQ ID NO: 31753 - DNA, 16 bp, Artificial Sequence
  Synthetic
acggatccgagaccgc

SEQ ID NO: 31754 - DNA, 16 bp, Artificial Sequence
  Synthetic
accgcgccctcctgta

SEQ ID NO: 31755 - DNA, 16 bp, Artificial Sequence
  Synthetic
accttgtcgggcgtcc

SEQ ID NO: 31756 - DNA, 18 bp, Artificial Sequence
  Synthetic
ccccaccctcgtacttct

SEQ ID NO: 31757 - DNA, 20 bp, Artificial Sequence
  Synthetic
cgtacaccgagttacacacg

SEQ ID NO: 31758 - DNA, 17 bp, Artificial Sequence
  Synthetic
tggcgatcagcagcagc

SEQ ID NO: 31759 - DNA, 18 bp, Artificial Sequence
  Synthetic
ggattcttggccaacccg

SEQ ID NO: 31760 - DNA, 16 bp, Artificial Sequence
  Synthetic
tgcgaagagtcccccg

SEQ ID NO: 31761 - DNA, 16 bp, Artificial Sequence
  Synthetic
cgtccgtccggcatct

SEQ ID NO: 31762 - DNA, 19 bp, Artificial Sequence
  Synthetic
catcctgttgcgggatctg

SEQ ID NO: 31763 - DNA, 18 bp, Artificial Sequence
  Synthetic
gtgtcttctcgcgcgtat

SEQ ID NO: 31764 - DNA, 18 bp, Artificial Sequence
  Synthetic
aacaggccgggtctctgg

SEQ ID NO: 31765 - DNA, 16 bp, Artificial Sequence
  Synthetic
aacgtcctcgccgacc

SEQ ID NO: 31766 - DNA, 16 bp, Artificial Sequence
  Synthetic
aagatggcgccggtcc

SEQ ID NO: 31767 - DNA, 16 bp, Artificial Sequence
  Synthetic
ccccagatcgcgacct

SEQ ID NO: 31768 - DNA, 18 bp, Artificial Sequence
  Synthetic
gacgcaagctcacaggag

SEQ ID NO: 31769 - DNA, 18 bp, Artificial Sequence
  Synthetic
ccaccagcgagtcaagga

SEQ ID NO: 31770 - DNA, 16 bp, Artificial Sequence
  Synthetic
acgcatcgggccagat

SEQ ID NO: 31771 - DNA, 20 bp, Artificial Sequence
  Synthetic
gaaacgcctgcctatctacc

SEQ ID NO: 31772 - DNA, 20 bp, Artificial Sequence
  Synthetic
ggtcaattgtatggagccgg

SEQ ID NO: 31773 - DNA, 17 bp, Artificial Sequence
  Synthetic
acacgctcaggagggag

SEQ ID NO: 31774 - DNA, 16 bp, Artificial Sequence
  Synthetic
cctcgcgggcagcaaa

SEQ ID NO: 31775 - DNA, 17 bp, Artificial Sequence
  Synthetic
acctccacacggaccac

SEQ ID NO: 31776 - DNA, 17 bp, Artificial Sequence
  Synthetic
tgtggtgaacccgtcgg

SEQ ID NO: 31777 - DNA, 16 bp, Artificial Sequence
  Synthetic
tcgtcctgcagcggct

SEQ ID NO: 31778 - DNA, 18 bp, Artificial Sequence
  Synthetic
tgctcgatctcccggacg

SEQ ID NO: 31779 - DNA, 18 bp, Artificial Sequence
  Synthetic
gacaggagccaatgtggg

SEQ ID NO: 31780 - DNA, 19 bp, Artificial Sequence
  Synthetic
cctcaacgaactccttggc

SEQ ID NO: 31781 - DNA, 18 bp, Artificial Sequence
  Synthetic
aagactctcccccaccgc

SEQ ID NO: 31782 - DNA, 16 bp, Artificial Sequence
  Synthetic
tggggtccctggacga

SEQ ID NO: 31783 - DNA, 17 bp, Artificial Sequence
  Synthetic
acgtagctcccgatggc

SEQ ID NO: 31784 - DNA, 20 bp, Artificial Sequence
  Synthetic
cgtcaatggtaaacagcgtg

SEQ ID NO: 31785 - DNA, 16 bp, Artificial Sequence
  Synthetic
acacgagggcggtgtc

SEQ ID NO: 31786 - DNA, 18 bp, Artificial Sequence
  Synthetic
cacgctcgatacgatgcg

SEQ ID NO: 31787 - DNA, 16 bp, Artificial Sequence
  Synthetic
tatcggctccggtccg

SEQ ID NO: 31788 - DNA, 17 bp, Artificial Sequence
  Synthetic
ccgctggtctcacagga

SEQ ID NO: 31789 - DNA, 16 bp, Artificial Sequence
  Synthetic
tcttgtcgggcctccc

SEQ ID NO: 31790 - DNA, 16 bp, Artificial Sequence
  Synthetic
atggagcgcggggaac

SEQ ID NO: 31791 - DNA, 16 bp, Artificial Sequence
  Synthetic
acgcatgccagcccaa

SEQ ID NO: 31792 - DNA, 18 bp, Artificial Sequence
  Synthetic
ccctgtcgtttgggtccc

SEQ ID NO: 31793 - DNA, 20 bp, Artificial Sequence
  Synthetic
gtcataagaccagtcggacg

SEQ ID NO: 31794 - DNA, 16 bp, Artificial Sequence
  Synthetic
gcggcgtccgtgttgt

SEQ ID NO: 31795 - DNA, 16 bp, Artificial Sequence
  Synthetic
acccaaacccacccgc

SEQ ID NO: 31796 - DNA, 20 bp, Artificial Sequence
  Synthetic
cgtaatgaccctccttgacc

SEQ ID NO: 31797 - DNA, 17 bp, Artificial Sequence
  Synthetic
tgtcccccgtaaacgcg

SEQ ID NO: 31798 - DNA, 19 bp, Artificial Sequence
  Synthetic
ggcaaggatctcctgcaga

SEQ ID NO: 31799 - DNA, 17 bp, Artificial Sequence
  Synthetic
cagtcaccagcttggcc

SEQ ID NO: 31800 - DNA, 17 bp, Artificial Sequence
  Synthetic
atgcaggtccaggaggg

SEQ ID NO: 31801 - DNA, 18 bp, Artificial Sequence
  Synthetic
tgtcgcggtggataatgc

SEQ ID NO: 31802 - DNA, 16 bp, Artificial Sequence
  Synthetic
cgaggtgaggcgcgat

SEQ ID NO: 31803 - DNA, 16 bp, Artificial Sequence
  Synthetic
atgttcgccgtccccg

SEQ ID NO: 31804 - DNA, 20 bp, Artificial Sequence
  Synthetic
gccaagtcgtgtgctgtttc

SEQ ID NO: 31805 - DNA, 16 bp, Artificial Sequence
  Synthetic
acggcaaagcccccca

SEQ ID NO: 31806 - DNA, 20 bp, Artificial Sequence
  Synthetic
tgtggtcggtatggacgata

SEQ ID NO: 31807 - DNA, 18 bp, Artificial Sequence
  Synthetic
gtaggtggtgtgggggac

SEQ ID NO: 31808 - DNA, 18 bp, Artificial Sequence
  Synthetic
ggtcgcaggagccatagg

SEQ ID NO: 31809 - DNA, 16 bp, Artificial Sequence
  Synthetic
aactggggccggttgc

SEQ ID NO: 31810 - DNA, 16 bp, Artificial Sequence
  Synthetic
tgcgtctgcgtcgacg

SEQ ID NO: 31811 - DNA, 17 bp, Artificial Sequence
  Synthetic
tgggtgcaaattgcggg

SEQ ID NO: 31812 - DNA, 21 bp, Artificial Sequence
  Synthetic
attgctgatgttgacatatgt

SEQ ID NO: 31813 - DNA, 22 bp, Artificial Sequence
  Synthetic
tacagtaaagcaagagccattt

SEQ ID NO: 31814 - DNA, 20 bp, Artificial Sequence
  Synthetic
ccgaaaactccactgcatat

SEQ ID NO: 31815 - DNA, 23 bp, Artificial Sequence
  Synthetic
agttattgctacgatatcttgtt

SEQ ID NO: 31816 - DNA, 19 bp, Artificial Sequence
  Synthetic
caaacagtgggggaaagcc

SEQ ID NO: 31817 - DNA, 23 bp, Artificial Sequence
  Synthetic
cgttgacatactttccaatcaat

SEQ ID NO: 31818 - DNA, 20 bp, Artificial Sequence
  Synthetic
cccaactcctcccagtcttt

SEQ ID NO: 31819 - DNA, 24 bp, Artificial Sequence
  Synthetic
ataactgtttctcttccaaaagtg

SEQ ID NO: 31820 - DNA, 19 bp, Artificial Sequence
  Synthetic
ctaccttgttggcgtctgg

SEQ ID NO: 31821 - DNA, 20 bp, Artificial Sequence
  Synthetic
ttcattgccatcatccattt

SEQ ID NO: 31822 - DNA, 18 bp, Artificial Sequence
  Synthetic
gaacagggccaaaggttc

SEQ ID NO: 31823 - DNA, 23 bp, Artificial Sequence
  Synthetic
atatatccacagcttgttcttca

SEQ ID NO: 31824 - DNA, 19 bp, Artificial Sequence
  Synthetic
ctcactatgagctgaacca

SEQ ID NO: 31825 - DNA, 21 bp, Artificial Sequence
  Synthetic
ctggtaatactccaaccattc

SEQ ID NO: 31826 - DNA, 19 bp, Artificial Sequence
  Synthetic
gacagcttcccaatttctg

SEQ ID NO: 31827 - DNA, 20 bp, Artificial Sequence
  Synthetic
cagtgaagagaactgcattc

SEQ ID NO: 31828 - DNA, 18 bp, Artificial Sequence
  Synthetic
gcacattagccttttccc

SEQ ID NO: 31829 - DNA, 18 bp, Artificial Sequence
  Synthetic
ctttcatacgcagctgtg

SEQ ID NO: 31830 - DNA, 21 bp, Artificial Sequence
  Synthetic
tgattgttgcttgtttacctt

SEQ ID NO: 31831 - DNA, 19 bp, Artificial Sequence
  Synthetic
gcaaatgactcctggaaca

SEQ ID NO: 31832 - DNA, 19 bp, Artificial Sequence
  Synthetic
cgctttaggaactggattg

SEQ ID NO: 31833 - DNA, 21 bp, Artificial Sequence
  Synthetic
aatgatacaccaaacgtttct

SEQ ID NO: 31834 - DNA, 21 bp, Artificial Sequence
  Synthetic
tacttcattagcataggcaga

SEQ ID NO: 31835 - DNA, 20 bp, Artificial Sequence
  Synthetic
gtagatgttttcgccctggg

SEQ ID NO: 31836 - DNA, 18 bp, Artificial Sequence
  Synthetic
gccgtacaggaattgcat

SEQ ID NO: 31837 - DNA, 18 bp, Artificial Sequence
  Synthetic
ttaggagcttggggtgtc

SEQ ID NO: 31838 - DNA, 19 bp, Artificial Sequence
  Synthetic
aatgattgttccccgtctg

SEQ ID NO: 31839 - DNA, 24 bp, Artificial Sequence
  Synthetic
cccttcaaaattttctacttgagt

SEQ ID NO: 31840 - DNA, 20 bp, Artificial Sequence
  Synthetic
gattaccagatacctttggc

SEQ ID NO: 31841 - DNA, 19 bp, Artificial Sequence
  Synthetic
caatgagcccctattggag

SEQ ID NO: 31842 - DNA, 25 bp, Artificial Sequence
  Synthetic
cgtaaaagaaaagttcatcaccata

SEQ ID NO: 31843 - DNA, 18 bp, Artificial Sequence
  Synthetic
gttttacgcgtcgtgttg

SEQ ID NO: 31844 - DNA, 19 bp, Artificial Sequence
  Synthetic
aaataattgttgggtgcgg

SEQ ID NO: 31845 - DNA, 19 bp, Artificial Sequence
  Synthetic
atgaaacgtttacggtcgt

SEQ ID NO: 31846 - DNA, 18 bp, Artificial Sequence
  Synthetic
tgtcacccttatgcgaca

SEQ ID NO: 31847 - DNA, 18 bp, Artificial Sequence
  Synthetic
gccattttgatttcccgc

SEQ ID NO: 31848 - DNA, 20 bp, Artificial Sequence
  Synthetic
atcccgagcttcttcctgta

SEQ ID NO: 31849 - DNA, 25 bp, Artificial Sequence
  Synthetic
gtactatactttgaggacctatagg

SEQ ID NO: 31850 - DNA, 19 bp, Artificial Sequence
  Synthetic
ggcacttggtaaagcatct

SEQ ID NO: 31851 - DNA, 24 bp, Artificial Sequence
  Synthetic
gtactgttccataaatctactgta

SEQ ID NO: 31852 - DNA, 20 bp, Artificial Sequence
  Synthetic
attctgctgactctgactaa

SEQ ID NO: 31853 - DNA, 20 bp, Artificial Sequence
  Synthetic
gcagctgtatagtctgttct

SEQ ID NO: 31854 - DNA, 21 bp, Artificial Sequence
  Synthetic
atgaaacttaccgaaaacggt

SEQ ID NO: 31855 - DNA, 18 bp, Artificial Sequence
  Synthetic
cctctgcctcttgtgaga

SEQ ID NO: 31856 - DNA, 19 bp, Artificial Sequence
  Synthetic
ggaacacccaggctctacc

SEQ ID NO: 31857 - DNA, 19 bp, Artificial Sequence
  Synthetic
cgcctttctaggagcactc

SEQ ID NO: 31858 - DNA, 20 bp, Artificial Sequence
  Synthetic
gaatcttttggcaaccttct

SEQ ID NO: 31859 - DNA, 20 bp, Artificial Sequence
  Synthetic
aatcctggcactacttctgc

SEQ ID NO: 31860 - DNA, 20 bp, Artificial Sequence
  Synthetic
agcttttgtagaacctgtct

SEQ ID NO: 31861 - DNA, 18 bp, Artificial Sequence
  Synthetic
acctgcctgtctttccgg

SEQ ID NO: 31862 - DNA, 18 bp, Artificial Sequence
  Synthetic
ttaggggccattgtttca

SEQ ID NO: 31863 - DNA, 22 bp, Artificial Sequence
  Synthetic
ttcctggttccatattgtttac

SEQ ID NO: 31864 - DNA, 19 bp, Artificial Sequence
  Synthetic
gtttctgcagcttccattt

SEQ ID NO: 31865 - DNA, 24 bp, Artificial Sequence
  Synthetic
ggtatgggtattttttatctttgc

SEQ ID NO: 31866 - DNA, 23 bp, Artificial Sequence
  Synthetic
ctttgtcttttcctctatctgtt

SEQ ID NO: 31867 - DNA, 21 bp, Artificial Sequence
  Synthetic
actagaaggggtattccaaat

SEQ ID NO: 31868 - DNA, 20 bp, Artificial Sequence
  Synthetic
ggctttgtgggttgtaaggt

SEQ ID NO: 31869 - DNA, 18 bp, Artificial Sequence
  Synthetic
atgactgctccttctccc

SEQ ID NO: 31870 - DNA, 18 bp, Artificial Sequence
  Synthetic
ccctctgatggctcttct

SEQ ID NO: 31871 - DNA, 20 bp, Artificial Sequence
  Synthetic
accctctcttgaaatgtgta

SEQ ID NO: 31872 - DNA, 21 bp, Artificial Sequence
  Synthetic
ttgtttagccaattcttgagc

SEQ ID NO: 31873 - DNA, 20 bp, Artificial Sequence
  Synthetic
gccatagaaaacagtcacat

SEQ ID NO: 31874 - DNA, 25 bp, Artificial Sequence
  Synthetic
tagaagtttcatttattatggaggc

SEQ ID NO: 31875 - DNA, 22 bp, Artificial Sequence
  Synthetic
caaagcctgaatagttggtatc

SEQ ID NO: 31876 - DNA, 22 bp, Artificial Sequence
  Synthetic
ttgtatctgggatgttgtacaa

SEQ ID NO: 31877 - DNA, 23 bp, Artificial Sequence
  Synthetic
cactaaaggtaatgttggtatga

SEQ ID NO: 31878 - DNA, 23 bp, Artificial Sequence
  Synthetic
attcttttcttgttgaatttggg

SEQ ID NO: 31879 - DNA, 20 bp, Artificial Sequence
  Synthetic
ccgcaagagtctctctcgta

SEQ ID NO: 31880 - DNA, 25 bp, Artificial Sequence
  Synthetic
ccccctttttcttttataaaatgtg

SEQ ID NO: 31881 - DNA, 22 bp, Artificial Sequence
  Synthetic
tttcttagtagctacttcctgc

SEQ ID NO: 31882 - DNA, 20 bp, Artificial Sequence
  Synthetic
ggagagatgggaacacacac

SEQ ID NO: 31883 - DNA, 19 bp, Artificial Sequence
  Synthetic
aggtgttgttgttagtggt

SEQ ID NO: 31884 - DNA, 25 bp, Artificial Sequence
  Synthetic
ctgtattgataacattactggttga

SEQ ID NO: 31885 - DNA, 21 bp, Artificial Sequence
  Synthetic
catagagtctttccatttggg

SEQ ID NO: 31886 - DNA, 19 bp, Artificial Sequence
  Synthetic
ccaattaaaggcaaggacc

SEQ ID NO: 31887 - DNA, 19 bp, Artificial Sequence
  Synthetic
atgagatgtgtatccgtgc

SEQ ID NO: 31888 - DNA, 20 bp, Artificial Sequence
  Synthetic
ctttcaagtgccaagagatg

SEQ ID NO: 31889 - DNA, 24 bp, Artificial Sequence
  Synthetic
gctatcattaatgttacagccaag

SEQ ID NO: 31890 - DNA, 18 bp, Artificial Sequence
  Synthetic
acttctgtggtcaccgtt

SEQ ID NO: 31891 - DNA, 20 bp, Artificial Sequence
  Synthetic
gcactggagctaggatgagt

SEQ ID NO: 31892 - DNA, 18 bp, Artificial Sequence
  Synthetic
gactcaggtaccccttcc

SEQ ID NO: 31893 - DNA, 18 bp, Artificial Sequence
  Synthetic
ccatccacacattctgct

SEQ ID NO: 31894 - DNA, 19 bp, Artificial Sequence
  Synthetic
gtttagggctcaaatcagc

SEQ ID NO: 31895 - DNA, 21 bp, Artificial Sequence
  Synthetic
tcgctttcatacagagtcatt

SEQ ID NO: 31896 - DNA, 19 bp, Artificial Sequence
  Synthetic
agtccattgtccagattgt

SEQ ID NO: 31897 - DNA, 20 bp, Artificial Sequence
  Synthetic
cctgtaccaatacccaaacc

SEQ ID NO: 31898 - DNA, 22 bp, Artificial Sequence
  Synthetic
acctaaagctgtagtaggattt

SEQ ID NO: 31899 - DNA, 20 bp, Artificial Sequence
  Synthetic
tttcctcaacatctccaact

SEQ ID NO: 31900 - DNA, 20 bp, Artificial Sequence
  Synthetic
tgcatcaaatacaggattgg

SEQ ID NO: 31901 - DNA, 19 bp, Artificial Sequence
  Synthetic
gcatttcaaagctctctgc

SEQ ID NO: 31902 - DNA, 25 bp, Artificial Sequence
  Synthetic
gtttctgtaacatattcatctgttg

SEQ ID NO: 31903 - DNA, 20 bp, Artificial Sequence
  Synthetic
aatagggatgtccagaacaa

SEQ ID NO: 31904 - DNA, 21 bp, Artificial Sequence
  Synthetic
ctttctataggaggacagtca

SEQ ID NO: 31905 - DNA, 20 bp, Artificial Sequence
  Synthetic
gtactctccattggtattgc

SEQ ID NO: 31906 - DNA, 20 bp, Artificial Sequence
  Synthetic
cagttggacatttagtagcc

SEQ ID NO: 31907 - DNA, 21 bp, Artificial Sequence
  Synthetic
ttcaagtttattcaggttgca

SEQ ID NO: 31908 - DNA, 23 bp, Artificial Sequence
  Synthetic
acagtaaaaacatcgaatggtaa

SEQ ID NO: 31909 - DNA, 21 bp, Artificial Sequence
  Synthetic
ccaataagtgaattgctccag

SEQ ID NO: 31910 - DNA, 20 bp, Artificial Sequence
  Synthetic
gctttctgattgctacttga

SEQ ID NO: 31911 - DNA, 23 bp, Artificial Sequence
  Synthetic
ttcttctgctaataaggcataat

SEQ ID NO: 31912 - DNA, 22 bp, Artificial Sequence
  Synthetic
acctaacacttcatatccttct

SEQ ID NO: 31913 - DNA, 20 bp, Artificial Sequence
  Synthetic
ctttcagctcgtcttcgtct

SEQ ID NO: 31914 - DNA, 21 bp, Artificial Sequence
  Synthetic
cctaccagtaccaatccctaa

SEQ ID NO: 31915 - DNA, 20 bp, Artificial Sequence
  Synthetic
acaatggatccacagaagtg

SEQ ID NO: 31916 - DNA, 19 bp, Artificial Sequence
  Synthetic
gttaccacgtcatcaaagg

SEQ ID NO: 31917 - DNA, 23 bp, Artificial Sequence
  Synthetic
attaatatcaaaacctgggacaa

SEQ ID NO: 31918 - DNA, 24 bp, Artificial Sequence
  Synthetic
aaatctatcaaaaagaggatgacc

SEQ ID NO: 31919 - DNA, 20 bp, Artificial Sequence
  Synthetic
tggataaaaaaaacgtccgt

SEQ ID NO: 31920 - DNA, 18 bp, Artificial Sequence
  Synthetic
gctgcttacgaggaacat

SEQ ID NO: 31921 - DNA, 18 bp, Artificial Sequence
  Synthetic
cgaaaatcagcgaccgaa

SEQ ID NO: 31922 - DNA, 19 bp, Artificial Sequence
  Synthetic
cctttcagggatcatctcc

SEQ ID NO: 31923 - DNA, 18 bp, Artificial Sequence
  Synthetic
aatgaacagggccaaagg

SEQ ID NO: 31924 - DNA, 20 bp, Artificial Sequence
  Synthetic
atatatacgctgcttgtccc

SEQ ID NO: 31925 - DNA, 21 bp, Artificial Sequence
  Synthetic
atgtctaccattcttactccg

SEQ ID NO: 31926 - DNA, 19 bp, Artificial Sequence
  Synthetic
ccacaataattgcctcagc

SEQ ID NO: 31927 - DNA, 23 bp, Artificial Sequence
  Synthetic
gcaatattccaatcatacccatg

SEQ ID NO: 31928 - DNA, 23 bp, Artificial Sequence
  Synthetic
gatatgtgttaactagcactgat

SEQ ID NO: 31929 - DNA, 21 bp, Artificial Sequence
  Synthetic
agtcagagaagaaaattgcat

SEQ ID NO: 31930 - DNA, 22 bp, Artificial Sequence
  Synthetic
gtaagattgctcagttcattga

SEQ ID NO: 31931 - DNA, 18 bp, Artificial Sequence
  Synthetic
ttttgagcagatcctggg

SEQ ID NO: 31932 - DNA, 18 bp, Artificial Sequence
  Synthetic
tcctacatgcactggttg

SEQ ID NO: 31933 - DNA, 22 bp, Artificial Sequence
  Synthetic
tttagcattagccaatgaaagt

SEQ ID NO: 31934 - DNA, 18 bp, Artificial Sequence
  Synthetic
catccctgttgctagcag

SEQ ID NO: 31935 - DNA, 22 bp, Artificial Sequence
  Synthetic
ggttttttctataagccggttt

SEQ ID NO: 31936 - DNA, 22 bp, Artificial Sequence
  Synthetic
catacagtcatcatcacacttg

SEQ ID NO: 31937 - DNA, 22 bp, Artificial Sequence
  Synthetic
tggttaagtggtttttacacca

SEQ ID NO: 31938 - DNA, 18 bp, Artificial Sequence
  Synthetic
ttctctgcactgggtaca

SEQ ID NO: 31939 - DNA, 18 bp, Artificial Sequence
  Synthetic
gtgtgtccagaagcatct

SEQ ID NO: 31940 - DNA, 23 bp, Artificial Sequence
  Synthetic
tgtacaactacttttgtcacttt

SEQ ID NO: 31941 - DNA, 18 bp, Artificial Sequence
  Synthetic
cactttgtaatcgtggcg

SEQ ID NO: 31942 - DNA, 21 bp, Artificial Sequence
  Synthetic
catacgtttcatttgtgcttt

SEQ ID NO: 31943 - DNA, 19 bp, Artificial Sequence
  Synthetic
tgtcctacttgtgcatagc

SEQ ID NO: 31944 - DNA, 18 bp, Artificial Sequence
  Synthetic
tgccatctagtgtttgca

SEQ ID NO: 31945 - DNA, 18 bp, Artificial Sequence
  Synthetic
gtgaccctttgcgatccg

SEQ ID NO: 31946 - DNA, 18 bp, Artificial Sequence
  Synthetic
tagtagctgcaaccagga

SEQ ID NO: 31947 - DNA, 22 bp, Artificial Sequence
  Synthetic
tggcattgataatacactttgg

SEQ ID NO: 31948 - DNA, 23 bp, Artificial Sequence
  Synthetic
atgttaagagtctaccattaccc

SEQ ID NO: 31949 - DNA, 21 bp, Artificial Sequence
  Synthetic
acataaacatcaaacaggcca

SEQ ID NO: 31950 - DNA, 25 bp, Artificial Sequence
  Synthetic
tcttaatagtataatatggatgccc

SEQ ID NO: 31951 - DNA, 25 bp, Artificial Sequence
  Synthetic
caggatatttactaatggagttcat

SEQ ID NO: 31952 - DNA, 20 bp, Artificial Sequence
  Synthetic
gttaccttagcttgacatcg

SEQ ID NO: 31953 - DNA, 20 bp, Artificial Sequence
  Synthetic
aaatgcaaagctatgccaac

SEQ ID NO: 31954 - DNA, 23 bp, Artificial Sequence
  Synthetic
gcattagaatcttcatctgctaa

SEQ ID NO: 31955 - DNA, 21 bp, Artificial Sequence
  Synthetic
tcttaaggcagtaaggaactc

SEQ ID NO: 31956 - DNA, 20 bp, Artificial Sequence
  Synthetic
tgttctccttctcctcctcg

SEQ ID NO: 31957 - DNA, 22 bp, Artificial Sequence
  Synthetic
taactgtaaggcttaggacatt

SEQ ID NO: 31958 - DNA, 24 bp, Artificial Sequence
  Synthetic
taaaactaggatctaaagcaatgc

SEQ ID NO: 31959 - DNA, 18 bp, Artificial Sequence
  Synthetic
tacgccatctggaatgct

SEQ ID NO: 31960 - DNA, 21 bp, Artificial Sequence
  Synthetic
cccaaaggatagcattattgc

SEQ ID NO: 31961 - DNA, 25 bp, Artificial Sequence
  Synthetic
aataaatctatacgaatcctccaag

SEQ ID NO: 31962 - DNA, 19 bp, Artificial Sequence
  Synthetic
atgagactgctctggtaac

SEQ ID NO: 31963 - DNA, 20 bp, Artificial Sequence
  Synthetic
gtggtaaggataaaggcaac

SEQ ID NO: 31964 - DNA, 18 bp, Artificial Sequence
  Synthetic
ggtacaaaggctgacagc

SEQ ID NO: 31965 - DNA, 20 bp, Artificial Sequence
  Synthetic
ggtgagtcccaattgtcctc

SEQ ID NO: 31966 - DNA, 19 bp, Artificial Sequence
  Synthetic
gccgatactcttccctcat

SEQ ID NO: 31967 - DNA, 20 bp, Artificial Sequence
  Synthetic
aaatcctccatacttttgcc

SEQ ID NO: 31968 - DNA, 18 bp, Artificial Sequence
  Synthetic
gtcaccgctcaataccag

SEQ ID NO: 31969 - DNA, 24 bp, Artificial Sequence
  Synthetic
tccttatatgtctcttcaagcttt

SEQ ID NO: 31970 - DNA, 19 bp, Artificial Sequence
  Synthetic
tgattgtgtcgttttccga

SEQ ID NO: 31971 - DNA, 24 bp, Artificial Sequence
  Synthetic
gagtccttatccatctttctaatt

SEQ ID NO: 31972 - DNA, 22 bp, Artificial Sequence
  Synthetic
ttttgtataagttgatccggag

SEQ ID NO: 31973 - DNA, 23 bp, Artificial Sequence
  Synthetic
tcacttttttgggtattagtctt

SEQ ID NO: 31974 - DNA, 20 bp, Artificial Sequence
  Synthetic
agaagcctagtaggaagaca

SEQ ID NO: 31975 - DNA, 21 bp, Artificial Sequence
  Synthetic
caaggttattgatccaattgc

SEQ ID NO: 31976 - DNA, 19 bp, Artificial Sequence
  Synthetic
ttgttggtgttgacctctt

SEQ ID NO: 31977 - DNA, 19 bp, Artificial Sequence
  Synthetic
cagagcaatggttccaatt

SEQ ID NO: 31978 - DNA, 24 bp, Artificial Sequence
  Synthetic
ctgaatgcttctatacattctttg

SEQ ID NO: 31979 - DNA, 20 bp, Artificial Sequence
  Synthetic
atcaagtgcaacagaattgt

SEQ ID NO: 31980 - DNA, 22 bp, Artificial Sequence
  Synthetic
caccaggattattgtccataat

SEQ ID NO: 31981 - DNA, 25 bp, Artificial Sequence
  Synthetic
agatcatttataattaaggacggag

SEQ ID NO: 31982 - DNA, 21 bp, Artificial Sequence
  Synthetic
tcctcctatctgaaaaccatg

SEQ ID NO: 31983 - DNA, 20 bp, Artificial Sequence
  Synthetic
gtaatgcagcttgttgttgt

SEQ ID NO: 31984 - DNA, 23 bp, Artificial Sequence
  Synthetic
cccaatttgatttttttggagat

SEQ ID NO: 31985 - DNA, 20 bp, Artificial Sequence
  Synthetic
gcatgcatatcctagaacag

SEQ ID NO: 31986 - DNA, 22 bp, Artificial Sequence
  Synthetic
ggtctaatagattcgccttgat

SEQ ID NO: 31987 - DNA, 20 bp, Artificial Sequence
  Synthetic
gtttgtgccatctgaagaat

SEQ ID NO: 31988 - DNA, 22 bp, Artificial Sequence
  Synthetic
gtactggagaatttcatctgag

SEQ ID NO: 31989 - DNA, 20 bp, Artificial Sequence
  Synthetic
gtaaggcgtttgtagaatgg

SEQ ID NO: 31990 - DNA, 24 bp, Artificial Sequence
  Synthetic
ggtcagaaaatttcattatgttgc

SEQ ID NO: 31991 - DNA, 19 bp, Artificial Sequence
  Synthetic
gcgtagtgtatgcaaagca

SEQ ID NO: 31992 - DNA, 18 bp, Artificial Sequence
  Synthetic
cgggaacaacacacagtt

SEQ ID NO: 31993 - DNA, 20 bp, Artificial Sequence
  Synthetic
gaagcaacttgtcttctgac

SEQ ID NO: 31994 - DNA, 19 bp, Artificial Sequence
  Synthetic
ccttaagctttgtggtgac

SEQ ID NO: 31995 - DNA, 19 bp, Artificial Sequence
  Synthetic
gtcactaacaaagtacgcc

SEQ ID NO: 31996 - DNA, 22 bp, Artificial Sequence
  Synthetic
aacaatagtatcaacgaaagct

SEQ ID NO: 31997 - DNA, 22 bp, Artificial Sequence
  Synthetic
ccttacacacgatatcacgtat

SEQ ID NO: 31998 - DNA, 22 bp, Artificial Sequence
  Synthetic
tgatggataataaacaccatcc

SEQ ID NO: 31999 - DNA, 18 bp, Artificial Sequence
  Synthetic
cgggcaaactcaagtcat

SEQ ID NO: 32000 - DNA, 18 bp, Artificial Sequence
  Synthetic
acatcacccatagcacca

SEQ ID NO: 32001 - DNA, 23 bp, Artificial Sequence
  Synthetic
gcacaaatattatggtaccttgt

SEQ ID NO: 32002 - DNA, 23 bp, Artificial Sequence
  Synthetic
gcagcatttacaataaagtcaaa

SEQ ID NO: 32003 - DNA, 18 bp, Artificial Sequence
  Synthetic
atgggtttgtcatcagcg

SEQ ID NO: 32004 - DNA, 20 bp, Artificial Sequence
  Synthetic
cttcagcagctttaagttca

SEQ ID NO: 32005 - DNA, 24 bp, Artificial Sequence
  Synthetic
tcacccaacaattattatcactag

SEQ ID NO: 32006 - DNA, 19 bp, Artificial Sequence
  Synthetic
aggtccagaaaaagcagta

SEQ ID NO: 32007 - DNA, 19 bp, Artificial Sequence
  Synthetic
ggtccaaaacgtacacaaa

SEQ ID NO: 32008 - DNA, 22 bp, Artificial Sequence
  Synthetic
ccaaatataagcagcaaaacca

SEQ ID NO: 32009 - DNA, 21 bp, Artificial Sequence
  Synthetic
gagtcacaatcaacacagaaa

SEQ ID NO: 32010 - DNA, 18 bp, Artificial Sequence
  Synthetic
caaccttagcacctgcac

SEQ ID NO: 32011 - DNA, 20 bp, Artificial Sequence
  Synthetic
ggcatgaaaaagcacaagta

SEQ ID NO: 32012 - DNA, 21 bp, Artificial Sequence
  Synthetic
gcagaagtaaaaatgcacttt

SEQ ID NO: 32013 - DNA, 18 bp, Artificial Sequence
  Synthetic
ccacaaaccagtaccaca

SEQ ID NO: 32014 - DNA, 22 bp, Artificial Sequence
  Synthetic
agatttgtcgaaactttaagct

SEQ ID NO: 32015 - DNA, 20 bp, Artificial Sequence
  Synthetic
ccattcaacacagtgtttcc

SEQ ID NO: 32016 - DNA, 22 bp, Artificial Sequence
  Synthetic
cggatagtccaattagttctca

SEQ ID NO: 32017 - DNA, 18 bp, Artificial Sequence
  Synthetic
aaaccattagcctgtgcc

SEQ ID NO: 32018 - DNA, 22 bp, Artificial Sequence
  Synthetic
cacttgcaaaaacaaaacctta

SEQ ID NO: 32019 - DNA, 22 bp, Artificial Sequence
  Synthetic
agaaattgcacaaagtagcata

SEQ ID NO: 32020 - DNA, 18 bp, Artificial Sequence
  Synthetic
ggttctaggaccgccaat

SEQ ID NO: 32021 - DNA, 22 bp, Artificial Sequence
  Synthetic
agaccaaaatcactatgcttag

SEQ ID NO: 32022 - DNA, 18 bp, Artificial Sequence
  Synthetic
catgtccaaacgtcggag

SEQ ID NO: 32023 - DNA, 22 bp, Artificial Sequence
  Synthetic
gcattatttcattgttctgcaa

SEQ ID NO: 32024 - DNA, 20 bp, Artificial Sequence
  Synthetic
agcacctctccttaaattgt

SEQ ID NO: 32025 - DNA, 18 bp, Artificial Sequence
  Synthetic
aatacaaacagacgcgcc

SEQ ID NO: 32026 - DNA, 22 bp, Artificial Sequence
  Synthetic
cgcatctttattgtaaacgtca

SEQ ID NO: 32027 - DNA, 18 bp, Artificial Sequence
  Synthetic
cacggtgtatgtcctcat

SEQ ID NO: 32028 - DNA, 21 bp, Artificial Sequence
  Synthetic
aaagttttgaagtcttgacca

SEQ ID NO: 32029 - DNA, 25 bp, Artificial Sequence
  Synthetic
cagtaatagtaagtctggtagaatg

SEQ ID NO: 32030 - DNA, 22 bp, Artificial Sequence
  Synthetic
gtaggtctgttgtaacgataat

SEQ ID NO: 32031 - DNA, 23 bp, Artificial Sequence
  Synthetic
ttctttaacatattatcccaccc

SEQ ID NO: 32032 - DNA, 23 bp, Artificial Sequence
  Synthetic
gcaaaattcatgaggtcctatag

SEQ ID NO: 32033 - DNA, 21 bp, Artificial Sequence
  Synthetic
ccttcgttaagagtcttgttg

SEQ ID NO: 32034 - DNA, 21 bp, Artificial Sequence
  Synthetic
atcattagcaagcttgtagtc

SEQ ID NO: 32035 - DNA, 18 bp, Artificial Sequence
  Synthetic
ctcctggtttgccattgt

SEQ ID NO: 32036 - DNA, 23 bp, Artificial Sequence
  Synthetic
tgtgcactattattgttaggttt

SEQ ID NO: 32037 - DNA, 20 bp, Artificial Sequence
  Synthetic
cctatagcacacatacgttg

SEQ ID NO: 32038 - DNA, 20 bp, Artificial Sequence
  Synthetic
gagcagtatctgatgtctgt

SEQ ID NO: 32039 - DNA, 21 bp, Artificial Sequence
  Synthetic
acatcaaacctgaaacccata

SEQ ID NO: 32040 - DNA, 19 bp, Artificial Sequence
  Synthetic
gttttacaacactgccagt

SEQ ID NO: 32041 - DNA, 23 bp, Artificial Sequence
  Synthetic
ggattataaacatagtcacagcc

SEQ ID NO: 32042 - DNA, 22 bp, Artificial Sequence
  Synthetic
ccttaggattaccaatgtcatg

SEQ ID NO: 32043 - DNA, 19 bp, Artificial Sequence
  Synthetic
acatgaaccgtcgtcatag

SEQ ID NO: 32044 - DNA, 20 bp, Artificial Sequence
  Synthetic
cgtacgaacactttatcacc

SEQ ID NO: 32045 - DNA, 23 bp, Artificial Sequence
  Synthetic
gagaataacacagcattagttga

SEQ ID NO: 32046 - DNA, 22 bp, Artificial Sequence
  Synthetic
gttgaaatcctctagaccatac

SEQ ID NO: 32047 - DNA, 21 bp, Artificial Sequence
  Synthetic
tgaggatagaatgtagcaacg

SEQ ID NO: 32048 - DNA, 21 bp, Artificial Sequence
  Synthetic
cacatagtcaacaacatcgtt

SEQ ID NO: 32049 - DNA, 18 bp, Artificial Sequence
  Synthetic
cacaacaacagtcgcttt

SEQ ID NO: 32050 - DNA, 20 bp, Artificial Sequence
  Synthetic
acaacaccatctacaacaga

SEQ ID NO: 32051 - DNA, 22 bp, Artificial Sequence
  Synthetic
acctaaagtgaaatagcgatag

SEQ ID NO: 32052 - DNA, 22 bp, Artificial Sequence
  Synthetic
tgtaatattaacaccagcagga

SEQ ID NO: 32053 - DNA, 19 bp, Artificial Sequence
  Synthetic
gacaacatagcaccaacaa

SEQ ID NO: 32054 - DNA, 23 bp, Artificial Sequence
  Synthetic
acgataggtgtacttgtaatttg

SEQ ID NO: 32055 - DNA, 23 bp, Artificial Sequence
  Synthetic
ccagaagtaacaagtttgctaaa

SEQ ID NO: 32056 - DNA, 21 bp, Artificial Sequence
  Synthetic
ctactatgttggtcattgctt

SEQ ID NO: 32057 - DNA, 21 bp, Artificial Sequence
  Synthetic
tttgacacactcattcacttt

SEQ ID NO: 32058 - DNA, 20 bp, Artificial Sequence
  Synthetic
caactcagagcgagaaatgt

SEQ ID NO: 32059 - DNA, 18 bp, Artificial Sequence
  Synthetic
taagtctcaacccggttg

SEQ ID NO: 32060 - DNA, 22 bp, Artificial Sequence
  Synthetic
tgaaacttcagcactaactttc

SEQ ID NO: 32061 - DNA, 19 bp, Artificial Sequence
  Synthetic
acacttaccttgcatagca

SEQ ID NO: 32062 - DNA, 19 bp, Artificial Sequence
  Synthetic
ggaaagggtctatgtgcat

SEQ ID NO: 32063 - DNA, 18 bp, Artificial Sequence
  Synthetic
cgaagtacatcacccaca

SEQ ID NO: 32064 - DNA, 20 bp, Artificial Sequence
  Synthetic
gccatcttttcgttcagttt

SEQ ID NO: 32065 - DNA, 21 bp, Artificial Sequence
  Synthetic
cgctctctaaattttgcatct

SEQ ID NO: 32066 - DNA, 19 bp, Artificial Sequence
  Synthetic
gaagaagcaggactctgat

SEQ ID NO: 32067 - DNA, 19 bp, Artificial Sequence
  Synthetic
cagcaaattgtggatagcc

SEQ ID NO: 32068 - DNA, 21 bp, Artificial Sequence
  Synthetic
tgaatttcaaacaacacagtg

SEQ ID NO: 32069 - DNA, 18 bp, Artificial Sequence
  Synthetic
ccattgttggctcgtcaa

SEQ ID NO: 32070 - DNA, 21 bp, Artificial Sequence
  Synthetic
agaacccacaaaaatgcataa

SEQ ID NO: 32071 - DNA, 23 bp, Artificial Sequence
  Synthetic
gctaggactagtatactttcgtt

SEQ ID NO: 32072 - DNA, 18 bp, Artificial Sequence
  Synthetic
gctgttgcaagcctgttg

SEQ ID NO: 32073 - DNA, 25 bp, Artificial Sequence
  Synthetic
tcccatatattattatcatatgccc

SEQ ID NO: 32074 - DNA, 23 bp, Artificial Sequence
  Synthetic
tggaataatagacacatcctgat

SEQ ID NO: 32075 - DNA, 19 bp, Artificial Sequence
  Synthetic
tctacctgtgcatgtgttt

SEQ ID NO: 32076 - DNA, 25 bp, Artificial Sequence
  Synthetic
ctatattttgttttacacctgtacc

SEQ ID NO: 32077 - DNA, 20 bp, Artificial Sequence
  Synthetic
cctcctcctgttcctatagg

SEQ ID NO: 32078 - DNA, 20 bp, Artificial Sequence
  Synthetic
agggacaacaatatcgggct

SEQ ID NO: 32079 - DNA, 24 bp, Artificial Sequence
  Synthetic
aggttcaatatcaaaggtagaaga

SEQ ID NO: 32080 - DNA, 19 bp, Artificial Sequence
  Synthetic
tgcaaaatccgggtcagga

SEQ ID NO: 32081 - DNA, 22 bp, Artificial Sequence
  Synthetic
ggtataggaaaagtggtaggac

SEQ ID NO: 32082 - DNA, 22 bp, Artificial Sequence
  Synthetic
ggaagaatactgaagtttccac

SEQ ID NO: 32083 - DNA, 21 bp, Artificial Sequence
  Synthetic
tttcagtgtcctttagcttgt

SEQ ID NO: 32084 - DNA, 19 bp, Artificial Sequence
  Synthetic
gaggctgtattctgctctt

SEQ ID NO: 32085 - DNA, 21 bp, Artificial Sequence
  Synthetic
acttttcatatggatctgcct

SEQ ID NO: 32086 - DNA, 19 bp, Artificial Sequence
  Synthetic
gggcgttgtcaaacaggac

SEQ ID NO: 32087 - DNA, 16 bp, Artificial Sequence
  Synthetic
ctgtgccacgcgtcct

SEQ ID NO: 32088 - DNA, 16 bp, Artificial Sequence
  Synthetic
cggccgagttgtctgc

SEQ ID NO: 32089 - DNA, 16 bp, Artificial Sequence
  Synthetic
gcacctcacccacgct

SEQ ID NO: 32090 - DNA, 18 bp, Artificial Sequence
  Synthetic
gcactcgtactgctcgct

SEQ ID NO: 32091 - DNA, 19 bp, Artificial Sequence
  Synthetic
gcgatctggtgggcattct

SEQ ID NO: 32092 - DNA, 18 bp, Artificial Sequence
  Synthetic
tttcctgcatgccgttta

SEQ ID NO: 32093 - DNA, 18 bp, Artificial Sequence
  Synthetic
cccctggacatctggaca

SEQ ID NO: 32094 - DNA, 17 bp, Artificial Sequence
  Synthetic
agtgtgtgcctgggtgt

SEQ ID NO: 32095 - DNA, 20 bp, Artificial Sequence
  Synthetic
ccctggagaggtcaggttac

SEQ ID NO: 32096 - DNA, 18 bp, Artificial Sequence
  Synthetic
agaggagcagggggacag

SEQ ID NO: 32097 - DNA, 18 bp, Artificial Sequence
  Synthetic
ccctgaaggtgaaccgct

SEQ ID NO: 32098 - DNA, 20 bp, Artificial Sequence
  Synthetic
cgaccagaaatagctgcagg

SEQ ID NO: 32099 - DNA, 19 bp, Artificial Sequence
  Synthetic
tcctcttcttgctggacga

SEQ ID NO: 32100 - DNA, 19 bp, Artificial Sequence
  Synthetic
gggtaaaagtgggagggca

SEQ ID NO: 32101 - DNA, 17 bp, Artificial Sequence
  Synthetic
ggggtgcctcacgagtt

SEQ ID NO: 32102 - DNA, 16 bp, Artificial Sequence
  Synthetic
tgcaaaaggccacggc

SEQ ID NO: 32103 - DNA, 16 bp, Artificial Sequence
  Synthetic
tcgcgaatctcccggg

SEQ ID NO: 32104 - DNA, 16 bp, Artificial Sequence
  Synthetic
taccccgggattggcc

SEQ ID NO: 32105 - DNA, 19 bp, Artificial Sequence
  Synthetic
cgaccgatgtactcaaccc

SEQ ID NO: 32106 - DNA, 16 bp, Artificial Sequence
  Synthetic
agtcccagctgcaggg

SEQ ID NO: 32107 - DNA, 18 bp, Artificial Sequence
  Synthetic
agctaacacggctcctgg

SEQ ID NO: 32108 - DNA, 20 bp, Artificial Sequence
  Synthetic
actccctcacacagatcctt

SEQ ID NO: 32109 - DNA, 20 bp, Artificial Sequence
  Synthetic
ctttttggcgctgttgacag

SEQ ID NO: 32110 - DNA, 16 bp, Artificial Sequence
  Synthetic
tcaggaggcgggggaa

SEQ ID NO: 32111 - DNA, 18 bp, Artificial Sequence
  Synthetic
gccacgacactcgaacca

SEQ ID NO: 32112 - DNA, 16 bp, Artificial Sequence
  Synthetic
agcccctcggttctcg

SEQ ID NO: 32113 - DNA, 16 bp, Artificial Sequence
  Synthetic
acgcagagaccgggag

SEQ ID NO: 32114 - DNA, 16 bp, Artificial Sequence
  Synthetic
accaccgcttgcctgg

SEQ ID NO: 32115 - DNA, 17 bp, Artificial Sequence
  Synthetic
ggacagacgtcgaggca

SEQ ID NO: 32116 - DNA, 18 bp, Artificial Sequence
  Synthetic
gctcaaactcctccccgt

SEQ ID NO: 32117 - DNA, 16 bp, Artificial Sequence
  Synthetic
gcgttcatggcctcgc

SEQ ID NO: 32118 - DNA, 16 bp, Artificial Sequence
  Synthetic
gagggccagcaggagt

SEQ ID NO: 32119 - DNA, 20 bp, Artificial Sequence
  Synthetic
gccagacctgtaaaacctca

SEQ ID NO: 32120 - DNA, 19 bp, Artificial Sequence
  Synthetic
gcctccgacgatgtccttt

SEQ ID NO: 32121 - DNA, 18 bp, Artificial Sequence
  Synthetic
tggagaatgtctgcgcca

SEQ ID NO: 32122 - DNA, 16 bp, Artificial Sequence
  Synthetic
acaggggctttgcgga

SEQ ID NO: 32123 - DNA, 16 bp, Artificial Sequence
  Synthetic
ttgcggaggccatcct

SEQ ID NO: 32124 - DNA, 17 bp, Artificial Sequence
  Synthetic
gggggaactccggctaa

SEQ ID NO: 32125 - DNA, 16 bp, Artificial Sequence
  Synthetic
ggcggctcaccttggt

SEQ ID NO: 32126 - DNA, 18 bp, Artificial Sequence
  Synthetic
gcccagatggaggcaaag

SEQ ID NO: 32127 - DNA, 19 bp, Artificial Sequence
  Synthetic
gtggagctgacatgctatt

SEQ ID NO: 32128 - DNA, 16 bp, Artificial Sequence
  Synthetic
ggtgcacacgccactc

SEQ ID NO: 32129 - DNA, 19 bp, Artificial Sequence
  Synthetic
gcacctcaacactagcctg

SEQ ID NO: 32130 - DNA, 17 bp, Artificial Sequence
  Synthetic
tttggccaccttcccct

SEQ ID NO: 32131 - DNA, 20 bp, Artificial Sequence
  Synthetic
tctgtacaatgccagcactg

SEQ ID NO: 32132 - DNA, 19 bp, Artificial Sequence
  Synthetic
caaggggcgcatagggata

SEQ ID NO: 32133 - DNA, 16 bp, Artificial Sequence
  Synthetic
accgaggcccgctact

SEQ ID NO: 32134 - DNA, 19 bp, Artificial Sequence
  Synthetic
tcgcgaattttgactgcaa

SEQ ID NO: 32135 - DNA, 20 bp, Artificial Sequence
  Synthetic
tttcctcaggcttggctaag

SEQ ID NO: 32136 - DNA, 20 bp, Artificial Sequence
  Synthetic
ggtgtcagacctgaagactg

SEQ ID NO: 32137 - DNA, 19 bp, Artificial Sequence
  Synthetic
ccgactcatctacggaggc

SEQ ID NO: 32138 - DNA, 17 bp, Artificial Sequence
  Synthetic
attgccgccgagttcag

SEQ ID NO: 32139 - DNA, 18 bp, Artificial Sequence
  Synthetic
ccgcacagaacctctccc

SEQ ID NO: 32140 - DNA, 16 bp, Artificial Sequence
  Synthetic
tccagcgtgcggtagc

SEQ ID NO: 32141 - DNA, 18 bp, Artificial Sequence
  Synthetic
gatggcgttatggcggtt

SEQ ID NO: 32142 - DNA, 20 bp, Artificial Sequence
  Synthetic
gggggaatatgttgaggtgg

SEQ ID NO: 32143 - DNA, 18 bp, Artificial Sequence
  Synthetic
caccgcgtcagcctgaaa

SEQ ID NO: 32144 - DNA, 17 bp, Artificial Sequence
  Synthetic
ggatgagcagggcctca

SEQ ID NO: 32145 - DNA, 21 bp, Artificial Sequence
  Synthetic
acaaacatcacaaagtacaca

SEQ ID NO: 32146 - DNA, 15 bp, Artificial Sequence
  Synthetic
tgcacgctcggctca

SEQ ID NO: 32147 - DNA, 18 bp, Artificial Sequence
  Synthetic
cggctactcgctgctcta

SEQ ID NO: 32148 - DNA, 19 bp, Artificial Sequence
  Synthetic
ccactcccttggatgtggg

SEQ ID NO: 32149 - DNA, 18 bp, Artificial Sequence
  Synthetic
agagggaggaggctaggc

SEQ ID NO: 32150 - DNA, 16 bp, Artificial Sequence
  Synthetic
tgtccggggagagcgt

SEQ ID NO: 32151 - DNA, 18 bp, Artificial Sequence
  Synthetic
acgctcagactcctcgtc

SEQ ID NO: 32152 - DNA, 16 bp, Artificial Sequence
  Synthetic
aagagggccgggatgg

SEQ ID NO: 32153 - DNA, 17 bp, Artificial Sequence
  Synthetic
ggcattgcccagcttgg

SEQ ID NO: 32154 - DNA, 19 bp, Artificial Sequence
  Synthetic
gattttgacaacctccacg

SEQ ID NO: 32155 - DNA, 20 bp, Artificial Sequence
  Synthetic
caccgtgctacctcagccta

SEQ ID NO: 32156 - DNA, 19 bp, Artificial Sequence
  Synthetic
cctgtttatcggcagccac

SEQ ID NO: 32157 - DNA, 19 bp, Artificial Sequence
  Synthetic
cggtcaagatggaggagct

SEQ ID NO: 32158 - DNA, 19 bp, Artificial Sequence
  Synthetic
gcaagggtaagccttctgg

SEQ ID NO: 32159 - DNA, 16 bp, Artificial Sequence
  Synthetic
tccagctccacgcgga

SEQ ID NO: 32160 - DNA, 16 bp, Artificial Sequence
  Synthetic
acaggggccgtctgtg

SEQ ID NO: 32161 - DNA, 17 bp, Artificial Sequence
  Synthetic
tccggcaggtgttccac

SEQ ID NO: 32162 - DNA, 18 bp, Artificial Sequence
  Synthetic
ccagtcacaggccccata

SEQ ID NO: 32163 - DNA, 19 bp, Artificial Sequence
  Synthetic
gcggggacaagctaaacac

SEQ ID NO: 32164 - DNA, 16 bp, Artificial Sequence
  Synthetic
tagcatgggaggcgcg

SEQ ID NO: 32165 - DNA, 18 bp, Artificial Sequence
  Synthetic
accaggcctacacagacc

SEQ ID NO: 32166 - DNA, 16 bp, Artificial Sequence
  Synthetic
agcgagaccctgcgct

SEQ ID NO: 32167 - DNA, 17 bp, Artificial Sequence
  Synthetic
ccaagcgcaaggccatc

SEQ ID NO: 32168 - DNA, 15 bp, Artificial Sequence
  Synthetic
atgcgggcaagggct

SEQ ID NO: 32169 - DNA, 16 bp, Artificial Sequence
  Synthetic
tgggggaggagggctt

SEQ ID NO: 32170 - DNA, 16 bp, Artificial Sequence
  Synthetic
tggccaccgagggtct

SEQ ID NO: 32171 - DNA, 16 bp, Artificial Sequence
  Synthetic
gggccctggatctgct

SEQ ID NO: 32172 - DNA, 16 bp, Artificial Sequence
  Synthetic
gagccccgctacacct

SEQ ID NO: 32173 - DNA, 16 bp, Artificial Sequence
  Synthetic
aggcctcgcacgagac

SEQ ID NO: 32174 - DNA, 18 bp, Artificial Sequence
  Synthetic
cttgggcatcatgcaggg

SEQ ID NO: 32175 - DNA, 19 bp, Artificial Sequence
  Synthetic
atgttcagggccatgtacg

SEQ ID NO: 32176 - DNA, 19 bp, Artificial Sequence
  Synthetic
ccgccacctcattctgaaa

SEQ ID NO: 32177 - DNA, 23 bp, Artificial Sequence
  Synthetic
accctgtccaaattaaacttaaa

SEQ ID NO: 32178 - DNA, 18 bp, Artificial Sequence
  Synthetic
gacttgcaacaggtgtct

SEQ ID NO: 32179 - DNA, 18 bp, Artificial Sequence
  Synthetic
ctactatgccactgtccc

SEQ ID NO: 32180 - DNA, 18 bp, Artificial Sequence
  Synthetic
aaagtttctgcagctgct

SEQ ID NO: 32181 - DNA, 20 bp, Artificial Sequence
  Synthetic
gagtcattaacctttcctgc

SEQ ID NO: 32182 - DNA, 18 bp, Artificial Sequence
  Synthetic
cttggcaggaatggagtc

SEQ ID NO: 32183 - DNA, 23 bp, Artificial Sequence
  Synthetic
acagtaatttctggttgatcaat

SEQ ID NO: 32184 - DNA, 23 bp, Artificial Sequence
  Synthetic
agtctggatttcttgttgaaact

SEQ ID NO: 32185 - DNA, 18 bp, Artificial Sequence
  Synthetic
ccttaggaactgcaacct

SEQ ID NO: 32186 - DNA, 25 bp, Artificial Sequence
  Synthetic
gatctccataaatatctttggtcat

SEQ ID NO: 32187 - DNA, 19 bp, Artificial Sequence
  Synthetic
ttcagcagacagtttctct

SEQ ID NO: 32188 - DNA, 18 bp, Artificial Sequence
  Synthetic
tttggcgcctttaggaac

SEQ ID NO: 32189 - DNA, 19 bp, Artificial Sequence
  Synthetic
tagttttccgttgtggctg

SEQ ID NO: 32190 - DNA, 19 bp, Artificial Sequence
  Synthetic
tttggttgtgttgtggttg

SEQ ID NO: 32191 - DNA, 22 bp, Artificial Sequence
  Synthetic
cactacagagacataagcattt

SEQ ID NO: 32192 - DNA, 19 bp, Artificial Sequence
  Synthetic
ctgtttatagctcccaggg

SEQ ID NO: 32193 - DNA, 21 bp, Artificial Sequence
  Synthetic
tttgtgtgcttttttgatccg

SEQ ID NO: 32194 - DNA, 21 bp, Artificial Sequence
  Synthetic
agatccattagaacacatcca

SEQ ID NO: 32195 - DNA, 25 bp, Artificial Sequence
  Synthetic
catggcaccttatatatttatgtct

SEQ ID NO: 32196 - DNA, 21 bp, Artificial Sequence
  Synthetic
gctgttccttctacagtttct

SEQ ID NO: 32197 - DNA, 18 bp, Artificial Sequence
  Synthetic
acaagctcttgcagttct

SEQ ID NO: 32198 - DNA, 21 bp, Artificial Sequence
  Synthetic
gcttctaacgataaccaagca

SEQ ID NO: 32199 - DNA, 22 bp, Artificial Sequence
  Synthetic
ggggactgatatactttcgttt

SEQ ID NO: 32200 - DNA, 21 bp, Artificial Sequence
  Synthetic
gcctctttaaacttagccatt

SEQ ID NO: 32201 - DNA, 21 bp, Artificial Sequence
  Synthetic
ggaggctcacttaataattgc

SEQ ID NO: 32202 - DNA, 22 bp, Artificial Sequence
  Synthetic
ttttactagtctggcttgactg

SEQ ID NO: 32203 - DNA, 18 bp, Artificial Sequence
  Synthetic
cagtgcattgaaacgtgc

SEQ ID NO: 32204 - DNA, 19 bp, Artificial Sequence
  Synthetic
gctgatctttgaaggcttt

SEQ ID NO: 32205 - DNA, 20 bp, Artificial Sequence
  Synthetic
aggcttttcgttggtatcgt

SEQ ID NO: 32206 - DNA, 17 bp, Artificial Sequence
  Synthetic
aagcagtccctcctcgg

SEQ ID NO: 32207 - DNA, 20 bp, Artificial Sequence
  Synthetic
atgaattgttgtctgtgctc

SEQ ID NO: 32208 - DNA, 24 bp, Artificial Sequence
  Synthetic
gctccactttattaattacatctg

SEQ ID NO: 32209 - DNA, 20 bp, Artificial Sequence
  Synthetic
tgacaatactgggtgctgtg

SEQ ID NO: 32210 - DNA, 23 bp, Artificial Sequence
  Synthetic
cagaaataatttgaaaagctgga

SEQ ID NO: 32211 - DNA, 18 bp, Artificial Sequence
  Synthetic
agaaatgaacctgtgcgc

SEQ ID NO: 32212 - DNA, 23 bp, Artificial Sequence
  Synthetic
cctcatctaacagtaagtcttca

SEQ ID NO: 32213 - DNA, 18 bp, Artificial Sequence
  Synthetic
ggcccgatactgattacc

SEQ ID NO: 32214 - DNA, 19 bp, Artificial Sequence
  Synthetic
gtacctgtttggggtcaaa

SEQ ID NO: 32215 - DNA, 24 bp, Artificial Sequence
  Synthetic
cctattaaacaattgagcatctga

SEQ ID NO: 32216 - DNA, 20 bp, Artificial Sequence
  Synthetic
gtttttgcctagtggggaat

SEQ ID NO: 32217 - DNA, 18 bp, Artificial Sequence
  Synthetic
aacgaggcaaactttcct

SEQ ID NO: 32218 - DNA, 19 bp, Artificial Sequence
  Synthetic
cgtgcttgtcttaggagat

SEQ ID NO: 32219 - DNA, 25 bp, Artificial Sequence
  Synthetic
caaactattttttcttcttagcagg

SEQ ID NO: 32220 - DNA, 19 bp, Artificial Sequence
  Synthetic
ccggaatcatagcttacct

SEQ ID NO: 32221 - DNA, 18 bp, Artificial Sequence
  Synthetic
caataccaacacccccac

SEQ ID NO: 32222 - DNA, 18 bp, Artificial Sequence
  Synthetic
tcttaatgcactgcgtgt

SEQ ID NO: 32223 - DNA, 22 bp, Artificial Sequence
  Synthetic
cggctacttagaaaatcatcga

SEQ ID NO: 32224 - DNA, 20 bp, Artificial Sequence
  Synthetic
tttctgcttgttgtgcataa

SEQ ID NO: 32225 - DNA, 18 bp, Artificial Sequence
  Synthetic
tagctctcgaatcgcttg

SEQ ID NO: 32226 - DNA, 18 bp, Artificial Sequence
  Synthetic
aaatccttgcagagctcc

SEQ ID NO: 32227 - DNA, 18 bp, Artificial Sequence
  Synthetic
tcatagctgcagccaatt

SEQ ID NO: 32228 - DNA, 22 bp, Artificial Sequence
  Synthetic
ccacaataaaggatctagctct

SEQ ID NO: 32229 - DNA, 21 bp, Artificial Sequence
  Synthetic
agggactttagatccttttgc

SEQ ID NO: 32230 - DNA, 20 bp, Artificial Sequence
  Synthetic
gtcatcaagacctgatcctt

SEQ ID NO: 32231 - DNA, 21 bp, Artificial Sequence
  Synthetic
gtcaaattgcattacaacgaa

SEQ ID NO: 32232 - DNA, 21 bp, Artificial Sequence
  Synthetic
aatgcgactaattttcacagc

SEQ ID NO: 32233 - DNA, 22 bp, Artificial Sequence
  Synthetic
gctaaacagtaatctcctccat

SEQ ID NO: 32234 - DNA, 18 bp, Artificial Sequence
  Synthetic
tcaaaaggaagcattcgc

SEQ ID NO: 32235 - DNA, 20 bp, Artificial Sequence
  Synthetic
ttactcgtttagcctcttca

SEQ ID NO: 32236 - DNA, 18 bp, Artificial Sequence
  Synthetic
atccggttttgcaaatgg

SEQ ID NO: 32237 - DNA, 20 bp, Artificial Sequence
  Synthetic
accacagaggaatctcaaac

SEQ ID NO: 32238 - DNA, 18 bp, Artificial Sequence
  Synthetic
aatgggacgagctgctag

SEQ ID NO: 32239 - DNA, 19 bp, Artificial Sequence
  Synthetic
gttaccggattgcatcact

SEQ ID NO: 32240 - DNA, 18 bp, Artificial Sequence
  Synthetic
agctaaagtgatggcctc

SEQ ID NO: 32241 - DNA, 21 bp, Artificial Sequence
  Synthetic
gctctactaatgagaaagcca

SEQ ID NO: 32242 - DNA, 18 bp, Artificial Sequence
  Synthetic
atacttgcggtctggcta

SEQ ID NO: 32243 - DNA, 19 bp, Artificial Sequence
  Synthetic
gagttgaactgaggcaaga

SEQ ID NO: 32244 - DNA, 18 bp, Artificial Sequence
  Synthetic
gtagggaagacaagcctc

SEQ ID NO: 32245 - DNA, 23 bp, Artificial Sequence
  Synthetic
gggaactttatgaatcaggaaat

SEQ ID NO: 32246 - DNA, 23 bp, Artificial Sequence
  Synthetic
ggtttcctgtagaaaattttccg

SEQ ID NO: 32247 - DNA, 21 bp, Artificial Sequence
  Synthetic
aaggaatccatagataggtcc

SEQ ID NO: 32248 - DNA, 18 bp, Artificial Sequence
  Synthetic
gaacagccagtgacaaag

SEQ ID NO: 32249 - DNA, 18 bp, Artificial Sequence
  Synthetic
accgccatttatgaagcc

SEQ ID NO: 32250 - DNA, 18 bp, Artificial Sequence
  Synthetic
cctaacgtgacagagtcg

SEQ ID NO: 32251 - DNA, 18 bp, Artificial Sequence
  Synthetic
tggccctttgtaatgtgc

SEQ ID NO: 32252 - DNA, 19 bp, Artificial Sequence
  Synthetic
tcgaggagatgtacttgga

SEQ ID NO: 32253 - DNA, 18 bp, Artificial Sequence
  Synthetic
gtcgctcaggatgtcatt

SEQ ID NO: 32254 - DNA, 19 bp, Artificial Sequence
  Synthetic
gccctatggtagtagatgc

SEQ ID NO: 32255 - DNA, 20 bp, Artificial Sequence
  Synthetic
aagagtgatcagcaaattcg

SEQ ID NO: 32256 - DNA, 20 bp, Artificial Sequence
  Synthetic
tgctgtttacgttttgcaaa

SEQ ID NO: 32257 - DNA, 25 bp, Artificial Sequence
  Synthetic
gtcttagagatactaaagaaacgat

SEQ ID NO: 32258 - DNA, 20 bp, Artificial Sequence
  Synthetic
ttcaataactcgtgttggac

SEQ ID NO: 32259 - DNA, 22 bp, Artificial Sequence
  Synthetic
aattctctgaagataaagaggc

SEQ ID NO: 32260 - DNA, 20 bp, Artificial Sequence
  Synthetic
atttcaagaatgtcggcaat

SEQ ID NO: 32261 - DNA, 20 bp, Artificial Sequence
  Synthetic
tatcaccagaaatcggagaa

SEQ ID NO: 32262 - DNA, 19 bp, Artificial Sequence
  Synthetic
aaggttgttttgccagatc

SEQ ID NO: 32263 - DNA, 21 bp, Artificial Sequence
  Synthetic
tttctttgaagggctttttgg

SEQ ID NO: 32264 - DNA, 18 bp, Artificial Sequence
  Synthetic
ggctgttgtccatatgcg

SEQ ID NO: 32265 - DNA, 22 bp, Artificial Sequence
  Synthetic
attttcttttgtacctgcagta

SEQ ID NO: 32266 - DNA, 21 bp, Artificial Sequence
  Synthetic
cctcagactataacaaaggct

SEQ ID NO: 32267 - DNA, 20 bp, Artificial Sequence
  Synthetic
tgaaaaaaagcataggcctt

SEQ ID NO: 32268 - DNA, 20 bp, Artificial Sequence
  Synthetic
gttgtattaggggttgcatt

SEQ ID NO: 32269 - DNA, 20 bp, Artificial Sequence
  Synthetic
aaacgatctgaaagaaggtg

SEQ ID NO: 32270 - DNA, 19 bp, Artificial Sequence
  Synthetic
ggtttgggagagatgagat

SEQ ID NO: 32271 - DNA, 19 bp, Artificial Sequence
  Synthetic
cctttattacagcgtgtgc

SEQ ID NO: 32272 - DNA, 21 bp, Artificial Sequence
  Synthetic
tctgcaggtagaaatcatgaa

SEQ ID NO: 32273 - DNA, 19 bp, Artificial Sequence
  Synthetic
ttgcgagagaagttctgtt

SEQ ID NO: 32274 - DNA, 22 bp, Artificial Sequence
  Synthetic
gggaactacaaaaaagatagcc

SEQ ID NO: 32275 - DNA, 20 bp, Artificial Sequence
  Synthetic
ggtagtcagaaaggaatccc

SEQ ID NO: 32276 - DNA, 21 bp, Artificial Sequence
  Synthetic
ttagaggtacgctttgcttta

SEQ ID NO: 32277 - DNA, 18 bp, Artificial Sequence
  Synthetic
atatcgttgttggcggga

SEQ ID NO: 32278 - DNA, 21 bp, Artificial Sequence
  Synthetic
tatcccatttcccataggtgt

SEQ ID NO: 32279 - DNA, 19 bp, Artificial Sequence
  Synthetic
cttggccagagaagttctc

SEQ ID NO: 32280 - DNA, 19 bp, Artificial Sequence
  Synthetic
tgtgggccttaaaagcaat

SEQ ID NO: 32281 - DNA, 20 bp, Artificial Sequence
  Synthetic
cggataaggcaatgaaacga

SEQ ID NO: 32282 - DNA, 19 bp, Artificial Sequence
  Synthetic
atacgttaagcagtctggt

SEQ ID NO: 32283 - DNA, 21 bp, Artificial Sequence
  Synthetic
aaaagcaagaaaaaaccacag

SEQ ID NO: 32284 - DNA, 22 bp, Artificial Sequence
  Synthetic
aacaaaacgtctaagtcaagaa

SEQ ID NO: 32285 - DNA, 18 bp, Artificial Sequence
  Synthetic
ttcggtgatccatgagac

SEQ ID NO: 32286 - DNA, 19 bp, Artificial Sequence
  Synthetic
ttcagctccaaatggtctt

SEQ ID NO: 32287 - DNA, 18 bp, Artificial Sequence
  Synthetic
cggatcagcgaacgattt

SEQ ID NO: 32288 - DNA, 19 bp, Artificial Sequence
  Synthetic
atacgctggtgaaagatgt

SEQ ID NO: 32289 - DNA, 22 bp, Artificial Sequence
  Synthetic
cggaatttctgtgatttcatct

SEQ ID NO: 32290 - DNA, 20 bp, Artificial Sequence
  Synthetic
tcaaaagtcctgaacgtact

SEQ ID NO: 32291 - DNA, 19 bp, Artificial Sequence
  Synthetic
gtttcttgcccaccttagt

SEQ ID NO: 32292 - DNA, 21 bp, Artificial Sequence
  Synthetic
gttcatgacaggatttcttca

SEQ ID NO: 32293 - DNA, 18 bp, Artificial Sequence
  Synthetic
aagggagatgtaggtcgg

SEQ ID NO: 32294 - DNA, 18 bp, Artificial Sequence
  Synthetic
taagggagcaacgtttgt

SEQ ID NO: 32295 - DNA, 18 bp, Artificial Sequence
  Synthetic
tgtaatggatgcaggtgc

SEQ ID NO: 32296 - DNA, 19 bp, Artificial Sequence
  Synthetic
gcaggattgatgagaaacc

SEQ ID NO: 32297 - DNA, 20 bp, Artificial Sequence
  Synthetic
agggattatgagtagatcgc

SEQ ID NO: 32298 - DNA, 18 bp, Artificial Sequence
  Synthetic
agaggacgatcggaagtt

SEQ ID NO: 32299 - DNA, 18 bp, Artificial Sequence
  Synthetic
actttcgttgcggtagac

SEQ ID NO: 32300 - DNA, 19 bp, Artificial Sequence
  Synthetic
gagcaagtaatcgcacatc

SEQ ID NO: 32301 - DNA, 19 bp, Artificial Sequence
  Synthetic
aagagggagagagatggat

SEQ ID NO: 32302 - DNA, 18 bp, Artificial Sequence
  Synthetic
aacagaaagccgatgagt

SEQ ID NO: 32303 - DNA, 19 bp, Artificial Sequence
  Synthetic
gtcggagggttatttgttg

SEQ ID NO: 32304 - DNA, 24 bp, Artificial Sequence
  Synthetic
tctttaagaactttatattccggc

SEQ ID NO: 32305 - DNA, 19 bp, Artificial Sequence
  Synthetic
ccaagaattctccttgcgt

SEQ ID NO: 32306 - DNA, 18 bp, Artificial Sequence
  Synthetic
tttagctgggcgaatctc

SEQ ID NO: 32307 - DNA, 19 bp, Artificial Sequence
  Synthetic
agcttctgcagtttctgta

SEQ ID NO: 32308 - DNA, 23 bp, Artificial Sequence
  Synthetic
tcagaaaataaagaacgatggtt

SEQ ID NO: 32309 - DNA, 21 bp, Artificial Sequence
  Synthetic
ttctaaagagatagaaacgcg

SEQ ID NO: 32310 - DNA, 18 bp, Artificial Sequence
  Synthetic
cggcttcttcgatagtcg

SEQ ID NO: 32311 - DNA, 21 bp, Artificial Sequence
  Synthetic
cgatgtttttgtgtacgatgt

SEQ ID NO: 32312 - DNA, 20 bp, Artificial Sequence
  Synthetic
caagacctaccagaaagact

SEQ ID NO: 32313 - DNA, 22 bp, Artificial Sequence
  Synthetic
atacgagagactattgaaaagc

SEQ ID NO: 32314 - DNA, 19 bp, Artificial Sequence
  Synthetic
cccaaagcagataggaagc

SEQ ID NO: 32315 - DNA, 21 bp, Artificial Sequence
  Synthetic
atttgcatttccagttggtag

SEQ ID NO: 32316 - DNA, 18 bp, Artificial Sequence
  Synthetic
tactgaaccctgccatga

SEQ ID NO: 32317 - DNA, 18 bp, Artificial Sequence
  Synthetic
tctcttgcggttttcgtt

SEQ ID NO: 32318 - DNA, 18 bp, Artificial Sequence
  Synthetic
atgtgatatgtggctcgc

SEQ ID NO: 32319 - DNA, 20 bp, Artificial Sequence
  Synthetic
gttacagtctgtgtttgcac

SEQ ID NO: 32320 - DNA, 18 bp, Artificial Sequence
  Synthetic
gacttcgaaccctccttt

SEQ ID NO: 32321 - DNA, 18 bp, Artificial Sequence
  Synthetic
tctttcgccgtaagaacc

SEQ ID NO: 32322 - DNA, 21 bp, Artificial Sequence
  Synthetic
gatgaagagctttctttctcg

SEQ ID NO: 32323 - DNA, 19 bp, Artificial Sequence
  Synthetic
accgcttcttatcttcgat

SEQ ID NO: 32324 - DNA, 18 bp, Artificial Sequence
  Synthetic
aatcaccatggctccttc

SEQ ID NO: 32325 - DNA, 18 bp, Artificial Sequence
  Synthetic
ggaaagcacttcgttagc

SEQ ID NO: 32326 - DNA, 20 bp, Artificial Sequence
  Synthetic
ttcctttctccttgggaaat

SEQ ID NO: 32327 - DNA, 20 bp, Artificial Sequence
  Synthetic
atacactaccaggtcctagt

SEQ ID NO: 32328 - DNA, 19 bp, Artificial Sequence
  Synthetic
caaaaaagagcaccgagaa

SEQ ID NO: 32329 - DNA, 20 bp, Artificial Sequence
  Synthetic
gtctgattgtcaatgtgctt

SEQ ID NO: 32330 - DNA, 21 bp, Artificial Sequence
  Synthetic
ccttagggatatacacgaacg

SEQ ID NO: 32331 - DNA, 21 bp, Artificial Sequence
  Synthetic
tctagctcttccataagatgc

SEQ ID NO: 32332 - DNA, 21 bp, Artificial Sequence
  Synthetic
ttttgccgtatagaacaccaa

SEQ ID NO: 32333 - DNA, 21 bp, Artificial Sequence
  Synthetic
cgagagaaacagttacggaat

SEQ ID NO: 32334 - DNA, 18 bp, Artificial Sequence
  Synthetic
gacatgttgaggccagtt

SEQ ID NO: 32335 - DNA, 18 bp, Artificial Sequence
  Synthetic
aattgcatgacccagtcc

SEQ ID NO: 32336 - DNA, 20 bp, Artificial Sequence
  Synthetic
agttctccatccaaatagct

SEQ ID NO: 32337 - DNA, 19 bp, Artificial Sequence
  Synthetic
cacagcaataatggtctgc

SEQ ID NO: 32338 - DNA, 20 bp, Artificial Sequence
  Synthetic
ttgaacgacgtgtaatcttg

SEQ ID NO: 32339 - DNA, 20 bp, Artificial Sequence
  Synthetic
ggactgaaacaatactaccg

SEQ ID NO: 32340 - DNA, 19 bp, Artificial Sequence
  Synthetic
ccggcaaaaatgatctcat

SEQ ID NO: 32341 - DNA, 22 bp, Artificial Sequence
  Synthetic
tctgtagttatggataagacgg

SEQ ID NO: 32342 - DNA, 20 bp, Artificial Sequence
  Synthetic
acctatcacacaaccattct

SEQ ID NO: 32343 - DNA, 22 bp, Artificial Sequence
  Synthetic
gattaggatttgatggctcttc

SEQ ID NO: 32344 - DNA, 19 bp, Artificial Sequence
  Synthetic
tcgaatgtaatacggcaga

SEQ ID NO: 32345 - DNA, 18 bp, Artificial Sequence
  Synthetic
ccttctcttgttcccacc

SEQ ID NO: 32346 - DNA, 18 bp, Artificial Sequence
  Synthetic
acgccagatcagcttaaa

SEQ ID NO: 32347 - DNA, 20 bp, Artificial Sequence
  Synthetic
atcctacaactctctcctcc

SEQ ID NO: 32348 - DNA, 18 bp, Artificial Sequence
  Synthetic
gtcttatcgacacacccg

SEQ ID NO: 32349 - DNA, 22 bp, Artificial Sequence
  Synthetic
aaagagcatatactaacaggcg

SEQ ID NO: 32350 - DNA, 19 bp, Artificial Sequence
  Synthetic
ggaacagcatctaaagcag

SEQ ID NO: 32351 - DNA, 19 bp, Artificial Sequence
  Synthetic
tcataaacagcactgccaa

SEQ ID NO: 32352 - DNA, 20 bp, Artificial Sequence
  Synthetic
actctacaatagctctgctc

SEQ ID NO: 32353 - DNA, 22 bp, Artificial Sequence
  Synthetic
cccaatagctaaggtaacaatc

SEQ ID NO: 32354 - DNA, 23 bp, Artificial Sequence
  Synthetic
gatcgttttgtagaggaaactac

SEQ ID NO: 32355 - DNA, 20 bp, Artificial Sequence
  Synthetic
ggcacatacgaagaaatcct

SEQ ID NO: 32356 - DNA, 19 bp, Artificial Sequence
  Synthetic
ctatccgcaactcatggaa

SEQ ID NO: 32357 - DNA, 21 bp, Artificial Sequence
  Synthetic
gcgaagagaaagtatcgtaga

SEQ ID NO: 32358 - DNA, 19 bp, Artificial Sequence
  Synthetic
gagatgtccaagaagcact

SEQ ID NO: 32359 - DNA, 22 bp, Artificial Sequence
  Synthetic
ccaagtagtgatacaaagaggg

SEQ ID NO: 32360 - DNA, 20 bp, Artificial Sequence
  Synthetic
aataggaagagacaaccctg

SEQ ID NO: 32361 - DNA, 18 bp, Artificial Sequence
  Synthetic
atcgctaatcctgcacca

SEQ ID NO: 32362 - DNA, 22 bp, Artificial Sequence
  Synthetic
gggtaagtctaaaaattggctc

SEQ ID NO: 32363 - DNA, 23 bp, Artificial Sequence
  Synthetic
tctacttcttttccattgtaagc

SEQ ID NO: 32364 - DNA, 18 bp, Artificial Sequence
  Synthetic
gatccacgacttcctgga

SEQ ID NO: 32365 - DNA, 22 bp, Artificial Sequence
  Synthetic
cacaacttctttaactacctga

SEQ ID NO: 32366 - DNA, 20 bp, Artificial Sequence
  Synthetic
gttcagcattcagacgatag

SEQ ID NO: 32367 - DNA, 18 bp, Artificial Sequence
  Synthetic
agaatgctgcttatgcct

SEQ ID NO: 32368 - DNA, 18 bp, Artificial Sequence
  Synthetic
tacgcccccctaaactag

SEQ ID NO: 32369 - DNA, 18 bp, Artificial Sequence
  Synthetic
ctcccaggaaaagaaggg

SEQ ID NO: 32370 - DNA, 18 bp, Artificial Sequence
  Synthetic
agctaaacaagggcgtag

SEQ ID NO: 32371 - DNA, 21 bp, Artificial Sequence
  Synthetic
aaaacatttaaccaactccct

SEQ ID NO: 32372 - DNA, 19 bp, Artificial Sequence
  Synthetic
actcactacccaagtcagt

SEQ ID NO: 32373 - DNA, 18 bp, Artificial Sequence
  Synthetic
ttggcaatggctcaccta

SEQ ID NO: 32374 - DNA, 19 bp, Artificial Sequence
  Synthetic
ccatctgtaaagcttcgct

SEQ ID NO: 32375 - DNA, 21 bp, Artificial Sequence
  Synthetic
accagttcctttatctccatc

SEQ ID NO: 32376 - DNA, 18 bp, Artificial Sequence
  Synthetic
caagagactcggggagtg

SEQ ID NO: 32377 - DNA, 18 bp, Artificial Sequence
  Synthetic
ggttagcgcattaacagc

SEQ ID NO: 32378 - DNA, 20 bp, Artificial Sequence
  Synthetic
tggagagtagaatagcgaac

SEQ ID NO: 32379 - DNA, 20 bp, Artificial Sequence
  Synthetic
gattttgggattctctagcg

SEQ ID NO: 32380 - DNA, 22 bp, Artificial Sequence
  Synthetic
tcttggtgttattttacccatt

SEQ ID NO: 32381 - DNA, 21 bp, Artificial Sequence
  Synthetic
ccatcattagcgatattccct

SEQ ID NO: 32382 - DNA, 18 bp, Artificial Sequence
  Synthetic
cgcggtcatgatagaaga

SEQ ID NO: 32383 - DNA, 19 bp, Artificial Sequence
  Synthetic
cacaatcggtaatcccact

SEQ ID NO: 32384 - DNA, 22 bp, Artificial Sequence
  Synthetic
cggtaaaaatcacagatccatt

SEQ ID NO: 32385 - DNA, 18 bp, Artificial Sequence
  Synthetic
gcctgtgatatcgcttct

SEQ ID NO: 32386 - DNA, 21 bp, Artificial Sequence
  Synthetic
tagggatctctctctaagact

SEQ ID NO: 32387 - DNA, 24 bp, Artificial Sequence
  Synthetic
attctctctattgttaagctgttc

SEQ ID NO: 32388 - DNA, 18 bp, Artificial Sequence
  Synthetic
gtgcgaacaagagctctt

SEQ ID NO: 32389 - DNA, 18 bp, Artificial Sequence
  Synthetic
ctttgtgcagctgtttga

SEQ ID NO: 32390 - DNA, 18 bp, Artificial Sequence
  Synthetic
gcacagaaaatgcaggtt

SEQ ID NO: 32391 - DNA, 23 bp, Artificial Sequence
  Synthetic
taatggttccattggaatgtttg

SEQ ID NO: 32392 - DNA, 21 bp, Artificial Sequence
  Synthetic
acagtaaagcaagaaccattt

SEQ ID NO: 32393 - DNA, 23 bp, Artificial Sequence
  Synthetic
actgcatatgtatcctatctgat

SEQ ID NO: 32394 - DNA, 21 bp, Artificial Sequence
  Synthetic
cctgaccactcatttattcct

SEQ ID NO: 32395 - DNA, 21 bp, Artificial Sequence
  Synthetic
gctctatgctgacaaaatgac

SEQ ID NO: 32396 - DNA, 20 bp, Artificial Sequence
  Synthetic
agccaatccatgtactttga

SEQ ID NO: 32397 - DNA, 23 bp, Artificial Sequence
  Synthetic
cagttcataaatgtttttctgga

SEQ ID NO: 32398 - DNA, 18 bp, Artificial Sequence
  Synthetic
gggttggaagtgtgaaga

SEQ ID NO: 32399 - DNA, 23 bp, Artificial Sequence
  Synthetic
gcttcttactgaatatcttccag

SEQ ID NO: 32400 - DNA, 21 bp, Artificial Sequence
  Synthetic
aatttgggaggaaggaggtat

SEQ ID NO: 32401 - DNA, 21 bp, Artificial Sequence
  Synthetic
ttctacttccaagcagatagc

SEQ ID NO: 32402 - DNA, 23 bp, Artificial Sequence
  Synthetic
gctctatttgttatttctgaagc

SEQ ID NO: 32403 - DNA, 18 bp, Artificial Sequence
  Synthetic
ccagagatcaccaaagct

SEQ ID NO: 32404 - DNA, 19 bp, Artificial Sequence
  Synthetic
aatctgttcacaagtggca

SEQ ID NO: 32405 - DNA, 19 bp, Artificial Sequence
  Synthetic
gcatctgcactcccattcg

SEQ ID NO: 32406 - DNA, 23 bp, Artificial Sequence
  Synthetic
cctcacaaaaattacaatgcaat

SEQ ID NO: 32407 - DNA, 21 bp, Artificial Sequence
  Synthetic
cacacgaggaaactatcttgt

SEQ ID NO: 32408 - DNA, 18 bp, Artificial Sequence
  Synthetic
ctcctctctctcctgcag

SEQ ID NO: 32409 - DNA, 18 bp, Artificial Sequence
  Synthetic
ttttgaccccggtacctc

SEQ ID NO: 32410 - DNA, 23 bp, Artificial Sequence
  Synthetic
ctacttaaatcaaattgctgtgt

SEQ ID NO: 32411 - DNA, 18 bp, Artificial Sequence
  Synthetic
aacacctgctcctgtctt

SEQ ID NO: 32412 - DNA, 19 bp, Artificial Sequence
  Synthetic
ggtccctttcttcttcgga

SEQ ID NO: 32413 - DNA, 18 bp, Artificial Sequence
  Synthetic
tgactgtgaggagggtcc

SEQ ID NO: 32414 - DNA, 19 bp, Artificial Sequence
  Synthetic
cttcccacttgctcaggtg

SEQ ID NO: 32415 - DNA, 22 bp, Artificial Sequence
  Synthetic
cgccctttggtaatttcataat

SEQ ID NO: 32416 - DNA, 22 bp, Artificial Sequence
  Synthetic
gttgactctgttaaaggtatga

SEQ ID NO: 32417 - DNA, 22 bp, Artificial Sequence
  Synthetic
ggttgagtatcaatactgctaa

SEQ ID NO: 32418 - DNA, 22 bp, Artificial Sequence
  Synthetic
cctttgaacaaattcatccgta

SEQ ID NO: 32419 - DNA, 19 bp, Artificial Sequence
  Synthetic
gcctttccttgtctggatt

SEQ ID NO: 32420 - DNA, 22 bp, Artificial Sequence
  Synthetic
tccatcagagataacagtgttt

SEQ ID NO: 32421 - DNA, 22 bp, Artificial Sequence
  Synthetic
gtcttcatttacaactgcatct

SEQ ID NO: 32422 - DNA, 24 bp, Artificial Sequence
  Synthetic
gtattcctggtattatcacaaact

SEQ ID NO: 32423 - DNA, 20 bp, Artificial Sequence
  Synthetic
ccgtatttgttgatcttcga

SEQ ID NO: 32424 - DNA, 19 bp, Artificial Sequence
  Synthetic
acatacctaagggggttgt

SEQ ID NO: 32425 - DNA, 18 bp, Artificial Sequence
  Synthetic
aaacatgtccaaaaccgc

SEQ ID NO: 32426 - DNA, 23 bp, Artificial Sequence
  Synthetic
cacaggttcttttataacaacag

SEQ ID NO: 32427 - DNA, 18 bp, Artificial Sequence
  Synthetic
aggcaaaacacctgaaga

SEQ ID NO: 32428 - DNA, 23 bp, Artificial Sequence
  Synthetic
cgccgcatattaaaataatcaat

SEQ ID NO: 32429 - DNA, 23 bp, Artificial Sequence
  Synthetic
tcataaacatctaatggcaattg

SEQ ID NO: 32430 - DNA, 18 bp, Artificial Sequence
  Synthetic
atgtaacacgccttccag

SEQ ID NO: 32431 - DNA, 21 bp, Artificial Sequence
  Synthetic
catcatccaaagtgtcctcta

SEQ ID NO: 32432 - DNA, 23 bp, Artificial Sequence
  Synthetic
tcacatttaatgcatttccagta

SEQ ID NO: 32433 - DNA, 23 bp, Artificial Sequence
  Synthetic
acagtcatagttgttaagatgtt

SEQ ID NO: 32434 - DNA, 19 bp, Artificial Sequence
  Synthetic
gttcgtgcatcatcatcaa

SEQ ID NO: 32435 - DNA, 22 bp, Artificial Sequence
  Synthetic
acagcctttaaatcttcactag

SEQ ID NO: 32436 - DNA, 18 bp, Artificial Sequence
  Synthetic
cacctttggccaaaacca

SEQ ID NO: 32437 - DNA, 21 bp, Artificial Sequence
  Synthetic
tggtacatcaaatcgtacaca

SEQ ID NO: 32438 - DNA, 25 bp, Artificial Sequence
  Synthetic
ccactcagtaatcttatattcaaca

SEQ ID NO: 32439 - DNA, 23 bp, Artificial Sequence
  Synthetic
atgacactatcttcaaccttaaa

SEQ ID NO: 32440 - DNA, 21 bp, Artificial Sequence
  Synthetic
caacatgcctaaacaagctaa

SEQ ID NO: 32441 - DNA, 20 bp, Artificial Sequence
  Synthetic
cgcatagaacaaccaacttg

SEQ ID NO: 32442 - DNA, 19 bp, Artificial Sequence
  Synthetic
gcaccccctttaagactaa

SEQ ID NO: 32443 - DNA, 18 bp, Artificial Sequence
  Synthetic
cagaggaaagcacacagc

SEQ ID NO: 32444 - DNA, 18 bp, Artificial Sequence
  Synthetic
aagcacccaagaaccatt

SEQ ID NO: 32445 - DNA, 21 bp, Artificial Sequence
  Synthetic
cttgaaacacaaaaagcatca

SEQ ID NO: 32446 - DNA, 21 bp, Artificial Sequence
  Synthetic
caacacatggttctaccttag

SEQ ID NO: 32447 - DNA, 21 bp, Artificial Sequence
  Synthetic
gtaccagtatgacaaccagta

SEQ ID NO: 32448 - DNA, 21 bp, Artificial Sequence
  Synthetic
cataatctgacgtccttggaa

SEQ ID NO: 32449 - DNA, 22 bp, Artificial Sequence
  Synthetic
tgccataaataacttcatcagt

SEQ ID NO: 32450 - DNA, 19 bp, Artificial Sequence
  Synthetic
aagccccaataacagctaa

SEQ ID NO: 32451 - DNA, 20 bp, Artificial Sequence
  Synthetic
agtgctacaataatgccaca

SEQ ID NO: 32452 - DNA, 24 bp, Artificial Sequence
  Synthetic
cgttcataagcagatttagcaata

SEQ ID NO: 32453 - DNA, 20 bp, Artificial Sequence
  Synthetic
actagtggccagttacaatc

SEQ ID NO: 32454 - DNA, 18 bp, Artificial Sequence
  Synthetic
ggtgttcctccttgttgt

SEQ ID NO: 32455 - DNA, 19 bp, Artificial Sequence
  Synthetic
tccacaaactcgacaaaca

SEQ ID NO: 32456 - DNA, 20 bp, Artificial Sequence
  Synthetic
gtgttcagccacaaacttac

SEQ ID NO: 32457 - DNA, 19 bp, Artificial Sequence
  Synthetic
ccaatgcatgacacatggt

SEQ ID NO: 32458 - DNA, 21 bp, Artificial Sequence
  Synthetic
tgaaattttacaccgcttgtt

SEQ ID NO: 32459 - DNA, 18 bp, Artificial Sequence
  Synthetic
gttggcaggacattacgc

SEQ ID NO: 32460 - DNA, 18 bp, Artificial Sequence
  Synthetic
agcacgatcacacttagg

SEQ ID NO: 32461 - DNA, 24 bp, Artificial Sequence
  Synthetic
cgcataatcagaattataacacac

SEQ ID NO: 32462 - DNA, 25 bp, Artificial Sequence
  Synthetic
cgttctattaaaagaacactatcag

SEQ ID NO: 32463 - DNA, 18 bp, Artificial Sequence
  Synthetic
cttgcagcaaagaagagg

SEQ ID NO: 32464 - DNA, 20 bp, Artificial Sequence
  Synthetic
cgctcactaacaatctcttg

SEQ ID NO: 32465 - DNA, 23 bp, Artificial Sequence
  Synthetic
caatagaatacagcaagaccaat

SEQ ID NO: 32466 - DNA, 25 bp, Artificial Sequence
  Synthetic
gagcattaataacagaaagctcata

SEQ ID NO: 32467 - DNA, 23 bp, Artificial Sequence
  Synthetic
tgaagcgattaacatttacagaa

SEQ ID NO: 32468 - DNA, 18 bp, Artificial Sequence
  Synthetic
ataccaagacacacggct

SEQ ID NO: 32469 - DNA, 19 bp, Artificial Sequence
  Synthetic
atcaaagggatgaggtgct

SEQ ID NO: 32470 - DNA, 22 bp, Artificial Sequence
  Synthetic
ccaatatatccccactgttgaa

SEQ ID NO: 32471 - DNA, 18 bp, Artificial Sequence
  Synthetic
caactgcattcggtggat

SEQ ID NO: 32472 - DNA, 22 bp, Artificial Sequence
  Synthetic
gcatgttttaaacaaactgcac

SEQ ID NO: 32473 - DNA, 18 bp, Artificial Sequence
  Synthetic
gcttccaacacacgtcta

SEQ ID NO: 32474 - DNA, 23 bp, Artificial Sequence
  Synthetic
gcaaaataaaacacacaatcagt

SEQ ID NO: 32475 - DNA, 19 bp, Artificial Sequence
  Synthetic
gagtgtatgctggagtcat

SEQ ID NO: 32476 - DNA, 24 bp, Artificial Sequence
  Synthetic
cataactgagtatacttagcaaca

SEQ ID NO: 32477 - DNA, 18 bp, Artificial Sequence
  Synthetic
accttgggcttacacaaa

SEQ ID NO: 32478 - DNA, 20 bp, Artificial Sequence
  Synthetic
ttcctaggatgtgaggattc

SEQ ID NO: 32479 - DNA, 22 bp, Artificial Sequence
  Synthetic
tgtattcaaaacgaattcccat

SEQ ID NO: 32480 - DNA, 23 bp, Artificial Sequence
  Synthetic
gccatattcttataaacctgagt

SEQ ID NO: 32481 - DNA, 18 bp, Artificial Sequence
  Synthetic
tacggaggttgacaagca

SEQ ID NO: 32482 - DNA, 19 bp, Artificial Sequence
  Synthetic
tctttgcgatgattaccca

SEQ ID NO: 32483 - DNA, 25 bp, Artificial Sequence
  Synthetic
gtgttttacacttaatctcactcat

SEQ ID NO: 32484 - DNA, 21 bp, Artificial Sequence
  Synthetic
agttatgctggaaaaacacat

SEQ ID NO: 32485 - DNA, 21 bp, Artificial Sequence
  Synthetic
acgaaccattcaatttacacg

SEQ ID NO: 32486 - DNA, 25 bp, Artificial Sequence
  Synthetic
caaaaatattacacttgtctccttg

SEQ ID NO: 32487 - DNA, 23 bp, Artificial Sequence
  Synthetic
caacacaaccaagataactatca

SEQ ID NO: 32488 - DNA, 23 bp, Artificial Sequence
  Synthetic
gtagttcatttacttctgtgagt

SEQ ID NO: 32489 - DNA, 20 bp, Artificial Sequence
  Synthetic
ggaaatagactagcagaggt

SEQ ID NO: 32490 - DNA, 20 bp, Artificial Sequence
  Synthetic
ttggcttttgacacattcat

SEQ ID NO: 32491 - DNA, 18 bp, Artificial Sequence
  Synthetic
tcagcattacatacggcg

SEQ ID NO: 32492 - DNA, 21 bp, Artificial Sequence
  Synthetic
acatcctgtacaacagcatat

SEQ ID NO: 32493 - DNA, 23 bp, Artificial Sequence
  Synthetic
tgtgaaaccatttattactccaa

SEQ ID NO: 32494 - DNA, 20 bp, Artificial Sequence
  Synthetic
aaatctgccaaagaatagcc

SEQ ID NO: 32495 - DNA, 19 bp, Artificial Sequence
  Synthetic
ctacccctggtttgaacat

SEQ ID NO: 32496 - DNA, 18 bp, Artificial Sequence
  Synthetic
gccaggcggaaacctagt

SEQ ID NO: 32497 - DNA, 25 bp, Artificial Sequence
  Synthetic
gcttattcaaaattttctgtctgac

SEQ ID NO: 32498 - DNA, 22 bp, Artificial Sequence
  Synthetic
attcatcataccatcttgttgt

SEQ ID NO: 32499 - DNA, 23 bp, Artificial Sequence
  Synthetic
cattacaacacaaaactttcaac

SEQ ID NO: 32500 - DNA, 21 bp, Artificial Sequence
  Synthetic
cggtcaaaaatcacactgaaa

SEQ ID NO: 32501 - DNA, 18 bp, Artificial Sequence
  Synthetic
gttctcgccattttccgt

SEQ ID NO: 32502 - DNA, 20 bp, Artificial Sequence
  Synthetic
tccagaatccgctccactat

SEQ ID NO: 32503 - DNA, 23 bp, Artificial Sequence
  Synthetic
tcaagtcgattaaaaatcacact

SEQ ID NO: 32504 - DNA, 20 bp, Artificial Sequence
  Synthetic
tttctgttttggagggagtg

SEQ ID NO: 32505 - DNA, 18 bp, Artificial Sequence
  Synthetic
gctccaagaaaggacccg

SEQ ID NO: 32506 - DNA, 18 bp, Artificial Sequence
  Synthetic
ataggctgtcgtcgtccg

SEQ ID NO: 32507 - DNA, 20 bp, Artificial Sequence
  Synthetic
gcaagttccctgttgcgaaa

SEQ ID NO: 32508 - DNA, 19 bp, Artificial Sequence
  Synthetic
tatcacccacgtagagcgc

SEQ ID NO: 32509 - DNA, 20 bp, Artificial Sequence
  Synthetic
catggagtaataggccaggc

SEQ ID NO: 32510 - DNA, 20 bp, Artificial Sequence
  Synthetic
tggtgtgaagcagtacacag

SEQ ID NO: 32511 - DNA, 19 bp, Artificial Sequence
  Synthetic
cctcgcccccatagatgtt

SEQ ID NO: 32512 - DNA, 18 bp, Artificial Sequence
  Synthetic
gacctgttgacagcgcag

SEQ ID NO: 32513 - DNA, 18 bp, Artificial Sequence
  Synthetic
aggctgtaggtcaccagc

SEQ ID NO: 32514 - DNA, 18 bp, Artificial Sequence
  Synthetic
ccaacaacacctcacggc

SEQ ID NO: 32515 - DNA, 18 bp, Artificial Sequence
  Synthetic
aagagacttggcccctgg

SEQ ID NO: 32516 - DNA, 18 bp, Artificial Sequence
  Synthetic
atggagacctagcctgcg

SEQ ID NO: 32517 - DNA, 18 bp, Artificial Sequence
  Synthetic
acatcatatgcccccccg

SEQ ID NO: 32518 - DNA, 18 bp, Artificial Sequence
  Synthetic
tcgtaccatgagcagccc

SEQ ID NO: 32519 - DNA, 20 bp, Artificial Sequence
  Synthetic
gccgatatagaaggggcgta

SEQ ID NO: 32520 - DNA, 20 bp, Artificial Sequence
  Synthetic
gctgcagcaatccaaggatt

SEQ ID NO: 32521 - DNA, 19 bp, Artificial Sequence
  Synthetic
gaccctgcccaggcctata

SEQ ID NO: 32522 - DNA, 19 bp, Artificial Sequence
  Synthetic
catagtgcgtcggtgagac

SEQ ID NO: 32523 - DNA, 18 bp, Artificial Sequence
  Synthetic
acccgttcttcacatggc

SEQ ID NO: 32524 - DNA, 20 bp, Artificial Sequence
  Synthetic
ggaatgcaaccctaccatga

SEQ ID NO: 32525 - DNA, 18 bp, Artificial Sequence
  Synthetic
tgtctcagactccacccg

SEQ ID NO: 32526 - DNA, 18 bp, Artificial Sequence
  Synthetic
tggactgtgtgtcgaccc

SEQ ID NO: 32527 - DNA, 20 bp, Artificial Sequence
  Synthetic
accttcttctgacgctgaga

SEQ ID NO: 32528 - DNA, 18 bp, Artificial Sequence
  Synthetic
cccccaggtcagggtaca

SEQ ID NO: 32529 - DNA, 18 bp, Artificial Sequence
  Synthetic
agaactccactggcacgg

SEQ ID NO: 32530 - DNA, 20 bp, Artificial Sequence
  Synthetic
gttggaggagcaagatgtga

SEQ ID NO: 32531 - DNA, 21 bp, Artificial Sequence
  Synthetic
tcttgtctgctgtaattggat

SEQ ID NO: 32532 - DNA, 20 bp, Artificial Sequence
  Synthetic
ggatttatgtcaactctccg

SEQ ID NO: 32533 - DNA, 18 bp, Artificial Sequence
  Synthetic
gttttgcggaccagttct

SEQ ID NO: 32534 - DNA, 18 bp, Artificial Sequence
  Synthetic
ttgctcttctgttgggtt

SEQ ID NO: 32535 - DNA, 19 bp, Artificial Sequence
  Synthetic
ccactcactatcagctgaa

SEQ ID NO: 32536 - DNA, 18 bp, Artificial Sequence
  Synthetic
atgcttggagtcatgtcg

SEQ ID NO: 32537 - DNA, 24 bp, Artificial Sequence
  Synthetic
gaattttaacagtttcccagtttc

SEQ ID NO: 32538 - DNA, 20 bp, Artificial Sequence
  Synthetic
aaatgaggagaactgcattc

SEQ ID NO: 32539 - DNA, 20 bp, Artificial Sequence
  Synthetic
tccttgcccaattagcacat

SEQ ID NO: 32540 - DNA, 19 bp, Artificial Sequence
  Synthetic
agggtagtgccagcagtag

SEQ ID NO: 32541 - DNA, 18 bp, Artificial Sequence
  Synthetic
gtggcttccggatgcttg

SEQ ID NO: 32542 - DNA, 16 bp, Artificial Sequence
  Synthetic
gccggtggacaaggct

SEQ ID NO: 32543 - DNA, 15 bp, Artificial Sequence
  Synthetic
acgccagcaggagca

SEQ ID NO: 32544 - DNA, 20 bp, Artificial Sequence
  Synthetic
gccatttgcacgtaatgacc

SEQ ID NO: 32545 - DNA, 16 bp, Artificial Sequence
  Synthetic
attccgtcggctggcc

SEQ ID NO: 32546 - DNA, 18 bp, Artificial Sequence
  Synthetic
ggcgcacgggaatgacat

SEQ ID NO: 32547 - DNA, 16 bp, Artificial Sequence
  Synthetic
gctcttaccgctgccg

SEQ ID NO: 32548 - DNA, 18 bp, Artificial Sequence
  Synthetic
gagcacaaccagtctcgc

SEQ ID NO: 32549 - DNA, 19 bp, Artificial Sequence
  Synthetic
gccggtaaagccagtcatg

SEQ ID NO: 32550 - DNA, 19 bp, Artificial Sequence
  Synthetic
ggtgttcatgtacgctcgt

SEQ ID NO: 32551 - DNA, 18 bp, Artificial Sequence
  Synthetic
ctatgaccacgcagcctg

SEQ ID NO: 32552 - DNA, 18 bp, Artificial Sequence
  Synthetic
taccaggcagcgttgaca

SEQ ID NO: 32553 - DNA, 16 bp, Artificial Sequence
  Synthetic
acaagggctccaggcg

SEQ ID NO: 32554 - DNA, 17 bp, Artificial Sequence
  Synthetic
ccggagcatggagtggt

SEQ ID NO: 32555 - DNA, 18 bp, Artificial Sequence
  Synthetic
tgcagacaccctccacag

SEQ ID NO: 32556 - DNA, 17 bp, Artificial Sequence
  Synthetic
tcgccaaccttctcccg

SEQ ID NO: 32557 - DNA, 16 bp, Artificial Sequence
  Synthetic
aggtggtagcgggcag

SEQ ID NO: 32558 - DNA, 18 bp, Artificial Sequence
  Synthetic
cccactactgaccgtcga

SEQ ID NO: 32559 - DNA, 18 bp, Artificial Sequence
  Synthetic
gttgatgtgggctacggc

SEQ ID NO: 32560 - DNA, 19 bp, Artificial Sequence
  Synthetic
ccacgcttgcacgaggaat

SEQ ID NO: 32561 - DNA, 16 bp, Artificial Sequence
  Synthetic
tcgtcgccacacacga

SEQ ID NO: 32562 - DNA, 20 bp, Artificial Sequence
  Synthetic
cctggctatgaggacgctaa

SEQ ID NO: 32563 - DNA, 20 bp, Artificial Sequence
  Synthetic
gccgctattggagtgagttt

SEQ ID NO: 32564 - DNA, 23 bp, Artificial Sequence
  Synthetic
taattctctaagtgcaaatgctg

SEQ ID NO: 32565 - DNA, 18 bp, Artificial Sequence
  Synthetic
actacctctccagtaccc

SEQ ID NO: 32566 - DNA, 18 bp, Artificial Sequence
  Synthetic
cccttatatctgcgtggc

SEQ ID NO: 32567 - DNA, 19 bp, Artificial Sequence
  Synthetic
tggtcccgattccgtatcc

SEQ ID NO: 32568 - DNA, 18 bp, Artificial Sequence
  Synthetic
atctggctttccggtaca

SEQ ID NO: 32569 - DNA, 21 bp, Artificial Sequence
  Synthetic
ctaacagtcctattttggctt

SEQ ID NO: 32570 - DNA, 18 bp, Artificial Sequence
  Synthetic
agcattttgtcctggcac

SEQ ID NO: 32571 - DNA, 20 bp, Artificial Sequence
  Synthetic
catggtgaattactttgcct

SEQ ID NO: 32572 - DNA, 20 bp, Artificial Sequence
  Synthetic
cggggtgtgcacttctagtg

SEQ ID NO: 32573 - DNA, 21 bp, Artificial Sequence
  Synthetic
ctgtacaatacgtgtcacaat

SEQ ID NO: 32574 - DNA, 18 bp, Artificial Sequence
  Synthetic
gaacataccccgtgcgac

SEQ ID NO: 32575 - DNA, 19 bp, Artificial Sequence
  Synthetic
gaacttctacaagggacgg

SEQ ID NO: 32576 - DNA, 21 bp, Artificial Sequence
  Synthetic
tatccctctgtaaaagcaaca

SEQ ID NO: 32577 - DNA, 25 bp, Artificial Sequence
  Synthetic
acatctaccttattgttacttgact

SEQ ID NO: 32578 - DNA, 19 bp, Artificial Sequence
  Synthetic
tcttgcaaacagttgttcc

SEQ ID NO: 32579 - DNA, 20 bp, Artificial Sequence
  Synthetic
gtaatggctgaagaggacaa

SEQ ID NO: 32580 - DNA, 22 bp, Artificial Sequence
  Synthetic
caggatatagatcagcatgact

SEQ ID NO: 32581 - DNA, 18 bp, Artificial Sequence
  Synthetic
aatattccgtgcacaccg

SEQ ID NO: 32582 - DNA, 23 bp, Artificial Sequence
  Synthetic
ttgtatactttcgttttagctgt

SEQ ID NO: 32583 - DNA, 21 bp, Artificial Sequence
  Synthetic
tctgtcaccatttgtttcttg

SEQ ID NO: 32584 - DNA, 19 bp, Artificial Sequence
  Synthetic
ggggtgtctgttgggtaga

SEQ ID NO: 32585 - DNA, 20 bp, Artificial Sequence
  Synthetic
agcctccatctccaacactt

SEQ ID NO: 32586 - DNA, 20 bp, Artificial Sequence
  Synthetic
caaatcctccacctataggg

SEQ ID NO: 32587 - DNA, 21 bp, Artificial Sequence
  Synthetic
acatctggtaaaccttcactt

SEQ ID NO: 32588 - DNA, 20 bp, Artificial Sequence
  Synthetic
tgccaagatacctaacatcc

SEQ ID NO: 32589 - DNA, 21 bp, Artificial Sequence
  Synthetic
cgtttacgtttttgtaaagca

SEQ ID NO: 32590 - DNA, 20 bp, Artificial Sequence
  Synthetic
ttggaacagttagggcatta

SEQ ID NO: 32591 - DNA, 21 bp, Artificial Sequence
  Synthetic
ctgtgtttgtttaggatccat

SEQ ID NO: 32592 - DNA, 23 bp, Artificial Sequence
  Synthetic
agtcaggatatttacaagtttca

SEQ ID NO: 32593 - DNA, 25 bp, Artificial Sequence
  Synthetic
ggtctgttaaataattgattatcgg

SEQ ID NO: 32594 - DNA, 23 bp, Artificial Sequence
  Synthetic
cagccaatatagatgttatcgtc

SEQ ID NO: 32595 - DNA, 20 bp, Artificial Sequence
  Synthetic
gtattccaaggggattcgat

SEQ ID NO: 32596 - DNA, 20 bp, Artificial Sequence
  Synthetic
gcgggtttagtagtactctt

SEQ ID NO: 32597 - DNA, 18 bp, Artificial Sequence
  Synthetic
ctctgctgatgttgctcc

SEQ ID NO: 32598 - DNA, 21 bp, Artificial Sequence
  Synthetic
gctcttattatgtcacaggct

SEQ ID NO: 32599 - DNA, 19 bp, Artificial Sequence
  Synthetic
tcactccttggaacatcct

SEQ ID NO: 32600 - DNA, 22 bp, Artificial Sequence
  Synthetic
ttttgttactacaacccctttc

SEQ ID NO: 32601 - DNA, 20 bp, Artificial Sequence
  Synthetic
gaaactgagccttcaatgtt

SEQ ID NO: 32602 - DNA, 19 bp, Artificial Sequence
  Synthetic
ctcctttcagcataagcct

SEQ ID NO: 32603 - DNA, 25 bp, Artificial Sequence
  Synthetic
ggataaagcactatatcttttcctt

SEQ ID NO: 32604 - DNA, 19 bp, Artificial Sequence
  Synthetic
agaccgtatttgctggttt

SEQ ID NO: 32605 - DNA, 22 bp, Artificial Sequence
  Synthetic
ggctgttttagttagaacttct

SEQ ID NO: 32606 - DNA, 21 bp, Artificial Sequence
  Synthetic
ggtgtgacagaataaccatac

SEQ ID NO: 32607 - DNA, 19 bp, Artificial Sequence
  Synthetic
acggggaattaaaccatct

SEQ ID NO: 32608 - DNA, 20 bp, Artificial Sequence
  Synthetic
atcaaagacggaatctccat

SEQ ID NO: 32609 - DNA, 23 bp, Artificial Sequence
  Synthetic
agcagcagtttctttagaaaatt

SEQ ID NO: 32610 - DNA, 20 bp, Artificial Sequence
  Synthetic
agtagcatctgatggttcat

SEQ ID NO: 32611 - DNA, 19 bp, Artificial Sequence
  Synthetic
tggtaaggtgaaccacatt

SEQ ID NO: 32612 - DNA, 21 bp, Artificial Sequence
  Synthetic
accaaaagtttcacatccttt

SEQ ID NO: 32613 - DNA, 23 bp, Artificial Sequence
  Synthetic
gatgtttaacacaaaaaccagta

SEQ ID NO: 32614 - DNA, 20 bp, Artificial Sequence
  Synthetic
cacctaaatcagcagctaca

SEQ ID NO: 32615 - DNA, 21 bp, Artificial Sequence
  Synthetic
gcgttcttacaatacgtacaa

SEQ ID NO: 32616 - DNA, 25 bp, Artificial Sequence
  Synthetic
acctttaatagtataactactacgc

SEQ ID NO: 32617 - DNA, 21 bp, Artificial Sequence
  Synthetic
gcttttacttggctaaaacca

SEQ ID NO: 32618 - DNA, 24 bp, Artificial Sequence
  Synthetic
ccagaatagaatttaaagcctgat

SEQ ID NO: 32619 - DNA, 24 bp, Artificial Sequence
  Synthetic
aataggatcttttatacccaaagg

SEQ ID NO: 32620 - DNA, 23 bp, Artificial Sequence
  Synthetic
tcacaatctaatacatgacacat

SEQ ID NO: 32621 - DNA, 19 bp, Artificial Sequence
  Synthetic
ccacttgtaatggcagcta

SEQ ID NO: 32622 - DNA, 21 bp, Artificial Sequence
  Synthetic
agctgctatactcttcaaaca

SEQ ID NO: 32623 - DNA, 21 bp, Artificial Sequence
  Synthetic
cgccacacataactatttcac

SEQ ID NO: 32624 - DNA, 25 bp, Artificial Sequence
  Synthetic
gagtaccaagatcattatacagttt

SEQ ID NO: 32625 - DNA, 24 bp, Artificial Sequence
  Synthetic
ctctatcactaacaatctcttgaa

SEQ ID NO: 32626 - DNA, 24 bp, Artificial Sequence
  Synthetic
tgtagtaataaacagctagaccta

SEQ ID NO: 32627 - DNA, 18 bp, Artificial Sequence
  Synthetic
accaggaggagctttagc

SEQ ID NO: 32628 - DNA, 23 bp, Artificial Sequence
  Synthetic
tccaaaacatacataaaccatct

SEQ ID NO: 32629 - DNA, 22 bp, Artificial Sequence
  Synthetic
aagcctgctgtagtaactatat

SEQ ID NO: 32630 - DNA, 20 bp, Artificial Sequence
  Synthetic
agtaatggcttgagcatagg

SEQ ID NO: 32631 - DNA, 22 bp, Artificial Sequence
  Synthetic
tcgctaacaaatgggtttaaat

SEQ ID NO: 32632 - DNA, 21 bp, Artificial Sequence
  Synthetic
agggtcataagcagttatagg

SEQ ID NO: 32633 - DNA, 21 bp, Artificial Sequence
  Synthetic
ccacagactcaatactgtcat

SEQ ID NO: 32634 - DNA, 23 bp, Artificial Sequence
  Synthetic
agattgacttttaacacactcat

SEQ ID NO: 32635 - DNA, 20 bp, Artificial Sequence
  Synthetic
caaagtacttgcaccttagc

SEQ ID NO: 32636 - DNA, 21 bp, Artificial Sequence
  Synthetic
agtatttccttgtggttgagt

SEQ ID NO: 32637 - DNA, 22 bp, Artificial Sequence
  Synthetic
aagaataggaaactgaggatca

SEQ ID NO: 32638 - DNA, 22 bp, Artificial Sequence
  Synthetic
agcaacagagtcttctacataa

SEQ ID NO: 32639 - DNA, 23 bp, Artificial Sequence
  Synthetic
ggatcatcaagttctaccactat

SEQ ID NO: 32640 - DNA, 21 bp, Artificial Sequence
  Synthetic
tctaaaattctcaaggcagga

SEQ ID NO: 32641 - DNA, 19 bp, Artificial Sequence
  Synthetic
ctccttcatgacttgggtc

SEQ ID NO: 32642 - DNA, 18 bp, Artificial Sequence
  Synthetic
cgcttatgtctctgcagt

SEQ ID NO: 32643 - DNA, 18 bp, Artificial Sequence
  Synthetic
aaaatcgtccattgctgc

SEQ ID NO: 32644 - DNA, 21 bp, Artificial Sequence
  Synthetic
cctcacatacaagaacatagg

SEQ ID NO: 32645 - DNA, 22 bp, Artificial Sequence
  Synthetic
aaatccttccaattgtggtgat

SEQ ID NO: 32646 - DNA, 25 bp, Artificial Sequence
  Synthetic
ttctctctattgttatactgttctg

SEQ ID NO: 32647 - DNA, 18 bp, Artificial Sequence
  Synthetic
ctttgtgctgctgtttga

SEQ ID NO: 32648 - DNA, 20 bp, Artificial Sequence
  Synthetic
ccagagagtacccttccctc

SEQ ID NO: 32649 - DNA, 19 bp, Artificial Sequence
  Synthetic
tctcagttcaagagtgctg

SEQ ID NO: 32650 - DNA, 20 bp, Artificial Sequence
  Synthetic
acctttagttggatctccca

SEQ ID NO: 32651 - DNA, 18 bp, Artificial Sequence
  Synthetic
tcctcgtcgtcgtcgaag

SEQ ID NO: 32652 - DNA, 18 bp, Artificial Sequence
  Synthetic
gtcatctccaacccagtg

SEQ ID NO: 32653 - DNA, 23 bp, Artificial Sequence
  Synthetic
ccaaatatttttaacagccagtc

SEQ ID NO: 32654 - DNA, 24 bp, Artificial Sequence
  Synthetic
agtaaatacactaatgtctggacc

SEQ ID NO: 32655 - DNA, 19 bp, Artificial Sequence
  Synthetic
agcaggatctgaagaaaca

SEQ ID NO: 32656 - DNA, 18 bp, Artificial Sequence
  Synthetic
aactgaactaggcgggaa

SEQ ID NO: 32657 - DNA, 24 bp, Artificial Sequence
  Synthetic
ccatactttcagcttctactatat

SEQ ID NO: 32658 - DNA, 19 bp, Artificial Sequence
  Synthetic
caccatcctgtattgtgct

SEQ ID NO: 32659 - DNA, 25 bp, Artificial Sequence
  Synthetic
ggtgtaaataattagactctggtat

SEQ ID NO: 32660 - DNA, 20 bp, Artificial Sequence
  Synthetic
ggagattcctcattttcgtc

SEQ ID NO: 32661 - DNA, 18 bp, Artificial Sequence
  Synthetic
gctcacatggctcagaaa

SEQ ID NO: 32662 - DNA, 20 bp, Artificial Sequence
  Synthetic
actttaggttgtctgcactt

SEQ ID NO: 32663 - DNA, 18 bp, Artificial Sequence
  Synthetic
tctcaaatcggtgcttca

SEQ ID NO: 32664 - DNA, 21 bp, Artificial Sequence
  Synthetic
tgaatgtgtgtcttctcagat

SEQ ID NO: 32665 - DNA, 18 bp, Artificial Sequence
  Synthetic
agttttcaaggctgggga

SEQ ID NO: 32666 - DNA, 18 bp, Artificial Sequence
  Synthetic
attttggacccagcttgc

SEQ ID NO: 32667 - DNA, 20 bp, Artificial Sequence
  Synthetic
cttatcattgggatcagctg

SEQ ID NO: 32668 - DNA, 20 bp, Artificial Sequence
  Synthetic
ggttccattggttctcacat

SEQ ID NO: 32669 - DNA, 22 bp, Artificial Sequence
  Synthetic
aagcaattttctagattcagcc

SEQ ID NO: 32670 - DNA, 20 bp, Artificial Sequence
  Synthetic
agccactcttaaatcgagtc

SEQ ID NO: 32671 - DNA, 20 bp, Artificial Sequence
  Synthetic
ccctcagagagactaatgtc

SEQ ID NO: 32672 - DNA, 18 bp, Artificial Sequence
  Synthetic
caactcgtttcgccatgt

SEQ ID NO: 32673 - DNA, 21 bp, Artificial Sequence
  Synthetic
gtgtcagtgctcttattaggt

SEQ ID NO: 32674 - DNA, 20 bp, Artificial Sequence
  Synthetic
aactgtaaaggagagctctg

SEQ ID NO: 32675 - DNA, 24 bp, Artificial Sequence
  Synthetic
caagtcctatagaatctatccact

SEQ ID NO: 32676 - DNA, 18 bp, Artificial Sequence
  Synthetic
gtggcatcggtaggtgta

SEQ ID NO: 32677 - DNA, 24 bp, Artificial Sequence
  Synthetic
attcttctttcttaatccttccag

SEQ ID NO: 32678 - DNA, 24 bp, Artificial Sequence
  Synthetic
cgcttttacaatatacacagctta

SEQ ID NO: 32679 - DNA, 22 bp, Artificial Sequence
  Synthetic
aattgcattatctggttcatct

SEQ ID NO: 32680 - DNA, 21 bp, Artificial Sequence
  Synthetic
tggtgagcttaaattgctatg

SEQ ID NO: 32681 - DNA, 22 bp, Artificial Sequence
  Synthetic
acaatcagctaactgtgcatat

SEQ ID NO: 32682 - DNA, 23 bp, Artificial Sequence
  Synthetic
agaatcttttcctgtaacacatt

SEQ ID NO: 32683 - DNA, 19 bp, Artificial Sequence
  Synthetic
tgcaatgtccacagttcat

SEQ ID NO: 32684 - DNA, 21 bp, Artificial Sequence
  Synthetic
aatccacaatgtctgaatggt

SEQ ID NO: 32685 - DNA, 20 bp, Artificial Sequence
  Synthetic
gatgtgcctgtaaatgtagg

SEQ ID NO: 32686 - DNA, 20 bp, Artificial Sequence
  Synthetic
taacaccaggaataggggta

SEQ ID NO: 32687 - DNA, 19 bp, Artificial Sequence
  Synthetic
ttgtttaccactgcgagta

SEQ ID NO: 32688 - DNA, 18 bp, Artificial Sequence
  Synthetic
agggatgaccactaaggc

SEQ ID NO: 32689 - DNA, 25 bp, Artificial Sequence
  Synthetic
tgtatttactagttctaatggagga

SEQ ID NO: 32690 - DNA, 23 bp, Artificial Sequence
  Synthetic
tgccctatcattagtacctttta

SEQ ID NO: 32691 - DNA, 20 bp, Artificial Sequence
  Synthetic
tttgagtgtttccctctgat

SEQ ID NO: 32692 - DNA, 21 bp, Artificial Sequence
  Synthetic
cattcagattcctgtgttctt

SEQ ID NO: 32693 - DNA, 20 bp, Artificial Sequence
  Synthetic
ggggattgtctgtaagaaca

SEQ ID NO: 32694 - DNA, 21 bp, Artificial Sequence
  Synthetic
acaattgtctgaccttgaatg

SEQ ID NO: 32695 - DNA, 21 bp, Artificial Sequence
  Synthetic
ccattattctcttgtctgctg

SEQ ID NO: 32696 - DNA, 20 bp, Artificial Sequence
  Synthetic
ccagggtttgtatcaactct

SEQ ID NO: 32697 - DNA, 19 bp, Artificial Sequence
  Synthetic
cttgggttaagtgcaacac

SEQ ID NO: 32698 - DNA, 20 bp, Artificial Sequence
  Synthetic
cttgttcctcagttggattc

SEQ ID NO: 32699 - DNA, 19 bp, Artificial Sequence
  Synthetic
ccacaattattgcctcagc

SEQ ID NO: 32700 - DNA, 19 bp, Artificial Sequence
  Synthetic
gggatcttgtgaccattga

SEQ ID NO: 32701 - DNA, 23 bp, Artificial Sequence
  Synthetic
ttgttgtaattgaatactggaga

SEQ ID NO: 32702 - DNA, 23 bp, Artificial Sequence
  Synthetic
ttttcgtttcattaccaacacta

SEQ ID NO: 32703 - DNA, 22 bp, Artificial Sequence
  Synthetic
gctgaatagaatcaatccagtg

SEQ ID NO: 32704 - DNA, 19 bp, Artificial Sequence
  Synthetic
cagaaactgcagttctctg

SEQ ID NO: 32705 - DNA, 20 bp, Artificial Sequence
  Synthetic
cggtagttttcgctacagaa

SEQ ID NO: 32706 - DNA, 25 bp, Artificial Sequence
  Synthetic
cattttaaggtattagcagaacctt

SEQ ID NO: 32707 - DNA, 21 bp, Artificial Sequence
  Synthetic
tttctgcatctacaggaacaa

SEQ ID NO: 32708 - DNA, 23 bp, Artificial Sequence
  Synthetic
ctgtataggcttttcacctatag

SEQ ID NO: 32709 - DNA, 22 bp, Artificial Sequence
  Synthetic
actcttactataccctctgatg

SEQ ID NO: 32710 - DNA, 24 bp, Artificial Sequence
  Synthetic
gactgtataactaactgtgcatta

SEQ ID NO: 32711 - DNA, 24 bp, Artificial Sequence
  Synthetic
gcccactataaacatttgaatttg

SEQ ID NO: 32712 - DNA, 22 bp, Artificial Sequence
  Synthetic
caaaaaaacacagcatctccat

SEQ ID NO: 32713 - DNA, 18 bp, Artificial Sequence
  Synthetic
ggtgtgtgtaaatgccct

SEQ ID NO: 32714 - DNA, 23 bp, Artificial Sequence
  Synthetic
gtttctataaactcacaagcatt

SEQ ID NO: 32715 - DNA, 20 bp, Artificial Sequence
  Synthetic
actttgaaatggcctggtta

SEQ ID NO: 32716 - DNA, 20 bp, Artificial Sequence
  Synthetic
tgtcttttaagccagtcagg

SEQ ID NO: 32717 - DNA, 22 bp, Artificial Sequence
  Synthetic
tctatgttggaggtaacaagta

SEQ ID NO: 32718 - DNA, 23 bp, Artificial Sequence
  Synthetic
aatagttcatggcttgtatctgt

SEQ ID NO: 32719 - DNA, 23 bp, Artificial Sequence
  Synthetic
agaaggaccaaataatacatcag

SEQ ID NO: 32720 - DNA, 23 bp, Artificial Sequence
  Synthetic
cctttaggtaatttcacagtttg

SEQ ID NO: 32721 - DNA, 20 bp, Artificial Sequence
  Synthetic
ggactgtggtgtaactgcat

SEQ ID NO: 32722 - DNA, 24 bp, Artificial Sequence
  Synthetic
ttctaatggtatagattccccaat

SEQ ID NO: 32723 - DNA, 20 bp, Artificial Sequence
  Synthetic
caatagattgtgctgttgct

SEQ ID NO: 32724 - DNA, 22 bp, Artificial Sequence
  Synthetic
aagaaaatagacgtttccacaa

SEQ ID NO: 32725 - DNA, 23 bp, Artificial Sequence
  Synthetic
tcaataatggaactaacaagctc

SEQ ID NO: 32726 - DNA, 19 bp, Artificial Sequence
  Synthetic
tgggctaatacatcagctg

SEQ ID NO: 32727 - DNA, 23 bp, Artificial Sequence
  Synthetic
acaaaaatataaagtgcatgtgc

SEQ ID NO: 32728 - DNA, 19 bp, Artificial Sequence
  Synthetic
gcccaatacagcttctact

SEQ ID NO: 32729 - DNA, 22 bp, Artificial Sequence
  Synthetic
agttattacagcagaaggagta

SEQ ID NO: 32730 - DNA, 22 bp, Artificial Sequence
  Synthetic
gatccatctgtactttcttcaa

SEQ ID NO: 32731 - DNA, 23 bp, Artificial Sequence
  Synthetic
ctaaagagttcgaaactaccttt

SEQ ID NO: 32732 - DNA, 23 bp, Artificial Sequence
  Synthetic
aaacccatatgaaataacctgta

SEQ ID NO: 32733 - DNA, 18 bp, Artificial Sequence
  Synthetic
gatgaggcgaagaagtgg

SEQ ID NO: 32734 - DNA, 18 bp, Artificial Sequence
  Synthetic
ttcagcagttggggcaga

SEQ ID NO: 32735 - DNA, 22 bp, Artificial Sequence
  Synthetic
ccctgaggatcaacaaatacat

SEQ ID NO: 32736 - DNA, 18 bp, Artificial Sequence
  Synthetic
ttcaaattgtacagcgcg

SEQ ID NO: 32737 - DNA, 19 bp, Artificial Sequence
  Synthetic
ctgcagctggaatatcact

SEQ ID NO: 32738 - DNA, 21 bp, Artificial Sequence
  Synthetic
ggatgaaccacatttaacacg

SEQ ID NO: 32739 - DNA, 22 bp, Artificial Sequence
  Synthetic
gctgtacatattcatccgtact

SEQ ID NO: 32740 - DNA, 20 bp, Artificial Sequence
  Synthetic
aagttccaattcctaaaggc

SEQ ID NO: 32741 - DNA, 22 bp, Artificial Sequence
  Synthetic
gtgttaatttaattgggggaca

SEQ ID NO: 32742 - DNA, 18 bp, Artificial Sequence
  Synthetic
tcaggagaacgaaaacgg

SEQ ID NO: 32743 - DNA, 19 bp, Artificial Sequence
  Synthetic
ggcgttgtcaaacaggaca

SEQ ID NO: 32744 - DNA, 18 bp, Artificial Sequence
  Synthetic
gcactcgtactgctcgct

SEQ ID NO: 32745 - DNA, 18 bp, Artificial Sequence
  Synthetic
tttcctgcatgccgttta

SEQ ID NO: 32746 - DNA, 18 bp, Artificial Sequence
  Synthetic
cccctggacatctggaca

SEQ ID NO: 32747 - DNA, 17 bp, Artificial Sequence
  Synthetic
agtgtgtgcctgggtgt

SEQ ID NO: 32748 - DNA, 17 bp, Artificial Sequence
  Synthetic
ggctggtccagggactt

SEQ ID NO: 32749 - DNA, 20 bp, Artificial Sequence
  Synthetic
ggcttagtgtgtcatggtga

SEQ ID NO: 32750 - DNA, 19 bp, Artificial Sequence
  Synthetic
tcaatgtcgacgaagatgc

SEQ ID NO: 32751 - DNA, 20 bp, Artificial Sequence
  Synthetic
tcccaggtctacgtgtgaaa

SEQ ID NO: 32752 - DNA, 18 bp, Artificial Sequence
  Synthetic
acgtgttccacccgtgaa

SEQ ID NO: 32753 - DNA, 18 bp, Artificial Sequence
  Synthetic
aggccaatagagccgagg

SEQ ID NO: 32754 - DNA, 19 bp, Artificial Sequence
  Synthetic
gcagtaaccgcagtccatg

SEQ ID NO: 32755 - DNA, 18 bp, Artificial Sequence
  Synthetic
cagggttggtgccttcac

SEQ ID NO: 32756 - DNA, 18 bp, Artificial Sequence
  Synthetic
agagaaggtggcccctgg

SEQ ID NO: 32757 - DNA, 18 bp, Artificial Sequence
  Synthetic
cgggagatgatggcgctg

SEQ ID NO: 32758 - DNA, 16 bp, Artificial Sequence
  Synthetic
aatggagccccgaccc

SEQ ID NO: 32759 - DNA, 16 bp, Artificial Sequence
  Synthetic
tgctgaccgaggccga

SEQ ID NO: 32760 - DNA, 19 bp, Artificial Sequence
  Synthetic
ggcgcaaggaaaaggagaa

SEQ ID NO: 32761 - DNA, 20 bp, Artificial Sequence
  Synthetic
acctcgcaaacatgctatca

SEQ ID NO: 32762 - DNA, 18 bp, Artificial Sequence
  Synthetic
gcgcggaatcaggaccat

SEQ ID NO: 32763 - DNA, 18 bp, Artificial Sequence
  Synthetic
cacccgccatggacctaa

SEQ ID NO: 32764 - DNA, 16 bp, Artificial Sequence
  Synthetic
cttgacgggggcagct

SEQ ID NO: 32765 - DNA, 16 bp, Artificial Sequence
  Synthetic
tacacccaccccggct

SEQ ID NO: 32766 - DNA, 16 bp, Artificial Sequence
  Synthetic
ctcgagggctgcagca

SEQ ID NO: 32767 - DNA, 18 bp, Artificial Sequence
  Synthetic
cgggctagcgagaatcca

SEQ ID NO: 32768 - DNA, 20 bp, Artificial Sequence
  Synthetic
tgagaagagctgacggtact

SEQ ID NO: 32769 - DNA, 16 bp, Artificial Sequence
  Synthetic
tgacgtcagcaggccg

SEQ ID NO: 32770 - DNA, 20 bp, Artificial Sequence
  Synthetic
tgcttcactttcttggggtg

SEQ ID NO: 32771 - DNA, 15 bp, Artificial Sequence
  Synthetic
aagggtgcagcggct

SEQ ID NO: 32772 - DNA, 19 bp, Artificial Sequence
  Synthetic
tggggcattccttgtacga

SEQ ID NO: 32773 - DNA, 19 bp, Artificial Sequence
  Synthetic
tgagcgctaagaagcagcc

SEQ ID NO: 32774 - DNA, 19 bp, Artificial Sequence
  Synthetic
gtcgtcatcaaggcccttg

SEQ ID NO: 32775 - DNA, 17 bp, Artificial Sequence
  Synthetic
cgttaacgcgagctccg

SEQ ID NO: 32776 - DNA, 19 bp, Artificial Sequence
  Synthetic
cggtcacgtctcatgttgg

SEQ ID NO: 32777 - DNA, 16 bp, Artificial Sequence
  Synthetic
cccgtggcctgcgtaa

SEQ ID NO: 32778 - DNA, 16 bp, Artificial Sequence
  Synthetic
cgcacctgcaagcaca

SEQ ID NO: 32779 - DNA, 20 bp, Artificial Sequence
  Synthetic
cctctgcttatcaatcggta

SEQ ID NO: 32780 - DNA, 18 bp, Artificial Sequence
  Synthetic
caaccctgttaggcacgg

SEQ ID NO: 32781 - DNA, 16 bp, Artificial Sequence
  Synthetic
gtgtccggagccgaca

SEQ ID NO: 32782 - DNA, 17 bp, Artificial Sequence
  Synthetic
acggttcctcactgggc

SEQ ID NO: 32783 - DNA, 19 bp, Artificial Sequence
  Synthetic
cctcctcctgctcctgttc

SEQ ID NO: 32784 - DNA, 18 bp, Artificial Sequence
  Synthetic
tactgggactcctgggcc

SEQ ID NO: 32785 - DNA, 20 bp, Artificial Sequence
  Synthetic
gtcttctttggcatccgagg

SEQ ID NO: 32786 - DNA, 16 bp, Artificial Sequence
  Synthetic
aggaactccagcggcg

SEQ ID NO: 32787 - DNA, 18 bp, Artificial Sequence
  Synthetic
acacgatggactgcctgg

SEQ ID NO: 32788 - DNA, 17 bp, Artificial Sequence
  Synthetic
gtcccccctggcattgt

SEQ ID NO: 32789 - DNA, 17 bp, Artificial Sequence
  Synthetic
gatgggtggagaggcca

SEQ ID NO: 32790 - DNA, 16 bp, Artificial Sequence
  Synthetic
tcagacacgcgacggg

SEQ ID NO: 32791 - DNA, 16 bp, Artificial Sequence
  Synthetic
acccgagaccgcagac

SEQ ID NO: 32792 - DNA, 20 bp, Artificial Sequence
  Synthetic
cactcccatacctggacctc

SEQ ID NO: 32793 - DNA, 16 bp, Artificial Sequence
  Synthetic
gcagccttgcgtggtg

SEQ ID NO: 32794 - DNA, 19 bp, Artificial Sequence
  Synthetic
cggatgcctgcctatggat

SEQ ID NO: 32795 - DNA, 18 bp, Artificial Sequence
  Synthetic
ttgagtggcctcgggacc

SEQ ID NO: 32796 - DNA, 17 bp, Artificial Sequence
  Synthetic
ggctgtggcgagtacca

SEQ ID NO: 32797 - DNA, 20 bp, Artificial Sequence
  Synthetic
tgcggatgtgttgttggtat

SEQ ID NO: 32798 - DNA, 20 bp, Artificial Sequence
  Synthetic
gctaccttcacctcctccaa

SEQ ID NO: 32799 - DNA, 18 bp, Artificial Sequence
  Synthetic
ttcctacgccctgcttca

SEQ ID NO: 32800 - DNA, 16 bp, Artificial Sequence
  Synthetic
agggacctcagcgcct

SEQ ID NO: 32801 - DNA, 20 bp, Artificial Sequence
  Synthetic
cgggttttctcagtacgtgc

SEQ ID NO: 32802 - DNA, 20 bp, Artificial Sequence
  Synthetic
ggggtgatttcacggatcag

SEQ ID NO: 32803 - DNA, 19 bp, Artificial Sequence
  Synthetic
cggtgctctcatgttggtc

SEQ ID NO: 32804 - DNA, 20 bp, Artificial Sequence
  Synthetic
agacagttgcagggatgaga

SEQ ID NO: 32805 - DNA, 19 bp, Artificial Sequence
  Synthetic
ccaggaagtccaaaactcc

SEQ ID NO: 32806 - DNA, 16 bp, Artificial Sequence
  Synthetic
aaccgccacccccttt

SEQ ID NO: 32807 - DNA, 16 bp, Artificial Sequence
  Synthetic
gcttggggcccacatg

SEQ ID NO: 32808 - DNA, 19 bp, Artificial Sequence
  Synthetic
gggtctcttttccgcttgt

SEQ ID NO: 32809 - DNA, 18 bp, Artificial Sequence
  Synthetic
ggacttgaggtgggctga

SEQ ID NO: 32810 - DNA, 19 bp, Artificial Sequence
  Synthetic
gcaaaggccaaagggagac

SEQ ID NO: 32811 - DNA, 18 bp, Artificial Sequence
  Synthetic
ctgcagacaccacccagt

SEQ ID NO: 32812 - DNA, 19 bp, Artificial Sequence
  Synthetic
gctctcagcctacaagagc

SEQ ID NO: 32813 - DNA, 20 bp, Artificial Sequence
  Synthetic
ggccctacattctggacaga

SEQ ID NO: 32814 - DNA, 16 bp, Artificial Sequence
  Synthetic
tccagacaccaggcgc

SEQ ID NO: 32815 - DNA, 18 bp, Artificial Sequence
  Synthetic
ctgacgcacagcctgtac

SEQ ID NO: 32816 - DNA, 18 bp, Artificial Sequence
  Synthetic
tggtctactgggagctgg

SEQ ID NO: 32817 - DNA, 16 bp, Artificial Sequence
  Synthetic
tgtgtgggcgagctga

SEQ ID NO: 32818 - DNA, 19 bp, Artificial Sequence
  Synthetic
gcctcaaccatcagtcacc

SEQ ID NO: 32819 - DNA, 16 bp, Artificial Sequence
  Synthetic
cctaccttggggcggt

SEQ ID NO: 32820 - DNA, 18 bp, Artificial Sequence
  Synthetic
taccccctggccacctac

SEQ ID NO: 32821 - DNA, 20 bp, Artificial Sequence
  Synthetic
tgcgaaactacctggatgac

SEQ ID NO: 32822 - DNA, 19 bp, Artificial Sequence
  Synthetic
tcatcaaggcctccctgag

SEQ ID NO: 32823 - DNA, 20 bp, Artificial Sequence
  Synthetic
ggccagccaagtctacagat

SEQ ID NO: 32824 - DNA, 15 bp, Artificial Sequence
  Synthetic
aatgcgcggcccatg

SEQ ID NO: 32825 - DNA, 18 bp, Artificial Sequence
  Synthetic
ttgtgacacacgtagcac

SEQ ID NO: 32826 - DNA, 19 bp, Artificial Sequence
  Synthetic
caagcctaactgcacgaca

SEQ ID NO: 32827 - DNA, 19 bp, Artificial Sequence
  Synthetic
agtgttgctgtatcaaggt

SEQ ID NO: 32828 - DNA, 18 bp, Artificial Sequence
  Synthetic
atccattctggcgtttcc

SEQ ID NO: 32829 - DNA, 19 bp, Artificial Sequence
  Synthetic
ccaatccccttcttctgtt

SEQ ID NO: 32830 - DNA, 24 bp, Artificial Sequence
  Synthetic
gggttacatcatctattagtccta

SEQ ID NO: 32831 - DNA, 23 bp, Artificial Sequence
  Synthetic
ccaactgaatttcaattgcttta

SEQ ID NO: 32832 - DNA, 19 bp, Artificial Sequence
  Synthetic
tttccctccaacatgtgta

SEQ ID NO: 32833 - DNA, 18 bp, Artificial Sequence
  Synthetic
gcttaaatggcggggtcg

SEQ ID NO: 32834 - DNA, 18 bp, Artificial Sequence
  Synthetic
agcactacaggtaggtgt

SEQ ID NO: 32835 - DNA, 18 bp, Artificial Sequence
  Synthetic
taatgtccgccttgggaa

SEQ ID NO: 32836 - DNA, 23 bp, Artificial Sequence
  Synthetic
gacacgtttagttttttaggaaa

SEQ ID NO: 32837 - DNA, 24 bp, Artificial Sequence
  Synthetic
ttgtataatgaagcatcaggtagt

SEQ ID NO: 32838 - DNA, 20 bp, Artificial Sequence
  Synthetic
ccaatgttcacctaagggag

SEQ ID NO: 32839 - DNA, 22 bp, Artificial Sequence
  Synthetic
tgcctgcctattataaaatgtc

SEQ ID NO: 32840 - DNA, 24 bp, Artificial Sequence
  Synthetic
acatatttgtactacgtgatgtgt

SEQ ID NO: 32841 - DNA, 18 bp, Artificial Sequence
  Synthetic
tctgcataggggtccttt

SEQ ID NO: 32842 - DNA, 20 bp, Artificial Sequence
  Synthetic
tatagtagcccgccaaaacg

SEQ ID NO: 32843 - DNA, 21 bp, Artificial Sequence
  Synthetic
cagacacattcttggacagaa

SEQ ID NO: 32844 - DNA, 19 bp, Artificial Sequence
  Synthetic
cttacatggttgttggcaa

SEQ ID NO: 32845 - DNA, 24 bp, Artificial Sequence
  Synthetic
cgttgctaatatagacaatctaac

SEQ ID NO: 32846 - DNA, 22 bp, Artificial Sequence
  Synthetic
tttactctttccttctccagta

SEQ ID NO: 32847 - DNA, 24 bp, Artificial Sequence
  Synthetic
ccatgtttaaaagatacattcgac

SEQ ID NO: 32848 - DNA, 25 bp, Artificial Sequence
  Synthetic
ctctaaaaagtttattccctggtat

SEQ ID NO: 32849 - DNA, 25 bp, Artificial Sequence
  Synthetic
gtcctgataataaatgtatttccag

SEQ ID NO: 32850 - DNA, 18 bp, Artificial Sequence
  Synthetic
aagaccttgtcgcggagg

SEQ ID NO: 32851 - DNA, 18 bp, Artificial Sequence
  Synthetic
aggtctagttggtctgct

SEQ ID NO: 32852 - DNA, 18 bp, Artificial Sequence
  Synthetic
aaattcaggtggaggcac

SEQ ID NO: 32853 - DNA, 22 bp, Artificial Sequence
  Synthetic
ggtgttatggcttaattcatct

SEQ ID NO: 32854 - DNA, 22 bp, Artificial Sequence
  Synthetic
tcatcagtgcttaatactttgg

SEQ ID NO: 32855 - DNA, 18 bp, Artificial Sequence
  Synthetic
aaagctgaattgggggac

SEQ ID NO: 32856 - DNA, 21 bp, Artificial Sequence
  Synthetic
ttttgtgctattggaagtacc

SEQ ID NO: 32857 - DNA, 20 bp, Artificial Sequence
  Synthetic
atggaaaatgctttctccac

SEQ ID NO: 32858 - DNA, 19 bp, Artificial Sequence
  Synthetic
agctggctaattgctcgtt

SEQ ID NO: 32859 - DNA, 20 bp, Artificial Sequence
  Synthetic
cctcactatcgtccccattg

SEQ ID NO: 32860 - DNA, 19 bp, Artificial Sequence
  Synthetic
tgtctacacataccccggc

SEQ ID NO: 32861 - DNA, 20 bp, Artificial Sequence
  Synthetic
atctgtacctgattgtgccg

SEQ ID NO: 32862 - DNA, 18 bp, Artificial Sequence
  Synthetic
acattttgccaccgtgtc

SEQ ID NO: 32863 - DNA, 18 bp, Artificial Sequence
  Synthetic
tggtcatatgcccattgc

SEQ ID NO: 32864 - DNA, 22 bp, Artificial Sequence
  Synthetic
aataaactctatgtcgtggtgt

SEQ ID NO: 32865 - DNA, 18 bp, Artificial Sequence
  Synthetic
attgccatccagtgcatt

SEQ ID NO: 32866 - DNA, 18 bp, Artificial Sequence
  Synthetic
ttaaacggctggccaatg

SEQ ID NO: 32867 - DNA, 19 bp, Artificial Sequence
  Synthetic
cttcctgtgcaaacctaac

SEQ ID NO: 32868 - DNA, 16 bp, Artificial Sequence
  Synthetic
tcccgtgctgctttgc

SEQ ID NO: 32869 - DNA, 18 bp, Artificial Sequence
  Synthetic
ttgataggaaggttgccc

SEQ ID NO: 32870 - DNA, 18 bp, Artificial Sequence
  Synthetic
ttggtcaagggactgcaa

SEQ ID NO: 32871 - DNA, 18 bp, Artificial Sequence
  Synthetic
aactactgcaacagacgc

SEQ ID NO: 32872 - DNA, 16 bp, Artificial Sequence
  Synthetic
atcggatgcccccacg

SEQ ID NO: 32873 - DNA, 19 bp, Artificial Sequence
  Synthetic
gtctgtgtagagccacaat

SEQ ID NO: 32874 - DNA, 18 bp, Artificial Sequence
  Synthetic
tagcgatgcatcaggaag

SEQ ID NO: 32875 - DNA, 23 bp, Artificial Sequence
  Synthetic
agatttaagttctataggagggc

SEQ ID NO: 32876 - DNA, 20 bp, Artificial Sequence
  Synthetic
tgttccttttagcacaaagc

SEQ ID NO: 32877 - DNA, 23 bp, Artificial Sequence
  Synthetic
cataactggaaaataaactgcaa

SEQ ID NO: 32878 - DNA, 20 bp, Artificial Sequence
  Synthetic
caacacatgacacacacatt

SEQ ID NO: 32879 - DNA, 18 bp, Artificial Sequence
  Synthetic
acaagcatgcacacctgc

SEQ ID NO: 32880 - DNA, 19 bp, Artificial Sequence
  Synthetic
cagtcttcccggcaattcc

SEQ ID NO: 32881 - DNA, 18 bp, Artificial Sequence
  Synthetic
gatttgccagtggagcgc

SEQ ID NO: 32882 - DNA, 18 bp, Artificial Sequence
  Synthetic
gcagggccagcaagaaga

SEQ ID NO: 32883 - DNA, 18 bp, Artificial Sequence
  Synthetic
ggcggacatcacaaccat

SEQ ID NO: 32884 - DNA, 18 bp, Artificial Sequence
  Synthetic
caacagtatgggtgcgcg

SEQ ID NO: 32885 - DNA, 19 bp, Artificial Sequence
  Synthetic
acactgccttggtgggtag

SEQ ID NO: 32886 - DNA, 18 bp, Artificial Sequence
  Synthetic
gtcgatcaggcaccttgg

SEQ ID NO: 32887 - DNA, 18 bp, Artificial Sequence
  Synthetic
tgagggcaggtgataggc

SEQ ID NO: 32888 - DNA, 18 bp, Artificial Sequence
  Synthetic
ccgctcctatctggccat

SEQ ID NO: 32889 - DNA, 18 bp, Artificial Sequence
  Synthetic
cgagatgccttgccatgg

SEQ ID NO: 32890 - DNA, 20 bp, Artificial Sequence
  Synthetic
ccactatggtgcccaaaagg

SEQ ID NO: 32891 - DNA, 16 bp, Artificial Sequence
  Synthetic
ggtcgaccgctccaca

SEQ ID NO: 32892 - DNA, 20 bp, Artificial Sequence
  Synthetic
gccactgagggattaagcac

SEQ ID NO: 32893 - DNA, 18 bp, Artificial Sequence
  Synthetic
ggggttgtcactgaccca

SEQ ID NO: 32894 - DNA, 20 bp, Artificial Sequence
  Synthetic
tctacaacttgagtgaccgc

SEQ ID NO: 32895 - DNA, 18 bp, Artificial Sequence
  Synthetic
tgtgtgaggccggtgaaa

SEQ ID NO: 32896 - DNA, 16 bp, Artificial Sequence
  Synthetic
ggcaatacgcggcgac

SEQ ID NO: 32897 - DNA, 18 bp, Artificial Sequence
  Synthetic
gctactgcagggttccct

SEQ ID NO: 32898 - DNA, 16 bp, Artificial Sequence
  Synthetic
ttggacggcgccttcc

SEQ ID NO: 32899 - DNA, 18 bp, Artificial Sequence
  Synthetic
gtggtatgacccgtgctg

SEQ ID NO: 32900 - DNA, 16 bp, Artificial Sequence
  Synthetic
ggtggtgcaggtggct

SEQ ID NO: 32901 - DNA, 18 bp, Artificial Sequence
  Synthetic
aggaggagggagagcaca

SEQ ID NO: 32902 - DNA, 18 bp, Artificial Sequence
  Synthetic
gtcctcctcggagcaagt

SEQ ID NO: 32903 - DNA, 20 bp, Artificial Sequence
  Synthetic
tccttagccccaaacccata

SEQ ID NO: 32904 - DNA, 20 bp, Artificial Sequence
  Synthetic
gttgagtcaaagcatcgggt

SEQ ID NO: 32905 - DNA, 18 bp, Artificial Sequence
  Synthetic
gcctccgtgaaggctctc

SEQ ID NO: 32906 - DNA, 18 bp, Artificial Sequence
  Synthetic
ccatatggtcggggcgta

SEQ ID NO: 32907 - DNA, 16 bp, Artificial Sequence
  Synthetic
aaacggccgctctccc

SEQ ID NO: 32908 - DNA, 20 bp, Artificial Sequence
  Synthetic
cggggttgttcaacagtttg

SEQ ID NO: 32909 - DNA, 17 bp, Artificial Sequence
  Synthetic
gtgtacggcgtgttcgg

SEQ ID NO: 32910 - DNA, 16 bp, Artificial Sequence
  Synthetic
aactgtgtggcggcgg

SEQ ID NO: 32911 - DNA, 18 bp, Artificial Sequence
  Synthetic
gcctgaaacagaccgtcc

SEQ ID NO: 32912 - DNA, 18 bp, Artificial Sequence
  Synthetic
ctgttttgccgacgaccg

SEQ ID NO: 32913 - DNA, 18 bp, Artificial Sequence
  Synthetic
tggacgatgggaatcggg

SEQ ID NO: 32914 - DNA, 18 bp, Artificial Sequence
  Synthetic
aaaccttcgtcgcgcatc

SEQ ID NO: 32915 - DNA, 20 bp, Artificial Sequence
  Synthetic
ccatgaatttcactgcgcct

SEQ ID NO: 32916 - DNA, 18 bp, Artificial Sequence
  Synthetic
tcagggagaaggaggcac

SEQ ID NO: 32917 - DNA, 18 bp, Artificial Sequence
  Synthetic
ccagagcggcaacaccta

SEQ ID NO: 32918 - DNA, 16 bp, Artificial Sequence
  Synthetic
gcttccgccagcccta

SEQ ID NO: 32919 - DNA, 18 bp, Artificial Sequence
  Synthetic
aattgccgaccatcaccg

SEQ ID NO: 32920 - DNA, 19 bp, Artificial Sequence
  Synthetic
ggataacgcgctggtatgc

SEQ ID NO: 32921 - DNA, 18 bp, Artificial Sequence
  Synthetic
cctgtcgcggattttcgg

SEQ ID NO: 32922 - DNA, 17 bp, Artificial Sequence
  Synthetic
ggcagcagggtttcgga

SEQ ID NO: 32923 - DNA, 20 bp, Artificial Sequence
  Synthetic
agcgttgatgatttgttggc

SEQ ID NO: 32924 - DNA, 18 bp, Artificial Sequence
  Synthetic
ttttgtggtggcaagcct

SEQ ID NO: 32925 - DNA, 20 bp, Artificial Sequence
  Synthetic
ggacatcttttgctgacgct

SEQ ID NO: 32926 - DNA, 20 bp, Artificial Sequence
  Synthetic
gagggcggttttcactttcc

SEQ ID NO: 32927 - DNA, 19 bp, Artificial Sequence
  Synthetic
actgtccacaaataccggc

SEQ ID NO: 32928 - DNA, 20 bp, Artificial Sequence
  Synthetic
accttaaataagctcgccgc

SEQ ID NO: 32929 - DNA, 18 bp, Artificial Sequence
  Synthetic
gcatcaccaagcttgccg

SEQ ID NO: 32930 - DNA, 16 bp, Artificial Sequence
  Synthetic
ttactgcgccgccgac

SEQ ID NO: 32931 - DNA, 16 bp, Artificial Sequence
  Synthetic
atatgccgaccgccgc

SEQ ID NO: 32932 - DNA, 15 bp, Artificial Sequence
  Synthetic
tgcggacgcgcgtat

SEQ ID NO: 32933 - DNA, 19 bp, Artificial Sequence
  Synthetic
cccgagcagaatgttgagc

SEQ ID NO: 32934 - DNA, 17 bp, Artificial Sequence
  Synthetic
cgtagctgtggcgcatc

SEQ ID NO: 32935 - DNA, 16 bp, Artificial Sequence
  Synthetic
cgcgtgccagacggat

SEQ ID NO: 32936 - DNA, 20 bp, Artificial Sequence
  Synthetic
gccctaccaacaaatcaccg

SEQ ID NO: 32937 - DNA, 16 bp, Artificial Sequence
  Synthetic
cgggctacggcttcct

SEQ ID NO: 32938 - DNA, 17 bp, Artificial Sequence
  Synthetic
cgcgaaatgggcattgc

SEQ ID NO: 32939 - DNA, 16 bp, Artificial Sequence
  Synthetic
aggacggcgtggtgtt

SEQ ID NO: 32940 - DNA, 18 bp, Artificial Sequence
  Synthetic
aactgcaaccccgaaacc

SEQ ID NO: 32941 - DNA, 16 bp, Artificial Sequence
  Synthetic
gcttccacgcctccga

SEQ ID NO: 32942 - DNA, 17 bp, Artificial Sequence
  Synthetic
aaaaggccgtccgttcg

SEQ ID NO: 32943 - DNA, 18 bp, Artificial Sequence
  Synthetic
cgcaaccggacgtttctg

SEQ ID NO: 32944 - DNA, 18 bp, Artificial Sequence
  Synthetic
gcataccgtttcccgacg

SEQ ID NO: 32945 - DNA, 20 bp, Artificial Sequence
  Synthetic
aacggcttgtttttcggatg

SEQ ID NO: 32946 - DNA, 20 bp, Artificial Sequence
  Synthetic
ggttaattggctgcgtatgc

SEQ ID NO: 32947 - DNA, 19 bp, Artificial Sequence
  Synthetic
gggtcagaccgaacacttg

SEQ ID NO: 32948 - DNA, 17 bp, Artificial Sequence
  Synthetic
gccggtcgaaacgcaaa

SEQ ID NO: 32949 - DNA, 18 bp, Artificial Sequence
  Synthetic
aattcggtgtcgtccacg

SEQ ID NO: 32950 - DNA, 17 bp, Artificial Sequence
  Synthetic
cggcgcggtaatttcgg

SEQ ID NO: 32951 - DNA, 20 bp, Artificial Sequence
  Synthetic
gtcggcattcggatattccc

SEQ ID NO: 32952 - DNA, 16 bp, Artificial Sequence
  Synthetic
agacagcgtgcgcctc

SEQ ID NO: 32953 - DNA, 15 bp, Artificial Sequence
  Synthetic
agcgcgtcggcaaag

SEQ ID NO: 32954 - DNA, 18 bp, Artificial Sequence
  Synthetic
cgcggtttgggtatgcac

SEQ ID NO: 32955 - DNA, 20 bp, Artificial Sequence
  Synthetic
caacccgcttccttcagttt

SEQ ID NO: 32956 - DNA, 16 bp, Artificial Sequence
  Synthetic
tcggcgcgatttgctg

SEQ ID NO: 32957 - DNA, 18 bp, Artificial Sequence
  Synthetic
ctcatcggcgacaacgtc

SEQ ID NO: 32958 - DNA, 15 bp, Artificial Sequence
  Synthetic
aacgcgcgcaacgtc

SEQ ID NO: 32959 - DNA, 16 bp, Artificial Sequence
  Synthetic
cgcgcccgattcttcg

SEQ ID NO: 32960 - DNA, 17 bp, Artificial Sequence
  Synthetic
gcaaacctgctgctgct

SEQ ID NO: 32961 - DNA, 16 bp, Artificial Sequence
  Synthetic
ttctcgcccctcgcct

SEQ ID NO: 32962 - DNA, 16 bp, Artificial Sequence
  Synthetic
tatggaagggcgcgcc

SEQ ID NO: 32963 - DNA, 17 bp, Artificial Sequence
  Synthetic
cgtcatcatcctgccgc

SEQ ID NO: 32964 - DNA, 19 bp, Artificial Sequence
  Synthetic
gcaaaaccgccctttcaga

SEQ ID NO: 32965 - DNA, 16 bp, Artificial Sequence
  Synthetic
gcacgctcgaaaccgc

SEQ ID NO: 32966 - DNA, 16 bp, Artificial Sequence
  Synthetic
cacgccgacggtttcg

SEQ ID NO: 32967 - DNA, 20 bp, Artificial Sequence
  Synthetic
cgaaaccgaacagggcatac

SEQ ID NO: 32968 - DNA, 18 bp, Artificial Sequence
  Synthetic
tgccaacgtaccagcaga

SEQ ID NO: 32969 - DNA, 16 bp, Artificial Sequence
  Synthetic
tcatcgggcgcggaaa

SEQ ID NO: 32970 - DNA, 16 bp, Artificial Sequence
  Synthetic
ggcgaagggctgctgt

SEQ ID NO: 32971 - DNA, 17 bp, Artificial Sequence
  Synthetic
gcaatatcacggggcgc

SEQ ID NO: 32972 - DNA, 17 bp, Artificial Sequence
  Synthetic
caaagccctcgccttcg

SEQ ID NO: 32973 - DNA, 17 bp, Artificial Sequence
  Synthetic
agaccacatcggcgtgt

SEQ ID NO: 32974 - DNA, 16 bp, Artificial Sequence
  Synthetic
tccagcccgccttcct

SEQ ID NO: 32975 - DNA, 16 bp, Artificial Sequence
  Synthetic
ttgagccgctgccacg

SEQ ID NO: 32976 - DNA, 16 bp, Artificial Sequence
  Synthetic
ttggtgaagctgcgcc

SEQ ID NO: 32977 - DNA, 19 bp, Artificial Sequence
  Synthetic
gacggcattttgctcacac

SEQ ID NO: 32978 - DNA, 16 bp, Artificial Sequence
  Synthetic
tcagacggcagcgacc

SEQ ID NO: 32979 - DNA, 17 bp, Artificial Sequence
  Synthetic
tcggttcgctgttgtgc

SEQ ID NO: 32980 - DNA, 16 bp, Artificial Sequence
  Synthetic
cttcgccacgcccaac

SEQ ID NO: 32981 - DNA, 16 bp, Artificial Sequence
  Synthetic
cctgcttgccgcccat

SEQ ID NO: 32982 - DNA, 19 bp, Artificial Sequence
  Synthetic
ttcatcccattcccaatca

SEQ ID NO: 32983 - DNA, 17 bp, Artificial Sequence
  Synthetic
cggcaggatttccgcct

SEQ ID NO: 32984 - DNA, 19 bp, Artificial Sequence
  Synthetic
gcgacaccaaagcaaacac

SEQ ID NO: 32985 - DNA, 16 bp, Artificial Sequence
  Synthetic
cgcagcctcgacgaac

SEQ ID NO: 32986 - DNA, 16 bp, Artificial Sequence
  Synthetic
cggcgaccactgttcg

SEQ ID NO: 32987 - DNA, 18 bp, Artificial Sequence
  Synthetic
gcttcctgcccgtcatcc

SEQ ID NO: 32988 - DNA, 16 bp, Artificial Sequence
  Synthetic
cgtcggtgcgattgcc

SEQ ID NO: 32989 - DNA, 16 bp, Artificial Sequence
  Synthetic
gccgtcattacccgcc

SEQ ID NO: 32990 - DNA, 18 bp, Artificial Sequence
  Synthetic
atccaaaccgacgttgcc

SEQ ID NO: 32991 - DNA, 20 bp, Artificial Sequence
  Synthetic
caactcccctttcgagcttt

SEQ ID NO: 32992 - DNA, 16 bp, Artificial Sequence
  Synthetic
attgccgctgcccgtc

SEQ ID NO: 32993 - DNA, 17 bp, Artificial Sequence
  Synthetic
tctgttcggggtcgctg

SEQ ID NO: 32994 - DNA, 17 bp, Artificial Sequence
  Synthetic
agggtaacgggtacgcc

SEQ ID NO: 32995 - DNA, 18 bp, Artificial Sequence
  Synthetic
cggctctgcattctgcca

SEQ ID NO: 32996 - DNA, 20 bp, Artificial Sequence
  Synthetic
actcgttttcagacggcatt

SEQ ID NO: 32997 - DNA, 16 bp, Artificial Sequence
  Synthetic
tctttcgccgccttgc

SEQ ID NO: 32998 - DNA, 19 bp, Artificial Sequence
  Synthetic
cggcatcggtttcgcaata

SEQ ID NO: 32999 - DNA, 16 bp, Artificial Sequence
  Synthetic
caaggttggcggcgac

SEQ ID NO: 33000 - DNA, 20 bp, Artificial Sequence
  Synthetic
accagacaccatgaacctct

SEQ ID NO: 33001 - DNA, 18 bp, Artificial Sequence
  Synthetic
ttgcccgcctgaacaaag

SEQ ID NO: 33002 - DNA, 19 bp, Artificial Sequence
  Synthetic
cgcagaagccaaacagcag

SEQ ID NO: 33003 - DNA, 19 bp, Artificial Sequence
  Synthetic
ggcatcaccctcaacctca

SEQ ID NO: 33004 - DNA, 16 bp, Artificial Sequence
  Synthetic
tcctgaccgcacgctg

SEQ ID NO: 33005 - DNA, 18 bp, Artificial Sequence
  Synthetic
aaacaggcacagctcgac

SEQ ID NO: 33006 - DNA, 16 bp, Artificial Sequence
  Synthetic
ccgaatggctgcacgc

SEQ ID NO: 33007 - DNA, 20 bp, Artificial Sequence
  Synthetic
cgctgattctccacatcacc

SEQ ID NO: 33008 - DNA, 17 bp, Artificial Sequence
  Synthetic
tcccgccacatcaacct

SEQ ID NO: 33009 - DNA, 18 bp, Artificial Sequence
  Synthetic
caaaccctgcacaccacg

SEQ ID NO: 33010 - DNA, 18 bp, Artificial Sequence
  Synthetic
tgctctttctgtcccccg

SEQ ID NO: 33011 - DNA, 17 bp, Artificial Sequence
  Synthetic
gccgtctgaacgttccg

SEQ ID NO: 33012 - DNA, 18 bp, Artificial Sequence
  Synthetic
cgcctatcccctgtcgtc

SEQ ID NO: 33013 - DNA, 20 bp, Artificial Sequence
  Synthetic
caccaaggcatttaggggat

SEQ ID NO: 33014 - DNA, 19 bp, Artificial Sequence
  Synthetic
ggcagttcaggcagtcgat

SEQ ID NO: 33015 - DNA, 19 bp, Artificial Sequence
  Synthetic
cctgaaactctacgccctg

SEQ ID NO: 33016 - DNA, 19 bp, Artificial Sequence
  Synthetic
cgataatggcagatacggc

SEQ ID NO: 33017 - DNA, 16 bp, Artificial Sequence
  Synthetic
cgaatggggacgcgac

SEQ ID NO: 33018 - DNA, 18 bp, Artificial Sequence
  Synthetic
catgcgcttcaccgacaa

SEQ ID NO: 33019 - DNA, 17 bp, Artificial Sequence
  Synthetic
acgaagccgccggattt

SEQ ID NO: 33020 - DNA, 17 bp, Artificial Sequence
  Synthetic
tcatccgacaaccgcga

SEQ ID NO: 33021 - DNA, 17 bp, Artificial Sequence
  Synthetic
gcccaatccgtccgcat

SEQ ID NO: 33022 - DNA, 18 bp, Artificial Sequence
  Synthetic
caggacaggcaaccgttt

SEQ ID NO: 33023 - DNA, 20 bp, Artificial Sequence
  Synthetic
aaaacgtcgaactggcattg

SEQ ID NO: 33024 - DNA, 18 bp, Artificial Sequence
  Synthetic
gcactggacgcacaagtt

SEQ ID NO: 33025 - DNA, 16 bp, Artificial Sequence
  Synthetic
gcgtgctgttccccca

SEQ ID NO: 33026 - DNA, 16 bp, Artificial Sequence
  Synthetic
tgccgtccatcctgcc

SEQ ID NO: 33027 - DNA, 17 bp, Artificial Sequence
  Synthetic
actcgccaccctttccg

SEQ ID NO: 33028 - DNA, 18 bp, Artificial Sequence
  Synthetic
gtcagcttcggacaccac

SEQ ID NO: 33029 - DNA, 18 bp, Artificial Sequence
  Synthetic
gtcgaaccgtcgcaaacc

SEQ ID NO: 33030 - DNA, 20 bp, Artificial Sequence
  Synthetic
cgtgtttgaaaaccgcgaac

SEQ ID NO: 33031 - DNA, 17 bp, Artificial Sequence
  Synthetic
cgcttatgccctgcacg

SEQ ID NO: 33032 - DNA, 20 bp, Artificial Sequence
  Synthetic
gcatttcccaagtggcgaaa

SEQ ID NO: 33033 - DNA, 16 bp, Artificial Sequence
  Synthetic
atcccccacgtcgacg

SEQ ID NO: 33034 - DNA, 16 bp, Artificial Sequence
  Synthetic
atcctgcccatcgccc

SEQ ID NO: 33035 - DNA, 18 bp, Artificial Sequence
  Synthetic
cgtccgaaccgcaacact

SEQ ID NO: 33036 - DNA, 17 bp, Artificial Sequence
  Synthetic
gcccaccttcaaacgcg

SEQ ID NO: 33037 - DNA, 18 bp, Artificial Sequence
  Synthetic
gccgttgccgtttcagac

SEQ ID NO: 33038 - DNA, 18 bp, Artificial Sequence
  Synthetic
ccgcacaacgcatacacg

SEQ ID NO: 33039 - DNA, 17 bp, Artificial Sequence
  Synthetic
gcattcaaccgccaggc

SEQ ID NO: 33040 - DNA, 16 bp, Artificial Sequence
  Synthetic
aactgcacgcactgcc

SEQ ID NO: 33041 - DNA, 16 bp, Artificial Sequence
  Synthetic
cgacggcgaaacggtg

SEQ ID NO: 33042 - DNA, 18 bp, Artificial Sequence
  Synthetic
gggaaacgggagaaacgg

SEQ ID NO: 33043 - DNA, 16 bp, Artificial Sequence
  Synthetic
gcggctcggtcgagat

SEQ ID NO: 33044 - DNA, 16 bp, Artificial Sequence
  Synthetic
agctccggatgcgctg

SEQ ID NO: 33045 - DNA, 20 bp, Artificial Sequence
  Synthetic
cctgtccaaatcttcctgcg

SEQ ID NO: 33046 - DNA, 20 bp, Artificial Sequence
  Synthetic
tgcatcagcgagtttacacc

SEQ ID NO: 33047 - DNA, 15 bp, Artificial Sequence
  Synthetic
tggcttcgcgcacga

SEQ ID NO: 33048 - DNA, 18 bp, Artificial Sequence
  Synthetic
gttgcggttgagcaggag

SEQ ID NO: 33049 - DNA, 18 bp, Artificial Sequence
  Synthetic
ctgaacataccggcgcag

SEQ ID NO: 33050 - DNA, 18 bp, Artificial Sequence
  Synthetic
ggacgcgttctgcaaaca

SEQ ID NO: 33051 - DNA, 16 bp, Artificial Sequence
  Synthetic
ggcgtgtgcttgggca

SEQ ID NO: 33052 - DNA, 18 bp, Artificial Sequence
  Synthetic
ttggcggaatattcgggc

SEQ ID NO: 33053 - DNA, 16 bp, Artificial Sequence
  Synthetic
tgcgggctacggcatg

SEQ ID NO: 33054 - DNA, 16 bp, Artificial Sequence
  Synthetic
caatcccgcaccgcag

SEQ ID NO: 33055 - DNA, 16 bp, Artificial Sequence
  Synthetic
cccttccccgcattgc

SEQ ID NO: 33056 - DNA, 16 bp, Artificial Sequence
  Synthetic
tggctgtgttccgggc

SEQ ID NO: 33057 - DNA, 20 bp, Artificial Sequence
  Synthetic
gcgaagaaaacgaaaaagga

SEQ ID NO: 33058 - DNA, 18 bp, Artificial Sequence
  Synthetic
ggtcaaaacatcggcaac

SEQ ID NO: 33059 - DNA, 17 bp, Artificial Sequence
  Synthetic
agggaattttgcgccgg

SEQ ID NO: 33060 - DNA, 20 bp, Artificial Sequence
  Synthetic
gcccaaacttttaacggctt

SEQ ID NO: 33061 - DNA, 17 bp, Artificial Sequence
  Synthetic
cggatacagcagcgcga

SEQ ID NO: 33062 - DNA, 17 bp, Artificial Sequence
  Synthetic
cacagaagcagcaccgg

SEQ ID NO: 33063 - DNA, 17 bp, Artificial Sequence
  Synthetic
tttgagcgcgtcaagca

SEQ ID NO: 33064 - DNA, 17 bp, Artificial Sequence
  Synthetic
cgccctgcaaaccgaag

SEQ ID NO: 33065 - DNA, 16 bp, Artificial Sequence
  Synthetic
aacccgcctcgccgaa

SEQ ID NO: 33066 - DNA, 20 bp, Artificial Sequence
  Synthetic
ccacatggttacactggcaa

SEQ ID NO: 33067 - DNA, 17 bp, Artificial Sequence
  Synthetic
gcgttttgccgcctctt

SEQ ID NO: 33068 - DNA, 16 bp, Artificial Sequence
  Synthetic
cgctgtgcgtggtcga

SEQ ID NO: 33069 - DNA, 18 bp, Artificial Sequence
  Synthetic
tgtccctccgcttcagat

SEQ ID NO: 33070 - DNA, 16 bp, Artificial Sequence
  Synthetic
atgctgcacgccgtcg

SEQ ID NO: 33071 - DNA, 23 bp, Artificial Sequence
  Synthetic
catgattttgaccacatcataat

SEQ ID NO: 33072 - DNA, 19 bp, Artificial Sequence
  Synthetic
gaaaacttactccgaagcg

SEQ ID NO: 33073 - DNA, 20 bp, Artificial Sequence
  Synthetic
agcaggttgtatttttgacg

SEQ ID NO: 33074 - DNA, 19 bp, Artificial Sequence
  Synthetic
gggcgacttcttcttcgtc

SEQ ID NO: 33075 - DNA, 19 bp, Artificial Sequence
  Synthetic
acatttaccgccacacaca

SEQ ID NO: 33076 - DNA, 18 bp, Artificial Sequence
  Synthetic
acacccgctcaacctgat

SEQ ID NO: 33077 - DNA, 17 bp, Artificial Sequence
  Synthetic
accgcctcaaagggacc

SEQ ID NO: 33078 - DNA, 19 bp, Artificial Sequence
  Synthetic
accgtagaagattggcaat

SEQ ID NO: 33079 - DNA, 17 bp, Artificial Sequence
  Synthetic
caaaacaacgcgctccg

SEQ ID NO: 33080 - DNA, 20 bp, Artificial Sequence
  Synthetic
acctgattaaaacacaaccg

SEQ ID NO: 33081 - DNA, 16 bp, Artificial Sequence
  Synthetic
gcccggacaccaaacc

SEQ ID NO: 33082 - DNA, 17 bp, Artificial Sequence
  Synthetic
ggcgaattggcgggaaa

SEQ ID NO: 33083 - DNA, 17 bp, Artificial Sequence
  Synthetic
ctccagcagctttgccc

SEQ ID NO: 33084 - DNA, 18 bp, Artificial Sequence
  Synthetic
ccagcttgggatctcatc

SEQ ID NO: 33085 - DNA, 18 bp, Artificial Sequence
  Synthetic
acctccgtccgaaaacct

SEQ ID NO: 33086 - DNA, 18 bp, Artificial Sequence
  Synthetic
ccggtttgcgttccgaag

SEQ ID NO: 33087 - DNA, 18 bp, Artificial Sequence
  Synthetic
agaacctgcaacgcatcg

SEQ ID NO: 33088 - DNA, 18 bp, Artificial Sequence
  Synthetic
gtgcttcggctttttgcg

SEQ ID NO: 33089 - DNA, 16 bp, Artificial Sequence
  Synthetic
tcctgccggcttaccc

SEQ ID NO: 33090 - DNA, 18 bp, Artificial Sequence
  Synthetic
attttcaggatgtggcgg

SEQ ID NO: 33091 - DNA, 17 bp, Artificial Sequence
  Synthetic
cggtcgagttcgcccat

SEQ ID NO: 33092 - DNA, 16 bp, Artificial Sequence
  Synthetic
ccgcctacacacggca

SEQ ID NO: 33093 - DNA, 20 bp, Artificial Sequence
  Synthetic
gccgcctattcttccgatac

SEQ ID NO: 33094 - DNA, 15 bp, Artificial Sequence
  Synthetic
tttgggcgcgttcgg

SEQ ID NO: 33095 - DNA, 16 bp, Artificial Sequence
  Synthetic
gcggccccgaactgat

SEQ ID NO: 33096 - DNA, 16 bp, Artificial Sequence
  Synthetic
agcaacaccgcctccg

SEQ ID NO: 33097 - DNA, 16 bp, Artificial Sequence
  Synthetic
gctgcaccgcgtgatc

SEQ ID NO: 33098 - DNA, 20 bp, Artificial Sequence
  Synthetic
gcgaaatccaagacttcggt

SEQ ID NO: 33099 - DNA, 16 bp, Artificial Sequence
  Synthetic
ggggctggcgacatca

SEQ ID NO: 33100 - DNA, 19 bp, Artificial Sequence
  Synthetic
cgataaagcgcgagaatgc

SEQ ID NO: 33101 - DNA, 16 bp, Artificial Sequence
  Synthetic
gaatgcgcgcagtccc

SEQ ID NO: 33102 - DNA, 19 bp, Artificial Sequence
  Synthetic
ggcaatgtcggcagtttct

SEQ ID NO: 33103 - DNA, 17 bp, Artificial Sequence
  Synthetic
accgaaccgacctcacc

SEQ ID NO: 33104 - DNA, 16 bp, Artificial Sequence
  Synthetic
gcttcgaccgcttcgc

SEQ ID NO: 33105 - DNA, 18 bp, Artificial Sequence
  Synthetic
tcggcgcgattttcagac

SEQ ID NO: 33106 - DNA, 20 bp, Artificial Sequence
  Synthetic
cacgcagtttttcaggatgc

SEQ ID NO: 33107 - DNA, 18 bp, Artificial Sequence
  Synthetic
caatgcctttgccacggg

SEQ ID NO: 33108 - DNA, 17 bp, Artificial Sequence
  Synthetic
ggtttgccacgcggttc

SEQ ID NO: 33109 - DNA, 19 bp, Artificial Sequence
  Synthetic
agaccttctttcatgcggc

SEQ ID NO: 33110 - DNA, 20 bp, Artificial Sequence
  Synthetic
gcttccagaaaatcgacgtg

SEQ ID NO: 33111 - DNA, 17 bp, Artificial Sequence
  Synthetic
cgaacaactcgccgcca

SEQ ID NO: 33112 - DNA, 18 bp, Artificial Sequence
  Synthetic
cgtcagcttcgccgaatc

SEQ ID NO: 33113 - DNA, 18 bp, Artificial Sequence
  Synthetic
cccaacgcaaagcccata

SEQ ID NO: 33114 - DNA, 19 bp, Artificial Sequence
  Synthetic
cgcaagtgcagattgggaa

SEQ ID NO: 33115 - DNA, 19 bp, Artificial Sequence
  Synthetic
gcagccgtctttttgcaac

SEQ ID NO: 33116 - DNA, 16 bp, Artificial Sequence
  Synthetic
ggcagcgaaggcacac

SEQ ID NO: 33117 - DNA, 15 bp, Artificial Sequence
  Synthetic
cgcctgccgcaacat

SEQ ID NO: 33118 - DNA, 16 bp, Artificial Sequence
  Synthetic
aacgcctgcgccttgc

SEQ ID NO: 33119 - DNA, 19 bp, Artificial Sequence
  Synthetic
ccatttccaaggcgcgttc

SEQ ID NO: 33120 - DNA, 16 bp, Artificial Sequence
  Synthetic
ttccgcaccctgccga

SEQ ID NO: 33121 - DNA, 23 bp, Artificial Sequence
  Synthetic
ggtttattaaaatcgcaaaaccc

SEQ ID NO: 33122 - DNA, 16 bp, Artificial Sequence
  Synthetic
accaactctccggcgg

SEQ ID NO: 33123 - DNA, 16 bp, Artificial Sequence
  Synthetic
gccgtgcagccggtat

SEQ ID NO: 33124 - DNA, 16 bp, Artificial Sequence
  Synthetic
ttcggctccggttggg

SEQ ID NO: 33125 - DNA, 20 bp, Artificial Sequence
  Synthetic
aagcgatatgattgaaggtg

SEQ ID NO: 33126 - DNA, 18 bp, Artificial Sequence
  Synthetic
gcgaaggaatcaacgcgg

SEQ ID NO: 33127 - DNA, 18 bp, Artificial Sequence
  Synthetic
gcctgttgagtatcgccc

SEQ ID NO: 33128 - DNA, 16 bp, Artificial Sequence
  Synthetic
agcaggcgcaggttgc

SEQ ID NO: 33129 - DNA, 17 bp, Artificial Sequence
  Synthetic
gagcgggaatggttcgc

SEQ ID NO: 33130 - DNA, 16 bp, Artificial Sequence
  Synthetic
aaccggcaaaccaggc

SEQ ID NO: 33131 - DNA, 18 bp, Artificial Sequence
  Synthetic
aggcaatccgaaacgcac

SEQ ID NO: 33132 - DNA, 18 bp, Artificial Sequence
  Synthetic
cgatacggcggacggttt

SEQ ID NO: 33133 - DNA, 16 bp, Artificial Sequence
  Synthetic
caatgcgccgcacctg

SEQ ID NO: 33134 - DNA, 17 bp, Artificial Sequence
  Synthetic
tcgccctataccacgcg

SEQ ID NO: 33135 - DNA, 16 bp, Artificial Sequence
  Synthetic
tgcctgcagccgagct

SEQ ID NO: 33136 - DNA, 18 bp, Artificial Sequence
  Synthetic
tgataaaacatccggcgc

SEQ ID NO: 33137 - DNA, 18 bp, Artificial Sequence
  Synthetic
ggcgtgtcagggctgttc

SEQ ID NO: 33138 - DNA, 16 bp, Artificial Sequence
  Synthetic
ataccggcggcaggtt

SEQ ID NO: 33139 - DNA, 20 bp, Artificial Sequence
  Synthetic
cgtcttttgcggttatccac

SEQ ID NO: 33140 - DNA, 20 bp, Artificial Sequence
  Synthetic
gccgatggaaaagcctttgt

SEQ ID NO: 33141 - DNA, 17 bp, Artificial Sequence
  Synthetic
gtaaccgcgcccagttt

SEQ ID NO: 33142 - DNA, 20 bp, Artificial Sequence
  Synthetic
atacgctgcttgaactcctc

SEQ ID NO: 33143 - DNA, 17 bp, Artificial Sequence
  Synthetic
acgacaccgacaggacg

SEQ ID NO: 33144 - DNA, 16 bp, Artificial Sequence
  Synthetic
tcacgggtatgggcgc

SEQ ID NO: 33145 - DNA, 16 bp, Artificial Sequence
  Synthetic
gaggcgcaaacgtggg

SEQ ID NO: 33146 - DNA, 17 bp, Artificial Sequence
  Synthetic
cgacacgcgccctgaaa

SEQ ID NO: 33147 - DNA, 19 bp, Artificial Sequence
  Synthetic
tccggctgttttcggttac

SEQ ID NO: 33148 - DNA, 16 bp, Artificial Sequence
  Synthetic
tgaacgcatcgcccgc

SEQ ID NO: 33149 - DNA, 18 bp, Artificial Sequence
  Synthetic
cccaatgtgtagcgtccc

SEQ ID NO: 33150 - DNA, 16 bp, Artificial Sequence
  Synthetic
gtcgccaagccgaagc

SEQ ID NO: 33151 - DNA, 20 bp, Artificial Sequence
  Synthetic
cggcgttcaacttatcgaca

SEQ ID NO: 33152 - DNA, 16 bp, Artificial Sequence
  Synthetic
agccctgtcgcccaga

SEQ ID NO: 33153 - DNA, 17 bp, Artificial Sequence
  Synthetic
cgtcaaacgctaccgcc

SEQ ID NO: 33154 - DNA, 17 bp, Artificial Sequence
  Synthetic
tctgccttccgcgtctt

SEQ ID NO: 33155 - DNA, 19 bp, Artificial Sequence
  Synthetic
gccttttgcgcctgatacg

SEQ ID NO: 33156 - DNA, 15 bp, Artificial Sequence
  Synthetic
tcatcacgcgcccga

SEQ ID NO: 33157 - DNA, 17 bp, Artificial Sequence
  Synthetic
cccttcccaagcctgca

SEQ ID NO: 33158 - DNA, 19 bp, Artificial Sequence
  Synthetic
gtctttgcggcgttggttt

SEQ ID NO: 33159 - DNA, 16 bp, Artificial Sequence
  Synthetic
gttgatgcctgccggg

SEQ ID NO: 33160 - DNA, 16 bp, Artificial Sequence
  Synthetic
aaagcccgcagcgtcg

SEQ ID NO: 33161 - DNA, 17 bp, Artificial Sequence
  Synthetic
tggttccggggctgtac

SEQ ID NO: 33162 - DNA, 18 bp, Artificial Sequence
  Synthetic
ggaatcaggcattggggc

SEQ ID NO: 33163 - DNA, 20 bp, Artificial Sequence
  Synthetic
caaaatagaaaaggcggctt

SEQ ID NO: 33164 - DNA, 18 bp, Artificial Sequence
  Synthetic
aactgcgttttgaacacc

SEQ ID NO: 33165 - DNA, 19 bp, Artificial Sequence
  Synthetic
gcggctaccaaagaaaccg

SEQ ID NO: 33166 - DNA, 18 bp, Artificial Sequence
  Synthetic
caagaacccagtctcgcc

SEQ ID NO: 33167 - DNA, 20 bp, Artificial Sequence
  Synthetic
gctattccgaagcggtttgc

SEQ ID NO: 33168 - DNA, 20 bp, Artificial Sequence
  Synthetic
aactcggttttcagctggaa

SEQ ID NO: 33169 - DNA, 19 bp, Artificial Sequence
  Synthetic
gctgctgtagttgtcgacg

SEQ ID NO: 33170 - DNA, 19 bp, Artificial Sequence
  Synthetic
gcttccaaggccgtctgaa

SEQ ID NO: 33171 - DNA, 18 bp, Artificial Sequence
  Synthetic
ctgcctcgaccaattccc

SEQ ID NO: 33172 - DNA, 23 bp, Artificial Sequence
  Synthetic
ttttgaaacatgaaaatccatcc

SEQ ID NO: 33173 - DNA, 17 bp, Artificial Sequence
  Synthetic
ccgaacggtggcgacat

SEQ ID NO: 33174 - DNA, 19 bp, Artificial Sequence
  Synthetic
tcggtttccaacgtatcgg

SEQ ID NO: 33175 - DNA, 17 bp, Artificial Sequence
  Synthetic
cgtggcggtctttcagg

SEQ ID NO: 33176 - DNA, 19 bp, Artificial Sequence
  Synthetic
caaaaacatccccatgcgg

SEQ ID NO: 33177 - DNA, 18 bp, Artificial Sequence
  Synthetic
tgatactcggtcgggtcg

SEQ ID NO: 33178 - DNA, 17 bp, Artificial Sequence
  Synthetic
cgcaaggcgttttcgga

SEQ ID NO: 33179 - DNA, 20 bp, Artificial Sequence
  Synthetic
ggctttcatggagtcggtaa

SEQ ID NO: 33180 - DNA, 17 bp, Artificial Sequence
  Synthetic
aaactcaaagccgccgg

SEQ ID NO: 33181 - DNA, 17 bp, Artificial Sequence
  Synthetic
gccgttgccgttttggt

SEQ ID NO: 33182 - DNA, 16 bp, Artificial Sequence
  Synthetic
acgcatcgctgccgac

SEQ ID NO: 33183 - DNA, 18 bp, Artificial Sequence
  Synthetic
tcgtactctccaacggct

SEQ ID NO: 33184 - DNA, 16 bp, Artificial Sequence
  Synthetic
ccacactgttcggcgc

SEQ ID NO: 33185 - DNA, 20 bp, Artificial Sequence
  Synthetic
gccatcgcggtattcatctc

SEQ ID NO: 33186 - DNA, 18 bp, Artificial Sequence
  Synthetic
gcctttatcgcgccgatt

SEQ ID NO: 33187 - DNA, 20 bp, Artificial Sequence
  Synthetic
ggataatcagcaggctgccc

SEQ ID NO: 33188 - DNA, 19 bp, Artificial Sequence
  Synthetic
ttgaaagaattgatggccg

SEQ ID NO: 33189 - DNA, 20 bp, Artificial Sequence
  Synthetic
tggaagaaagctttaccctg

SEQ ID NO: 33190 - DNA, 16 bp, Artificial Sequence
  Synthetic
ccgtcgcacctttgcc

SEQ ID NO: 33191 - DNA, 20 bp, Artificial Sequence
  Synthetic
tccgtccaaaccttccaaag

SEQ ID NO: 33192 - DNA, 16 bp, Artificial Sequence
  Synthetic
cgtggttggcggcaac

SEQ ID NO: 33193 - DNA, 20 bp, Artificial Sequence
  Synthetic
acatcaccaaagacgcagaa

SEQ ID NO: 33194 - DNA, 17 bp, Artificial Sequence
  Synthetic
gcgatgtcggtttcggc

SEQ ID NO: 33195 - DNA, 17 bp, Artificial Sequence
  Synthetic
cgaatacgcgggcgaag

SEQ ID NO: 33196 - DNA, 20 bp, Artificial Sequence
  Synthetic
ttacgagcgtttttctccgc

SEQ ID NO: 33197 - DNA, 16 bp, Artificial Sequence
  Synthetic
aaccgcgccgactacc

SEQ ID NO: 33198 - DNA, 18 bp, Artificial Sequence
  Synthetic
acatacaaaccggtgccg

SEQ ID NO: 33199 - DNA, 16 bp, Artificial Sequence
  Synthetic
attgcagacggcgggc

SEQ ID NO: 33200 - DNA, 19 bp, Artificial Sequence
  Synthetic
gcccgaactacgacggtag

SEQ ID NO: 33201 - DNA, 18 bp, Artificial Sequence
  Synthetic
tggcggtgaaagaactcg

SEQ ID NO: 33202 - DNA, 20 bp, Artificial Sequence
  Synthetic
gcgtttgtttcatgccgaaa

SEQ ID NO: 33203 - DNA, 19 bp, Artificial Sequence
  Synthetic
aaaccggttgaagactgat

SEQ ID NO: 33204 - DNA, 17 bp, Artificial Sequence
  Synthetic
aattcgacaccgccgtc

SEQ ID NO: 33205 - DNA, 16 bp, Artificial Sequence
  Synthetic
ctttcggcggcaaccc

SEQ ID NO: 33206 - DNA, 15 bp, Artificial Sequence
  Synthetic
tgcgccgcctgttgt

SEQ ID NO: 33207 - DNA, 17 bp, Artificial Sequence
  Synthetic
cgacaacgaagccaccc

SEQ ID NO: 33208 - DNA, 20 bp, Artificial Sequence
  Synthetic
cggttttaatcgcttgggca

SEQ ID NO: 33209 - DNA, 18 bp, Artificial Sequence
  Synthetic
ggcaacgaaatcggcgag

SEQ ID NO: 33210 - DNA, 15 bp, Artificial Sequence
  Synthetic
atgacggcggcggtt

SEQ ID NO: 33211 - DNA, 18 bp, Artificial Sequence
  Synthetic
cgggcgttttcaggagaa

SEQ ID NO: 33212 - DNA, 16 bp, Artificial Sequence
  Synthetic
acaggcttctgcggcg

SEQ ID NO: 33213 - DNA, 17 bp, Artificial Sequence
  Synthetic
ggcgcgcaaaatcaggg

SEQ ID NO: 33214 - DNA, 18 bp, Artificial Sequence
  Synthetic
acatcgccgaaaaacgcc

SEQ ID NO: 33215 - DNA, 19 bp, Artificial Sequence
  Synthetic
gcggtctcaatcccaaaga

SEQ ID NO: 33216 - DNA, 17 bp, Artificial Sequence
  Synthetic
gcggcggacgtattgca

SEQ ID NO: 33217 - DNA, 24 bp, Artificial Sequence
  Synthetic
ggtaacatatctgctaatctggta

SEQ ID NO: 33218 - DNA, 19 bp, Artificial Sequence
  Synthetic
aagtcgaagccaacgaagg

SEQ ID NO: 33219 - DNA, 20 bp, Artificial Sequence
  Synthetic
gtaaaaacttcggttgcggc

SEQ ID NO: 33220 - DNA, 19 bp, Artificial Sequence
  Synthetic
cgtttcaacgccgaagaca

SEQ ID NO: 33221 - DNA, 18 bp, Artificial Sequence
  Synthetic
ccagggcatcgtacacgt

SEQ ID NO: 33222 - DNA, 18 bp, Artificial Sequence
  Synthetic
ccgtccccatccctttgt

SEQ ID NO: 33223 - DNA, 17 bp, Artificial Sequence
  Synthetic
gcgcgtgcaaaccgatt

SEQ ID NO: 33224 - DNA, 18 bp, Artificial Sequence
  Synthetic
gtctgtgcgcaaaagctg

SEQ ID NO: 33225 - DNA, 17 bp, Artificial Sequence
  Synthetic
gtccgcccagcaggaaa

SEQ ID NO: 33226 - DNA, 17 bp, Artificial Sequence
  Synthetic
tgtccttcacgccggaa

SEQ ID NO: 33227 - DNA, 17 bp, Artificial Sequence
  Synthetic
cggcgttcggatgcgaa

SEQ ID NO: 33228 - DNA, 16 bp, Artificial Sequence
  Synthetic
cgcgtccgtagcccaa

SEQ ID NO: 33229 - DNA, 16 bp, Artificial Sequence
  Synthetic
aaccctcgtccgcgtc

SEQ ID NO: 33230 - DNA, 15 bp, Artificial Sequence
  Synthetic
cgcttcgcgcccaaa

SEQ ID NO: 33231 - DNA, 23 bp, Artificial Sequence
  Synthetic
gtattatcaatgacaacggtaga

SEQ ID NO: 33232 - DNA, 18 bp, Artificial Sequence
  Synthetic
cctacggtactgcctgta

SEQ ID NO: 33233 - DNA, 17 bp, Artificial Sequence
  Synthetic
gccgtacccagcatcct

SEQ ID NO: 33234 - DNA, 16 bp, Artificial Sequence
  Synthetic
caaacgcaggtcgccg

SEQ ID NO: 33235 - DNA, 18 bp, Artificial Sequence
  Synthetic
cacgataatggcggcagg

SEQ ID NO: 33236 - DNA, 16 bp, Artificial Sequence
  Synthetic
atccctcgccagagcc

SEQ ID NO: 33237 - DNA, 17 bp, Artificial Sequence
  Synthetic
cgtaccggcgacctgat

SEQ ID NO: 33238 - DNA, 20 bp, Artificial Sequence
  Synthetic
ggtatgcccgaattgcacaa

SEQ ID NO: 33239 - DNA, 16 bp, Artificial Sequence
  Synthetic
gcaacatcggacgcgg

SEQ ID NO: 33240 - DNA, 17 bp, Artificial Sequence
  Synthetic
tcgaagcgggactgctt

SEQ ID NO: 33241 - DNA, 18 bp, Artificial Sequence
  Synthetic
gcgtttcctgcgtggtaa

SEQ ID NO: 33242 - DNA, 18 bp, Artificial Sequence
  Synthetic
cctgcgctttgagttcgg

SEQ ID NO: 33243 - DNA, 17 bp, Artificial Sequence
  Synthetic
tcagcccaccgatccaa

SEQ ID NO: 33244 - DNA, 18 bp, Artificial Sequence
  Synthetic
gccccaaagccctggttt

SEQ ID NO: 33245 - DNA, 17 bp, Artificial Sequence
  Synthetic
gcatgaacggccaaggc

SEQ ID NO: 33246 - DNA, 19 bp, Artificial Sequence
  Synthetic
cagtttgcgcaaagcctga

SEQ ID NO: 33247 - DNA, 17 bp, Artificial Sequence
  Synthetic
aatgggcgcattcaccc

SEQ ID NO: 33248 - DNA, 19 bp, Artificial Sequence
  Synthetic
cggcccaaaaccttttccg

SEQ ID NO: 33249 - DNA, 17 bp, Artificial Sequence
  Synthetic
cccgaagccgtggatgt

SEQ ID NO: 33250 - DNA, 18 bp, Artificial Sequence
  Synthetic
gctctatggcgcgattgc

SEQ ID NO: 33251 - DNA, 17 bp, Artificial Sequence
  Synthetic
cgaccaaatcgtccggc

SEQ ID NO: 33252 - DNA, 17 bp, Artificial Sequence
  Synthetic
atcgtcagccgttcggc

SEQ ID NO: 33253 - DNA, 16 bp, Artificial Sequence
  Synthetic
actggctcgccctgct

SEQ ID NO: 33254 - DNA, 16 bp, Artificial Sequence
  Synthetic
ccgccttcgccgaaga

SEQ ID NO: 33255 - DNA, 16 bp, Artificial Sequence
  Synthetic
tgcgcccggtacaacc

SEQ ID NO: 33256 - DNA, 19 bp, Artificial Sequence
  Synthetic
cgtaatttcctgttgccaa

SEQ ID NO: 33257 - DNA, 18 bp, Artificial Sequence
  Synthetic
ccaactggccggtacact

SEQ ID NO: 33258 - DNA, 18 bp, Artificial Sequence
  Synthetic
agccgaaacacgaaacgc

SEQ ID NO: 33259 - DNA, 20 bp, Artificial Sequence
  Synthetic
ccaagaaggaaataccggat

SEQ ID NO: 33260 - DNA, 18 bp, Artificial Sequence
  Synthetic
cagtcctcttgagcagtt

SEQ ID NO: 33261 - DNA, 20 bp, Artificial Sequence
  Synthetic
ggcaagctttattatcgtgt

SEQ ID NO: 33262 - DNA, 18 bp, Artificial Sequence
  Synthetic
cttcttgtgaagcagtgc

SEQ ID NO: 33263 - DNA, 20 bp, Artificial Sequence
  Synthetic
tcattaaaagcttgttggcc

SEQ ID NO: 33264 - DNA, 21 bp, Artificial Sequence
  Synthetic
cagttcaactttttgttcgtg

SEQ ID NO: 33265 - DNA, 18 bp, Artificial Sequence
  Synthetic
attcgacgtgacagtctg

SEQ ID NO: 33266 - DNA, 22 bp, Artificial Sequence
  Synthetic
cgtcaaacaagatgtcaatttg

SEQ ID NO: 33267 - DNA, 18 bp, Artificial Sequence
  Synthetic
ctgtttgagcaggtcggg

SEQ ID NO: 33268 - DNA, 15 bp, Artificial Sequence
  Synthetic
agtggtcggcggcaa

SEQ ID NO: 33269 - DNA, 18 bp, Artificial Sequence
  Synthetic
cgatacgggtggtgcaaa

SEQ ID NO: 33270 - DNA, 16 bp, Artificial Sequence
  Synthetic
tccgtgccggcaaaca

SEQ ID NO: 33271 - DNA, 18 bp, Artificial Sequence
  Synthetic
ctttgtagggaacgcggc

SEQ ID NO: 33272 - DNA, 17 bp, Artificial Sequence
  Synthetic
cggcgcgatgatttcgg

SEQ ID NO: 33273 - DNA, 16 bp, Artificial Sequence
  Synthetic
aggaatgcgggggacg

SEQ ID NO: 33274 - DNA, 19 bp, Artificial Sequence
  Synthetic
cggttgctgacattgtcgt

SEQ ID NO: 33275 - DNA, 16 bp, Artificial Sequence
  Synthetic
cgccctgcttcgagga

SEQ ID NO: 33276 - DNA, 19 bp, Artificial Sequence
  Synthetic
cgacgatttggttgcccaa

SEQ ID NO: 33277 - DNA, 17 bp, Artificial Sequence
  Synthetic
cggcaaacggcatcacc

SEQ ID NO: 33278 - DNA, 19 bp, Artificial Sequence
  Synthetic
gtgctgcaccatcattggg

SEQ ID NO: 33279 - DNA, 16 bp, Artificial Sequence
  Synthetic
ccaacgcgggtttggg

SEQ ID NO: 33280 - DNA, 18 bp, Artificial Sequence
  Synthetic
gtgcaagatccgggcaat

SEQ ID NO: 33281 - DNA, 19 bp, Artificial Sequence
  Synthetic
ttaccgtacaggcaatgcg

SEQ ID NO: 33282 - DNA, 20 bp, Artificial Sequence
  Synthetic
cctacggtttggacgatgac

SEQ ID NO: 33283 - DNA, 16 bp, Artificial Sequence
  Synthetic
ccgacggcgaatggct

SEQ ID NO: 33284 - DNA, 19 bp, Artificial Sequence
  Synthetic
cctatttcgacgacgcgca

SEQ ID NO: 33285 - DNA, 18 bp, Artificial Sequence
  Synthetic
ttgaggacgttttgcgcg

SEQ ID NO: 33286 - DNA, 20 bp, Artificial Sequence
  Synthetic
gcgaaggttttgatatgccg

SEQ ID NO: 33287 - DNA, 19 bp, Artificial Sequence
  Synthetic
gcggttgtcgaatgttccg

SEQ ID NO: 33288 - DNA, 16 bp, Artificial Sequence
  Synthetic
aaggcgagctggcgga

SEQ ID NO: 33289 - DNA, 18 bp, Artificial Sequence
  Synthetic
gtgtccaccattacgggc

SEQ ID NO: 33290 - DNA, 15 bp, Artificial Sequence
  Synthetic
tgggcgcggacatca

SEQ ID NO: 33291 - DNA, 20 bp, Artificial Sequence
  Synthetic
cctgtgtcttcgatgagctg

SEQ ID NO: 33292 - DNA, 17 bp, Artificial Sequence
  Synthetic
atgtgccgtctgaacgc

SEQ ID NO: 33293 - DNA, 18 bp, Artificial Sequence
  Synthetic
gagacaacgatgcgggga

SEQ ID NO: 33294 - DNA, 19 bp, Artificial Sequence
  Synthetic
gttatgcggcaaatcaggc

SEQ ID NO: 33295 - DNA, 19 bp, Artificial Sequence
  Synthetic
ttaggcggcgaaaccattt

SEQ ID NO: 33296 - DNA, 17 bp, Artificial Sequence
  Synthetic
gcgcggcaaagtcagag

SEQ ID NO: 33297 - DNA, 18 bp, Artificial Sequence
  Synthetic
tgaatattgcccgtgccc

SEQ ID NO: 33298 - DNA, 18 bp, Artificial Sequence
  Synthetic
ctttggcgaggttggctt

SEQ ID NO: 33299 - DNA, 22 bp, Artificial Sequence
  Synthetic
gaaatcgcagtattgaaaaagt

SEQ ID NO: 33300 - DNA, 18 bp, Artificial Sequence
  Synthetic
gccgaactcgctgactgc

SEQ ID NO: 33301 - DNA, 20 bp, Artificial Sequence
  Synthetic
gggtctgatatgctgcaatt

SEQ ID NO: 33302 - DNA, 18 bp, Artificial Sequence
  Synthetic
gttttcaggatgccgggc

SEQ ID NO: 33303 - DNA, 18 bp, Artificial Sequence
  Synthetic
cggggaagtcggctttgt

SEQ ID NO: 33304 - DNA, 17 bp, Artificial Sequence
  Synthetic
ttatgcgcgaactcggc

SEQ ID NO: 33305 - DNA, 17 bp, Artificial Sequence
  Synthetic
ggcgcaaagggcaacag

SEQ ID NO: 33306 - DNA, 18 bp, Artificial Sequence
  Synthetic
aacaaacgctccgaaccg

SEQ ID NO: 33307 - DNA, 18 bp, Artificial Sequence
  Synthetic
aatccccctgaccgtacg

SEQ ID NO: 33308 - DNA, 18 bp, Artificial Sequence
  Synthetic
gccgcagtcttgacgttt

SEQ ID NO: 33309 - DNA, 15 bp, Artificial Sequence
  Synthetic
tggcaagcgcgacga

SEQ ID NO: 33310 - DNA, 17 bp, Artificial Sequence
  Synthetic
tgctcctcgcctcatgc

SEQ ID NO: 33311 - DNA, 16 bp, Artificial Sequence
  Synthetic
acctcgacccccgttc

SEQ ID NO: 33312 - DNA, 18 bp, Artificial Sequence
  Synthetic
gaggacaccgttttcgcc

SEQ ID NO: 33313 - DNA, 19 bp, Artificial Sequence
  Synthetic
cctcgacagccatcccaat

SEQ ID NO: 33314 - DNA, 20 bp, Artificial Sequence
  Synthetic
gcccctgatgtttcaagtcg

SEQ ID NO: 33315 - DNA, 20 bp, Artificial Sequence
  Synthetic
gcgtagtcatgcgttttcct

SEQ ID NO: 33316 - DNA, 19 bp, Artificial Sequence
  Synthetic
aaatgattgagcgcaaaga

SEQ ID NO: 33317 - DNA, 16 bp, Artificial Sequence
  Synthetic
tcggcacaacctgcgc

SEQ ID NO: 33318 - DNA, 17 bp, Artificial Sequence
  Synthetic
cgaagccgtccgtttcg

SEQ ID NO: 33319 - DNA, 16 bp, Artificial Sequence
  Synthetic
ttcgtgcagtcgggcg

SEQ ID NO: 33320 - DNA, 17 bp, Artificial Sequence
  Synthetic
gagtccgaccgtccaca

SEQ ID NO: 33321 - DNA, 19 bp, Artificial Sequence
  Synthetic
cgtgccgaacatgggtatg

SEQ ID NO: 33322 - DNA, 16 bp, Artificial Sequence
  Synthetic
gaatcgcggcggcttc

SEQ ID NO: 33323 - DNA, 20 bp, Artificial Sequence
  Synthetic
cgcagaacatggtgtcgtaa

SEQ ID NO: 33324 - DNA, 19 bp, Artificial Sequence
  Synthetic
tgttgttgaggtcgaggat

SEQ ID NO: 33325 - DNA, 16 bp, Artificial Sequence
  Synthetic
ggccaaacgtgtcgct

SEQ ID NO: 33326 - DNA, 18 bp, Artificial Sequence
  Synthetic
cgcccccgaatttttgca

SEQ ID NO: 33327 - DNA, 16 bp, Artificial Sequence
  Synthetic
caaacgcccgatgccc

SEQ ID NO: 33328 - DNA, 20 bp, Artificial Sequence
  Synthetic
ccatgcctgcatcaaatcgg

SEQ ID NO: 33329 - DNA, 19 bp, Artificial Sequence
  Synthetic
tcatatggcgtgtctcccg

SEQ ID NO: 33330 - DNA, 17 bp, Artificial Sequence
  Synthetic
acgtcgagggcttggaa

SEQ ID NO: 33331 - DNA, 16 bp, Artificial Sequence
  Synthetic
aagggtcgccgctgtc

SEQ ID NO: 33332 - DNA, 20 bp, Artificial Sequence
  Synthetic
gctttttctgccggtttacg

SEQ ID NO: 33333 - DNA, 20 bp, Artificial Sequence
  Synthetic
tgcccgtaaattccaacacg

SEQ ID NO: 33334 - DNA, 20 bp, Artificial Sequence
  Synthetic
ccttgtttcagcgtgttgcc

SEQ ID NO: 33335 - DNA, 20 bp, Artificial Sequence
  Synthetic
ggcaattttgacgaaacgcc

SEQ ID NO: 33336 - DNA, 19 bp, Artificial Sequence
  Synthetic
cggcaaccaaatcgtcgat

SEQ ID NO: 33337 - DNA, 21 bp, Artificial Sequence
  Synthetic
ttgttgatacggtttcccaaa

SEQ ID NO: 33338 - DNA, 19 bp, Artificial Sequence
  Synthetic
cggcatttccacaggttcg

SEQ ID NO: 33339 - DNA, 18 bp, Artificial Sequence
  Synthetic
tcaatcgtgttcaaacgc

SEQ ID NO: 33340 - DNA, 18 bp, Artificial Sequence
  Synthetic
tttcaagcgcatacaggc

SEQ ID NO: 33341 - DNA, 18 bp, Artificial Sequence
  Synthetic
tagtccattgtgcgccct

SEQ ID NO: 33342 - DNA, 21 bp, Artificial Sequence
  Synthetic
aataaataggcagcctgaaac

SEQ ID NO: 33343 - DNA, 19 bp, Artificial Sequence
  Synthetic
ttttggttagcagcacggt

SEQ ID NO: 33344 - DNA, 18 bp, Artificial Sequence
  Synthetic
aatccaagctgcctgaaa

SEQ ID NO: 33345 - DNA, 23 bp, Artificial Sequence
  Synthetic
tatgacgaacttcatcatcatgt

SEQ ID NO: 33346 - DNA, 18 bp, Artificial Sequence
  Synthetic
ttgtgtcgtgtctcatcg

SEQ ID NO: 33347 - DNA, 15 bp, Artificial Sequence
  Synthetic
aagcattgccgcccg

SEQ ID NO: 33348 - DNA, 17 bp, Artificial Sequence
  Synthetic
gtagcgcagattgccgg

SEQ ID NO: 33349 - DNA, 21 bp, Artificial Sequence
  Synthetic
ggatatggatgtccgacaatc

SEQ ID NO: 33350 - DNA, 20 bp, Artificial Sequence
  Synthetic
ctgaaacaatcgtctcaagg

SEQ ID NO: 33351 - DNA, 20 bp, Artificial Sequence
  Synthetic
gaaattgtagagcggctcca

SEQ ID NO: 33352 - DNA, 18 bp, Artificial Sequence
  Synthetic
cgcctgattcccctttcc

SEQ ID NO: 33353 - DNA, 23 bp, Artificial Sequence
  Synthetic
ggtatcaaaccgaattttttgtg

SEQ ID NO: 33354 - DNA, 20 bp, Artificial Sequence
  Synthetic
ggataggcaaaaaccggctc

SEQ ID NO: 33355 - DNA, 15 bp, Artificial Sequence
  Synthetic
catcgctgcgccgtt

SEQ ID NO: 33356 - DNA, 17 bp, Artificial Sequence
  Synthetic
tccgggtgcgttcaaac

SEQ ID NO: 33357 - DNA, 15 bp, Artificial Sequence
  Synthetic
ttcggcgcagtggca

SEQ ID NO: 33358 - DNA, 19 bp, Artificial Sequence
  Synthetic
ggtacacaattgtcccggg

SEQ ID NO: 33359 - DNA, 19 bp, Artificial Sequence
  Synthetic
cctcgtctatcagttccaa

SEQ ID NO: 33360 - DNA, 20 bp, Artificial Sequence
  Synthetic
ggtatgcagaccgtatcgtc

SEQ ID NO: 33361 - DNA, 18 bp, Artificial Sequence
  Synthetic
tttcccaaagccgcgaag

SEQ ID NO: 33362 - DNA, 20 bp, Artificial Sequence
  Synthetic
cgaagccacgaaaccgtaaa

SEQ ID NO: 33363 - DNA, 18 bp, Artificial Sequence
  Synthetic
acctttcgtatcggcggt

SEQ ID NO: 33364 - DNA, 18 bp, Artificial Sequence
  Synthetic
gcggatgattcggaggca

SEQ ID NO: 33365 - DNA, 17 bp, Artificial Sequence
  Synthetic
gttttcgcggcaatgcc

SEQ ID NO: 33366 - DNA, 17 bp, Artificial Sequence
  Synthetic
gcgtccagggtcagctt

SEQ ID NO: 33367 - DNA, 18 bp, Artificial Sequence
  Synthetic
tattttactgcgcccgcc

SEQ ID NO: 33368 - DNA, 20 bp, Artificial Sequence
  Synthetic
gactacggtgttgtcggaac

SEQ ID NO: 33369 - DNA, 16 bp, Artificial Sequence
  Synthetic
ttcttcgggcgcgagg

SEQ ID NO: 33370 - DNA, 20 bp, Artificial Sequence
  Synthetic
caacagcagtttttcggtgg

SEQ ID NO: 33371 - DNA, 17 bp, Artificial Sequence
  Synthetic
atagcggcaatgtcggc

SEQ ID NO: 33372 - DNA, 16 bp, Artificial Sequence
  Synthetic
aggtgcgcgaggtgtc

SEQ ID NO: 33373 - DNA, 17 bp, Artificial Sequence
  Synthetic
gcttgaccacggcaacc

SEQ ID NO: 33374 - DNA, 16 bp, Artificial Sequence
  Synthetic
ttccgccctgccgatt

SEQ ID NO: 33375 - DNA, 18 bp, Artificial Sequence
  Synthetic
gcggtggcttcgatgttg

SEQ ID NO: 33376 - DNA, 19 bp, Artificial Sequence
  Synthetic
cctggctgttccatcatgc

SEQ ID NO: 33377 - DNA, 16 bp, Artificial Sequence
  Synthetic
gcaggctttgacgggc

SEQ ID NO: 33378 - DNA, 17 bp, Artificial Sequence
  Synthetic
ccgcgcggaaactttga

SEQ ID NO: 33379 - DNA, 16 bp, Artificial Sequence
  Synthetic
tttcgggcaggtgcgc

SEQ ID NO: 33380 - DNA, 16 bp, Artificial Sequence
  Synthetic
ggcggcagatcgagga

SEQ ID NO: 33381 - DNA, 17 bp, Artificial Sequence
  Synthetic
cgcctcgccgaaagcat

SEQ ID NO: 33382 - DNA, 18 bp, Artificial Sequence
  Synthetic
tgaaaaccttgccgggac

SEQ ID NO: 33383 - DNA, 18 bp, Artificial Sequence
  Synthetic
cggactatacggcggacg

SEQ ID NO: 33384 - DNA, 16 bp, Artificial Sequence
  Synthetic
cggcggcttatgcgac

SEQ ID NO: 33385 - DNA, 18 bp, Artificial Sequence
  Synthetic
caggcctgaaaccgaccc

SEQ ID NO: 33386 - DNA, 17 bp, Artificial Sequence
  Synthetic
gcggacgcttggggtat

SEQ ID NO: 33387 - DNA, 16 bp, Artificial Sequence
  Synthetic
atgcggcagacgaggg

SEQ ID NO: 33388 - DNA, 15 bp, Artificial Sequence
  Synthetic
tccggcaaaagcgcg

SEQ ID NO: 33389 - DNA, 16 bp, Artificial Sequence
  Synthetic
gccggaagctggaagc

SEQ ID NO: 33390 - DNA, 17 bp, Artificial Sequence
  Synthetic
cggcttgccgtacatcg

SEQ ID NO: 33391 - DNA, 20 bp, Artificial Sequence
  Synthetic
gccgtccgtttgaaatgttc

SEQ ID NO: 33392 - DNA, 16 bp, Artificial Sequence
  Synthetic
ccgatgccgcgtcctt

SEQ ID NO: 33393 - DNA, 16 bp, Artificial Sequence
  Synthetic
acaccacggcggatgt

SEQ ID NO: 33394 - DNA, 19 bp, Artificial Sequence
  Synthetic
caagtcggcaagatggtta

SEQ ID NO: 33395 - DNA, 18 bp, Artificial Sequence
  Synthetic
aaccccttgggcgaagtg

SEQ ID NO: 33396 - DNA, 18 bp, Artificial Sequence
  Synthetic
taaacaacgggtgcacgc

SEQ ID NO: 33397 - DNA, 20 bp, Artificial Sequence
  Synthetic
ccattgcacatccataccga

SEQ ID NO: 33398 - DNA, 16 bp, Artificial Sequence
  Synthetic
ctttaccgcccggcac

SEQ ID NO: 33399 - DNA, 18 bp, Artificial Sequence
  Synthetic
cgtccaacacggtggtca

SEQ ID NO: 33400 - DNA, 17 bp, Artificial Sequence
  Synthetic
gcgatgtcggcaatgct

SEQ ID NO: 33401 - DNA, 17 bp, Artificial Sequence
  Synthetic
ggcgggtgctggtttct

SEQ ID NO: 33402 - DNA, 17 bp, Artificial Sequence
  Synthetic
cgtctgcctttacgccg

SEQ ID NO: 33403 - DNA, 16 bp, Artificial Sequence
  Synthetic
cggcggtcagctccat

SEQ ID NO: 33404 - DNA, 23 bp, Artificial Sequence
  Synthetic
gcttgaagttttaaaggagaaga

SEQ ID NO: 33405 - DNA, 20 bp, Artificial Sequence
  Synthetic
cgtgagctgggtttaaaacg

SEQ ID NO: 33406 - DNA, 20 bp, Artificial Sequence
  Synthetic
gcggcactgttttaccgtaa

SEQ ID NO: 33407 - DNA, 18 bp, Artificial Sequence
  Synthetic
cggatgatgccgtggaac

SEQ ID NO: 33408 - DNA, 19 bp, Artificial Sequence
  Synthetic
gctgtttgaggtcggggat

SEQ ID NO: 33409 - DNA, 16 bp, Artificial Sequence
  Synthetic
tcgaataccgcgccgc

SEQ ID NO: 33410 - DNA, 19 bp, Artificial Sequence
  Synthetic
cccatagacatcgcttcgc

SEQ ID NO: 33411 - DNA, 16 bp, Artificial Sequence
  Synthetic
ggaagcggccagccat

SEQ ID NO: 33412 - DNA, 18 bp, Artificial Sequence
  Synthetic
accatttggcagccgttg

SEQ ID NO: 33413 - DNA, 16 bp, Artificial Sequence
  Synthetic
ggcggtaatggcggga

SEQ ID NO: 33414 - DNA, 16 bp, Artificial Sequence
  Synthetic
atccccgcgtatgccg

SEQ ID NO: 33415 - DNA, 19 bp, Artificial Sequence
  Synthetic
cttcgtcgaaaaggtgcga

SEQ ID NO: 33416 - DNA, 16 bp, Artificial Sequence
  Synthetic
atgccgcccggaatgc

SEQ ID NO: 33417 - DNA, 18 bp, Artificial Sequence
  Synthetic
cgcgacccatggctaact

SEQ ID NO: 33418 - DNA, 16 bp, Artificial Sequence
  Synthetic
aggcggctgcggtttc

SEQ ID NO: 33419 - DNA, 17 bp, Artificial Sequence
  Synthetic
gcggggttgctgctgta

SEQ ID NO: 33420 - DNA, 20 bp, Artificial Sequence
  Synthetic
gcaaagtttgacaacgattc

SEQ ID NO: 33421 - DNA, 18 bp, Artificial Sequence
  Synthetic
gcgcgctggatttttgtc

SEQ ID NO: 33422 - DNA, 18 bp, Artificial Sequence
  Synthetic
cttcacgtttacgccgcc

SEQ ID NO: 33423 - DNA, 16 bp, Artificial Sequence
  Synthetic
cccaaatcgcgcaggc

SEQ ID NO: 33424 - DNA, 15 bp, Artificial Sequence
  Synthetic
agcgtttgccgtggc

SEQ ID NO: 33425 - DNA, 18 bp, Artificial Sequence
  Synthetic
catcgtttggccttggct

SEQ ID NO: 33426 - DNA, 16 bp, Artificial Sequence
  Synthetic
ccgtcgtcgccctgat

SEQ ID NO: 33427 - DNA, 20 bp, Artificial Sequence
  Synthetic
gctacgatgtggacagcatc

SEQ ID NO: 33428 - DNA, 18 bp, Artificial Sequence
  Synthetic
tgattatcggcggcgaag

SEQ ID NO: 33429 - DNA, 20 bp, Artificial Sequence
  Synthetic
tgaaagaacacggcgacatc

SEQ ID NO: 33430 - DNA, 16 bp, Artificial Sequence
  Synthetic
cacaacaccgccgcac

SEQ ID NO: 33431 - DNA, 19 bp, Artificial Sequence
  Synthetic
agaccgacatttcgctgtc

SEQ ID NO: 33432 - DNA, 18 bp, Artificial Sequence
  Synthetic
ggcagccaggaatgaggc

SEQ ID NO: 33433 - DNA, 19 bp, Artificial Sequence
  Synthetic
gccgctgaaacgtaccaat

SEQ ID NO: 33434 - DNA, 16 bp, Artificial Sequence
  Synthetic
acgaacagcccggcat

SEQ ID NO: 33435 - DNA, 19 bp, Artificial Sequence
  Synthetic
gccgtcggtcagtgtgaaa

SEQ ID NO: 33436 - DNA, 19 bp, Artificial Sequence
  Synthetic
tgaggatggcttgggcaat

SEQ ID NO: 33437 - DNA, 16 bp, Artificial Sequence
  Synthetic
cggatgccagttgcgc

SEQ ID NO: 33438 - DNA, 18 bp, Artificial Sequence
  Synthetic
tgaaacatacgccggtcg

SEQ ID NO: 33439 - DNA, 16 bp, Artificial Sequence
  Synthetic
gatgacgacgcggctg

SEQ ID NO: 33440 - DNA, 16 bp, Artificial Sequence
  Synthetic
aggcgcggacgagttc

SEQ ID NO: 33441 - DNA, 19 bp, Artificial Sequence
  Synthetic
gaatgactatgcggcaatt

SEQ ID NO: 33442 - DNA, 20 bp, Artificial Sequence
  Synthetic
cagataaaccgccgatggaa

SEQ ID NO: 33443 - DNA, 19 bp, Artificial Sequence
  Synthetic
gattttccggtcaggtcgg

SEQ ID NO: 33444 - DNA, 20 bp, Artificial Sequence
  Synthetic
gcgcatggcaaacaaaatgc

SEQ ID NO: 33445 - DNA, 19 bp, Artificial Sequence
  Synthetic
gaacaggtaggtcagcacg

SEQ ID NO: 33446 - DNA, 18 bp, Artificial Sequence
  Synthetic
gacgaccgcttcctgaac

SEQ ID NO: 33447 - DNA, 19 bp, Artificial Sequence
  Synthetic
gttatcccttgtccgctcc

SEQ ID NO: 33448 - DNA, 18 bp, Artificial Sequence
  Synthetic
cgagcctatgttctggct

SEQ ID NO: 33449 - DNA, 21 bp, Artificial Sequence
  Synthetic
ttctgaaaatgctgattgtca

SEQ ID NO: 33450 - DNA, 17 bp, Artificial Sequence
  Synthetic
cacggacaggaacggga

SEQ ID NO: 33451 - DNA, 20 bp, Artificial Sequence
  Synthetic
ccgaaacatgattttttgcc

SEQ ID NO: 33452 - DNA, 20 bp, Artificial Sequence
  Synthetic
ggttggtgtcttcggcaaat

SEQ ID NO: 33453 - DNA, 20 bp, Artificial Sequence
  Synthetic
ggtgtgtacggtttcttggc

SEQ ID NO: 33454 - DNA, 16 bp, Artificial Sequence
  Synthetic
ccactttggccgctgc

SEQ ID NO: 33455 - DNA, 16 bp, Artificial Sequence
  Synthetic
gccgaaccgcgatgtg

SEQ ID NO: 33456 - DNA, 18 bp, Artificial Sequence
  Synthetic
gatgacgatgcggctgac

SEQ ID NO: 33457 - DNA, 19 bp, Artificial Sequence
  Synthetic
tttgttgcctgcttttgcc

SEQ ID NO: 33458 - DNA, 16 bp, Artificial Sequence
  Synthetic
gcgctgaccacgggtt

SEQ ID NO: 33459 - DNA, 17 bp, Artificial Sequence
  Synthetic
tgcacaccgaccctgaa

SEQ ID NO: 33460 - DNA, 17 bp, Artificial Sequence
  Synthetic
gggacacaccaacaccg

SEQ ID NO: 33461 - DNA, 16 bp, Artificial Sequence
  Synthetic
accgtgtccgccgttt

SEQ ID NO: 33462 - DNA, 17 bp, Artificial Sequence
  Synthetic
ttttcagcagtccggcg

SEQ ID NO: 33463 - DNA, 20 bp, Artificial Sequence
  Synthetic
cgggttgaaagcctcatcac

SEQ ID NO: 33464 - DNA, 18 bp, Artificial Sequence
  Synthetic
ggagaaaggctcgtgcaa

SEQ ID NO: 33465 - DNA, 20 bp, Artificial Sequence
  Synthetic
tgtttcagcaaattccccca

SEQ ID NO: 33466 - DNA, 20 bp, Artificial Sequence
  Synthetic
caataccgtccggcatgatt

SEQ ID NO: 33467 - DNA, 19 bp, Artificial Sequence
  Synthetic
caagggtatggctgttcgc

SEQ ID NO: 33468 - DNA, 20 bp, Artificial Sequence
  Synthetic
cccatatatccgcaaagtca

SEQ ID NO: 33469 - DNA, 18 bp, Artificial Sequence
  Synthetic
acgaaatgccgctttggt

SEQ ID NO: 33470 - DNA, 19 bp, Artificial Sequence
  Synthetic
ccaattcgcgtgacaggat

SEQ ID NO: 33471 - DNA, 17 bp, Artificial Sequence
  Synthetic
caacggggacagaacgc

SEQ ID NO: 33472 - DNA, 18 bp, Artificial Sequence
  Synthetic
cggcaggatattggcagg

SEQ ID NO: 33473 - DNA, 18 bp, Artificial Sequence
  Synthetic
cttttgcctcgccgcttt

SEQ ID NO: 33474 - DNA, 19 bp, Artificial Sequence
  Synthetic
gccttggaatgcgtcgata

SEQ ID NO: 33475 - DNA, 16 bp, Artificial Sequence
  Synthetic
caatgcgtccgcctcg

SEQ ID NO: 33476 - DNA, 16 bp, Artificial Sequence
  Synthetic
ggatacacgcgcgcat

SEQ ID NO: 33477 - DNA, 20 bp, Artificial Sequence
  Synthetic
gcccatcatggtcaggtaca

SEQ ID NO: 33478 - DNA, 18 bp, Artificial Sequence
  Synthetic
tcgccgtcgatgactttc

SEQ ID NO: 33479 - DNA, 17 bp, Artificial Sequence
  Synthetic
gccgtacacgtcgtcca

SEQ ID NO: 33480 - DNA, 16 bp, Artificial Sequence
  Synthetic
cgcctgccgacaatgc

SEQ ID NO: 33481 - DNA, 18 bp, Artificial Sequence
  Synthetic
ccctacctgccgatggaa

SEQ ID NO: 33482 - DNA, 18 bp, Artificial Sequence
  Synthetic
gcgaagacatccgcgaaa

SEQ ID NO: 33483 - DNA, 16 bp, Artificial Sequence
  Synthetic
gcgtctattgcgcgcc

SEQ ID NO: 33484 - DNA, 18 bp, Artificial Sequence
  Synthetic
ccgtcctcaaaggcttgg

SEQ ID NO: 33485 - DNA, 20 bp, Artificial Sequence
  Synthetic
tgttggaaaaattggcgcaa

SEQ ID NO: 33486 - DNA, 18 bp, Artificial Sequence
  Synthetic
gcgtacagccgtctgaaa

SEQ ID NO: 33487 - DNA, 18 bp, Artificial Sequence
  Synthetic
ccgcaggcaaaaatcgcc

SEQ ID NO: 33488 - DNA, 17 bp, Artificial Sequence
  Synthetic
actgtatcccgccgtcg

SEQ ID NO: 33489 - DNA, 16 bp, Artificial Sequence
  Synthetic
tacacggcagcgtggc

SEQ ID NO: 33490 - DNA, 18 bp, Artificial Sequence
  Synthetic
cggaggtcgagaaagccg

SEQ ID NO: 33491 - DNA, 16 bp, Artificial Sequence
  Synthetic
gcggtgttcggcagca

SEQ ID NO: 33492 - DNA, 18 bp, Artificial Sequence
  Synthetic
cccgaggcatattggagc

SEQ ID NO: 33493 - DNA, 18 bp, Artificial Sequence
  Synthetic
ccgatgtcaggcgggaat

SEQ ID NO: 33494 - DNA, 16 bp, Artificial Sequence
  Synthetic
aggccggcgttcaaca

SEQ ID NO: 33495 - DNA, 15 bp, Artificial Sequence
  Synthetic
ttgcggcttggcgga

SEQ ID NO: 33496 - DNA, 18 bp, Artificial Sequence
  Synthetic
gctggcggcaatgtgttt

SEQ ID NO: 33497 - DNA, 19 bp, Artificial Sequence
  Synthetic
tcgagttggaaggctacga

SEQ ID NO: 33498 - DNA, 18 bp, Artificial Sequence
  Synthetic
gcctgccggtttgagttc

SEQ ID NO: 33499 - DNA, 18 bp, Artificial Sequence
  Synthetic
tgatcgagcgcaacaacc

SEQ ID NO: 33500 - DNA, 16 bp, Artificial Sequence
  Synthetic
ttcgcctgcaaccggc

SEQ ID NO: 33501 - DNA, 17 bp, Artificial Sequence
  Synthetic
ccggcggtttggaagac

SEQ ID NO: 33502 - DNA, 20 bp, Artificial Sequence
  Synthetic
tttccgcatgatggttgtct

SEQ ID NO: 33503 - DNA, 16 bp, Artificial Sequence
  Synthetic
gcagcttgcgtggagc

SEQ ID NO: 33504 - DNA, 20 bp, Artificial Sequence
  Synthetic
ccgttcaaagtcatctgcct

SEQ ID NO: 33505 - DNA, 17 bp, Artificial Sequence
  Synthetic
gggtcaaatggcaggcg

SEQ ID NO: 33506 - DNA, 18 bp, Artificial Sequence
  Synthetic
gtgaaccaaaccgccctg

SEQ ID NO: 33507 - DNA, 19 bp, Artificial Sequence
  Synthetic
ccgcttttgcacgacatgg

SEQ ID NO: 33508 - DNA, 19 bp, Artificial Sequence
  Synthetic
cgccgatgtatttgcagct

SEQ ID NO: 33509 - DNA, 18 bp, Artificial Sequence
  Synthetic
cttggtggcggaatctgc

SEQ ID NO: 33510 - DNA, 18 bp, Artificial Sequence
  Synthetic
tctgttgccggagagtcg

SEQ ID NO: 33511 - DNA, 23 bp, Artificial Sequence
  Synthetic
aaacaaatcgtcgtaataggatg

SEQ ID NO: 33512 - DNA, 18 bp, Artificial Sequence
  Synthetic
aagctcttgcaggttggg

SEQ ID NO: 33513 - DNA, 19 bp, Artificial Sequence
  Synthetic
ttcgagcgtgaacctcatg

SEQ ID NO: 33514 - DNA, 16 bp, Artificial Sequence
  Synthetic
accctgctcgccaacc

SEQ ID NO: 33515 - DNA, 19 bp, Artificial Sequence
  Synthetic
gccgccgtcaaagaaatgg

SEQ ID NO: 33516 - DNA, 18 bp, Artificial Sequence
  Synthetic
gaaagcgaacctcggcaa

SEQ ID NO: 33517 - DNA, 18 bp, Artificial Sequence
  Synthetic
tggcgttgctgttgagtt

SEQ ID NO: 33518 - DNA, 17 bp, Artificial Sequence
  Synthetic
gaggcaaggcagaaggc

SEQ ID NO: 33519 - DNA, 17 bp, Artificial Sequence
  Synthetic
cgccaaaaatccccggc

SEQ ID NO: 33520 - DNA, 20 bp, Artificial Sequence
  Synthetic
ccgtcggtattacccatcac

SEQ ID NO: 33521 - DNA, 18 bp, Artificial Sequence
  Synthetic
ttgcccagccttcatgtc

SEQ ID NO: 33522 - DNA, 16 bp, Artificial Sequence
  Synthetic
gccttcgcgtgcttcg

SEQ ID NO: 33523 - DNA, 19 bp, Artificial Sequence
  Synthetic
cggtgtacaggaacaggct

SEQ ID NO: 33524 - DNA, 18 bp, Artificial Sequence
  Synthetic
gggttttgagcgatcgcg

SEQ ID NO: 33525 - DNA, 19 bp, Artificial Sequence
  Synthetic
catcacgccacccgtcatg

SEQ ID NO: 33526 - DNA, 17 bp, Artificial Sequence
  Synthetic
tctcaacgccgccaaag

SEQ ID NO: 33527 - DNA, 20 bp, Artificial Sequence
  Synthetic
aggtgttgtttctgttgccc

SEQ ID NO: 33528 - DNA, 18 bp, Artificial Sequence
  Synthetic
gggcggacaaactcttgc

SEQ ID NO: 33529 - DNA, 19 bp, Artificial Sequence
  Synthetic
tacatctcccacaaccgcc

SEQ ID NO: 33530 - DNA, 18 bp, Artificial Sequence
  Synthetic
gcaccatccacctcctct

SEQ ID NO: 33531 - DNA, 17 bp, Artificial Sequence
  Synthetic
cccgcgtacaaaccctg

SEQ ID NO: 33532 - DNA, 15 bp, Artificial Sequence
  Synthetic
acgcaccgccgaact

SEQ ID NO: 33533 - DNA, 17 bp, Artificial Sequence
  Synthetic
gccctgtccgtcatcct

SEQ ID NO: 33534 - DNA, 19 bp, Artificial Sequence
  Synthetic
gcctcaaaccgcttccaaa

SEQ ID NO: 33535 - DNA, 16 bp, Artificial Sequence
  Synthetic
ggcgatgcaggttgcc

SEQ ID NO: 33536 - DNA, 18 bp, Artificial Sequence
  Synthetic
cttttgcaggatgcgccg

SEQ ID NO: 33537 - DNA, 19 bp, Artificial Sequence
  Synthetic
tgttgttgaggcacaccat

SEQ ID NO: 33538 - DNA, 16 bp, Artificial Sequence
  Synthetic
ttttccagcggcgcag

SEQ ID NO: 33539 - DNA, 18 bp, Artificial Sequence
  Synthetic
tcgcctggctcaactacc

SEQ ID NO: 33540 - DNA, 16 bp, Artificial Sequence
  Synthetic
tgccggtgagcgacac

SEQ ID NO: 33541 - DNA, 16 bp, Artificial Sequence
  Synthetic
tagcctacgccgtggc

SEQ ID NO: 33542 - DNA, 16 bp, Artificial Sequence
  Synthetic
agccacgcttttgccg

SEQ ID NO: 33543 - DNA, 16 bp, Artificial Sequence
  Synthetic
gtgctcctggcgcaga

SEQ ID NO: 33544 - DNA, 17 bp, Artificial Sequence
  Synthetic
gcaaagcgcaagatgcc

SEQ ID NO: 33545 - DNA, 18 bp, Artificial Sequence
  Synthetic
gaagtcttgatggcgccg

SEQ ID NO: 33546 - DNA, 16 bp, Artificial Sequence
  Synthetic
cccgcctgcgtgattg

SEQ ID NO: 33547 - DNA, 16 bp, Artificial Sequence
  Synthetic
accatcgccaagcccg

SEQ ID NO: 33548 - DNA, 15 bp, Artificial Sequence
  Synthetic
ttttgcagccgccgc

SEQ ID NO: 33549 - DNA, 16 bp, Artificial Sequence
  Synthetic
tccggagcgggtttgg

SEQ ID NO: 33550 - DNA, 19 bp, Artificial Sequence
  Synthetic
catcaggtgttggcgatgg

SEQ ID NO: 33551 - DNA, 18 bp, Artificial Sequence
  Synthetic
atatcagcaatgcccgac

SEQ ID NO: 33552 - DNA, 19 bp, Artificial Sequence
  Synthetic
aacggttacgcaaatcact

SEQ ID NO: 33553 - DNA, 19 bp, Artificial Sequence
  Synthetic
gcgcgaatacgtttttgag

SEQ ID NO: 33554 - DNA, 21 bp, Artificial Sequence
  Synthetic
gccaatgtgaatatgtccttg

SEQ ID NO: 33555 - DNA, 18 bp, Artificial Sequence
  Synthetic
aaatccaaaatgggccga

SEQ ID NO: 33556 - DNA, 18 bp, Artificial Sequence
  Synthetic
ctatccactttgggcgcg

SEQ ID NO: 33557 - DNA, 23 bp, Artificial Sequence
  Synthetic
aagtatagttttgttctccttgt

SEQ ID NO: 33558 - DNA, 19 bp, Artificial Sequence
  Synthetic
tatcgtggcaaacctatgc

SEQ ID NO: 33559 - DNA, 19 bp, Artificial Sequence
  Synthetic
ttgccacaaattgcgtaag

SEQ ID NO: 33560 - DNA, 18 bp, Artificial Sequence
  Synthetic
atacggatgcctgtatcg

SEQ ID NO: 33561 - DNA, 18 bp, Artificial Sequence
  Synthetic
cgatacaacgggttttgc

SEQ ID NO: 33562 - DNA, 19 bp, Artificial Sequence
  Synthetic
ggcactatggaatcactga

SEQ ID NO: 33563 - DNA, 21 bp, Artificial Sequence
  Synthetic
accagttcttcatcacgttta

SEQ ID NO: 33564 - DNA, 16 bp, Artificial Sequence
  Synthetic
cctcgccattgccgca

SEQ ID NO: 33565 - DNA, 16 bp, Artificial Sequence
  Synthetic
tgttgaacgccgccgc

SEQ ID NO: 33566 - DNA, 23 bp, Artificial Sequence
  Synthetic
gcctaaagaaaaggaggttaaat

SEQ ID NO: 33567 - DNA, 17 bp, Artificial Sequence
  Synthetic
tggtcatagcggcaggc

SEQ ID NO: 33568 - DNA, 15 bp, Artificial Sequence
  Synthetic
tttgagcgcggcggt

SEQ ID NO: 33569 - DNA, 18 bp, Artificial Sequence
  Synthetic
agaatttggcggcagagc

SEQ ID NO: 33570 - DNA, 19 bp, Artificial Sequence
  Synthetic
cccgcttcaatacggatgt

SEQ ID NO: 33571 - DNA, 19 bp, Artificial Sequence
  Synthetic
gctcgattcagacggcaat

SEQ ID NO: 33572 - DNA, 17 bp, Artificial Sequence
  Synthetic
tgccgccaaagaagcct

SEQ ID NO: 33573 - DNA, 17 bp, Artificial Sequence
  Synthetic
gcaaatccaagccgcct

SEQ ID NO: 33574 - DNA, 17 bp, Artificial Sequence
  Synthetic
gcggcgtattggttccg

SEQ ID NO: 33575 - DNA, 20 bp, Artificial Sequence
  Synthetic
gggaagtgatgagcgaatgc

SEQ ID NO: 33576 - DNA, 17 bp, Artificial Sequence
  Synthetic
tccgcaaagcatcctgc

SEQ ID NO: 33577 - DNA, 16 bp, Artificial Sequence
  Synthetic
gctggttcggctgcct

SEQ ID NO: 33578 - DNA, 17 bp, Artificial Sequence
  Synthetic
gcgtccagggtcagctt

SEQ ID NO: 33579 - DNA, 19 bp, Artificial Sequence
  Synthetic
cgggtattttactgcgccc

SEQ ID NO: 33580 - DNA, 19 bp, Artificial Sequence
  Synthetic
tggatgccgtctgaaggtt

SEQ ID NO: 33581 - DNA, 16 bp, Artificial Sequence
  Synthetic
tcggggtcggcggtat

SEQ ID NO: 33582 - DNA, 17 bp, Artificial Sequence
  Synthetic
gcgggccgcttttaagc

SEQ ID NO: 33583 - DNA, 20 bp, Artificial Sequence
  Synthetic
tccttgacgaactgaaagcc

SEQ ID NO: 33584 - DNA, 18 bp, Artificial Sequence
  Synthetic
accacgctatgatgggca

SEQ ID NO: 33585 - DNA, 20 bp, Artificial Sequence
  Synthetic
cgcgctgaaaatgggtttga

SEQ ID NO: 33586 - DNA, 18 bp, Artificial Sequence
  Synthetic
cgctgtacgactggcgac

SEQ ID NO: 33587 - DNA, 16 bp, Artificial Sequence
  Synthetic
tggcaggcccgagcaa

SEQ ID NO: 33588 - DNA, 16 bp, Artificial Sequence
  Synthetic
cggcaggcgggcatta

SEQ ID NO: 33589 - DNA, 16 bp, Artificial Sequence
  Synthetic
aacggcgtggctttcc

SEQ ID NO: 33590 - DNA, 18 bp, Artificial Sequence
  Synthetic
ggacggacatcaatggcg

SEQ ID NO: 33591 - DNA, 16 bp, Artificial Sequence
  Synthetic
tggcgctggaagtcgg

SEQ ID NO: 33592 - DNA, 18 bp, Artificial Sequence
  Synthetic
gctccctaccgtgtgcag

SEQ ID NO: 33593 - DNA, 16 bp, Artificial Sequence
  Synthetic
ggcatgggcaaagggc

SEQ ID NO: 33594 - DNA, 20 bp, Artificial Sequence
  Synthetic
cgtctgaaagatgcgttgga

SEQ ID NO: 33595 - DNA, 17 bp, Artificial Sequence
  Synthetic
gccttggcgttttccct

SEQ ID NO: 33596 - DNA, 17 bp, Artificial Sequence
  Synthetic
gtggtgctgcctgttcc

SEQ ID NO: 33597 - DNA, 17 bp, Artificial Sequence
  Synthetic
gtgcggccttatggtgc

SEQ ID NO: 33598 - DNA, 17 bp, Artificial Sequence
  Synthetic
gcaacggcttttggggt

SEQ ID NO: 33599 - DNA, 19 bp, Artificial Sequence
  Synthetic
ggtggtggttttggatgcc

SEQ ID NO: 33600 - DNA, 18 bp, Artificial Sequence
  Synthetic
ttgccgaagaggtcaaag

SEQ ID NO: 33601 - DNA, 20 bp, Artificial Sequence
  Synthetic
gtgtcgattggtggggaatt

SEQ ID NO: 33602 - DNA, 19 bp, Artificial Sequence
  Synthetic
ggatgttgcgaaagaggca

SEQ ID NO: 33603 - DNA, 19 bp, Artificial Sequence
  Synthetic
cgtcgtgctttataggaac

SEQ ID NO: 33604 - DNA, 20 bp, Artificial Sequence
  Synthetic
ccgcatcgatttgaccatcg

SEQ ID NO: 33605 - DNA, 18 bp, Artificial Sequence
  Synthetic
tctttcaggcgaggcaac

SEQ ID NO: 33606 - DNA, 16 bp, Artificial Sequence
  Synthetic
acaatcgcgccgacgg

SEQ ID NO: 33607 - DNA, 17 bp, Artificial Sequence
  Synthetic
cgccgaggatgagttgc

SEQ ID NO: 33608 - DNA, 19 bp, Artificial Sequence
  Synthetic
gcggtggaatcgacaatca

SEQ ID NO: 33609 - DNA, 16 bp, Artificial Sequence
  Synthetic
agtgggcttagggcgg

SEQ ID NO: 33610 - DNA, 17 bp, Artificial Sequence
  Synthetic
acggcatcggtatcggg

SEQ ID NO: 33611 - DNA, 19 bp, Artificial Sequence
  Synthetic
cgctgctcttggtagtcca

SEQ ID NO: 33612 - DNA, 18 bp, Artificial Sequence
  Synthetic
gatggtcagcgtcgtgtc

SEQ ID NO: 33613 - DNA, 16 bp, Artificial Sequence
  Synthetic
catcgcgcccgacaaa

SEQ ID NO: 33614 - DNA, 20 bp, Artificial Sequence
  Synthetic
gcaggtcgttatgattccgg

SEQ ID NO: 33615 - DNA, 16 bp, Artificial Sequence
  Synthetic
agtgttgcacggggcg

SEQ ID NO: 33616 - DNA, 19 bp, Artificial Sequence
  Synthetic
ccgctctaccttgcactgg

SEQ ID NO: 33617 - DNA, 17 bp, Artificial Sequence
  Synthetic
cgctgccggcaaattcc

SEQ ID NO: 33618 - DNA, 20 bp, Artificial Sequence
  Synthetic
ggcatacgtatttgtgcgtg

SEQ ID NO: 33619 - DNA, 16 bp, Artificial Sequence
  Synthetic
tttgggtgtcggggcg

SEQ ID NO: 33620 - DNA, 19 bp, Artificial Sequence
  Synthetic
gctgaaacttgaaaccgtc

SEQ ID NO: 33621 - DNA, 19 bp, Artificial Sequence
  Synthetic
aggttttgactgcacagca

SEQ ID NO: 33622 - DNA, 17 bp, Artificial Sequence
  Synthetic
cgtccacgcgtccatca

SEQ ID NO: 33623 - DNA, 17 bp, Artificial Sequence
  Synthetic
ggagcgttcgcctttgc

SEQ ID NO: 33624 - DNA, 18 bp, Artificial Sequence
  Synthetic
cgtgaaaccattgcgcct

SEQ ID NO: 33625 - DNA, 18 bp, Artificial Sequence
  Synthetic
ttgacctgcgtgatgtcg

SEQ ID NO: 33626 - DNA, 16 bp, Artificial Sequence
  Synthetic
gctcatcgctgccgac

SEQ ID NO: 33627 - DNA, 18 bp, Artificial Sequence
  Synthetic
gcagacgcgttgttgcac

SEQ ID NO: 33628 - DNA, 16 bp, Artificial Sequence
  Synthetic
gggcgcgtgagaacag

SEQ ID NO: 33629 - DNA, 16 bp, Artificial Sequence
  Synthetic
agggcgatggcggttt

SEQ ID NO: 33630 - DNA, 18 bp, Artificial Sequence
  Synthetic
gacggtgttgacggtgtg

SEQ ID NO: 33631 - DNA, 15 bp, Artificial Sequence
  Synthetic
tcggcatcgtcggca

SEQ ID NO: 33632 - DNA, 17 bp, Artificial Sequence
  Synthetic
gaatccaatgcgggggc

SEQ ID NO: 33633 - DNA, 16 bp, Artificial Sequence
  Synthetic
gcgcgaggcataccac

SEQ ID NO: 33634 - DNA, 18 bp, Artificial Sequence
  Synthetic
tcaatgaaggcgagcagc

SEQ ID NO: 33635 - DNA, 20 bp, Artificial Sequence
  Synthetic
gcgaacctgctttacgatgt

SEQ ID NO: 33636 - DNA, 20 bp, Artificial Sequence
  Synthetic
ggggcttcaacatcacgata

SEQ ID NO: 33637 - DNA, 18 bp, Artificial Sequence
  Synthetic
cctcaccttgccgtttgg

SEQ ID NO: 33638 - DNA, 19 bp, Artificial Sequence
  Synthetic
gcaatgctcggattctcgt

SEQ ID NO: 33639 - DNA, 19 bp, Artificial Sequence
  Synthetic
ccgcacatatacggcaacc

SEQ ID NO: 33640 - DNA, 17 bp, Artificial Sequence
  Synthetic
cacggacaggaacggga

SEQ ID NO: 33641 - DNA, 20 bp, Artificial Sequence
  Synthetic
agtttcgtcaaacccgacat

SEQ ID NO: 33642 - DNA, 18 bp, Artificial Sequence
  Synthetic
gcgccctgcagtcgttat

SEQ ID NO: 33643 - DNA, 19 bp, Artificial Sequence
  Synthetic
tccgtactcaaatcttggg

SEQ ID NO: 33644 - DNA, 18 bp, Artificial Sequence
  Synthetic
ggttgccttggttgcagg

SEQ ID NO: 33645 - DNA, 18 bp, Artificial Sequence
  Synthetic
gggctttggcttcttcgc

SEQ ID NO: 33646 - DNA, 17 bp, Artificial Sequence
  Synthetic
aggatcgaggatggcgg

SEQ ID NO: 33647 - DNA, 18 bp, Artificial Sequence
  Synthetic
ccgacagcacggttttgg

SEQ ID NO: 33648 - DNA, 19 bp, Artificial Sequence
  Synthetic
cgatttggatccggcttgg

SEQ ID NO: 33649 - DNA, 18 bp, Artificial Sequence
  Synthetic
cgtgatttcgatgggcgt

SEQ ID NO: 33650 - DNA, 17 bp, Artificial Sequence
  Synthetic
ggctcttgcgcgcaaat

SEQ ID NO: 33651 - DNA, 15 bp, Artificial Sequence
  Synthetic
ttgcgcggtgtctgc

SEQ ID NO: 33652 - DNA, 16 bp, Artificial Sequence
  Synthetic
gctctgccgtcttgcg

SEQ ID NO: 33653 - DNA, 16 bp, Artificial Sequence
  Synthetic
agccgtcagcgagtgc

SEQ ID NO: 33654 - DNA, 18 bp, Artificial Sequence
  Synthetic
gtcgagttgggctggtat

SEQ ID NO: 33655 - DNA, 16 bp, Artificial Sequence
  Synthetic
aacaaggaagccgcgc

SEQ ID NO: 33656 - DNA, 19 bp, Artificial Sequence
  Synthetic
aggaaaaaggcggcttcaa

SEQ ID NO: 33657 - DNA, 15 bp, Artificial Sequence
  Synthetic
aggtgtgccgccgtt

SEQ ID NO: 33658 - DNA, 16 bp, Artificial Sequence
  Synthetic
ccgccgtgttgtccgt

SEQ ID NO: 33659 - DNA, 22 bp, Artificial Sequence
  Synthetic
tcagtatttaggaagtggatgt

SEQ ID NO: 33660 - DNA, 20 bp, Artificial Sequence
  Synthetic
gtgtggttcttccatgcgaa

SEQ ID NO: 33661 - DNA, 16 bp, Artificial Sequence
  Synthetic
atctggcgcacggcaa

SEQ ID NO: 33662 - DNA, 16 bp, Artificial Sequence
  Synthetic
agcagcctcaccagcg

SEQ ID NO: 33663 - DNA, 19 bp, Artificial Sequence
  Synthetic
cttggttgattgccgcatc

SEQ ID NO: 33664 - DNA, 16 bp, Artificial Sequence
  Synthetic
tgagggcgagggtggt

SEQ ID NO: 33665 - DNA, 18 bp, Artificial Sequence
  Synthetic
gggcgacatcctgcattt

SEQ ID NO: 33666 - DNA, 17 bp, Artificial Sequence
  Synthetic
cgcggccgtagtcttgt

SEQ ID NO: 33667 - DNA, 22 bp, Artificial Sequence
  Synthetic
agatttcaaccaaatgaggaaa

SEQ ID NO: 33668 - DNA, 16 bp, Artificial Sequence
  Synthetic
tgggcgtgggctatgc

SEQ ID NO: 33669 - DNA, 19 bp, Artificial Sequence
  Synthetic
agttcatccacttcgcctg

SEQ ID NO: 33670 - DNA, 19 bp, Artificial Sequence
  Synthetic
gtcggattcgggtattgcc

SEQ ID NO: 33671 - DNA, 16 bp, Artificial Sequence
  Synthetic
cccaagacgcaagcgc

SEQ ID NO: 33672 - DNA, 16 bp, Artificial Sequence
  Synthetic
gcatcaccctgcccga

SEQ ID NO: 33673 - DNA, 19 bp, Artificial Sequence
  Synthetic
gaaatcgatgccgtcgtcg

SEQ ID NO: 33674 - DNA, 18 bp, Artificial Sequence
  Synthetic
aagccctgatgattgccg

SEQ ID NO: 33675 - DNA, 19 bp, Artificial Sequence
  Synthetic
ccctccaacaggacggtac

SEQ ID NO: 33676 - DNA, 16 bp, Artificial Sequence
  Synthetic
tgtgccgccgataccg

SEQ ID NO: 33677 - DNA, 18 bp, Artificial Sequence
  Synthetic
ttgcaggaagtttggcgg

SEQ ID NO: 33678 - DNA, 16 bp, Artificial Sequence
  Synthetic
aatctcggcagggcgg

SEQ ID NO: 33679 - DNA, 15 bp, Artificial Sequence
  Synthetic
tttggcggcgcgtac

SEQ ID NO: 33680 - DNA, 17 bp, Artificial Sequence
  Synthetic
ggtgtgtcggggcagta

SEQ ID NO: 33681 - DNA, 17 bp, Artificial Sequence
  Synthetic
tcatactccggctgccg

SEQ ID NO: 33682 - DNA, 16 bp, Artificial Sequence
  Synthetic
cggtcgttgacgcgga

SEQ ID NO: 33683 - DNA, 15 bp, Artificial Sequence
  Synthetic
gcttgccgcgcagtt

SEQ ID NO: 33684 - DNA, 17 bp, Artificial Sequence
  Synthetic
cgcatagggaacacgcc

SEQ ID NO: 33685 - DNA, 16 bp, Artificial Sequence
  Synthetic
gccagatgcccagtgc

SEQ ID NO: 33686 - DNA, 20 bp, Artificial Sequence
  Synthetic
cggtgtcgttcatggtttct

SEQ ID NO: 33687 - DNA, 16 bp, Artificial Sequence
  Synthetic
ggctttggcgcggtaa

SEQ ID NO: 33688 - DNA, 18 bp, Artificial Sequence
  Synthetic
tcatctttgccaacgccc

SEQ ID NO: 33689 - DNA, 19 bp, Artificial Sequence
  Synthetic
gcctattccaccgtatcgc

SEQ ID NO: 33690 - DNA, 16 bp, Artificial Sequence
  Synthetic
actgcccgaagtcgcg

SEQ ID NO: 33691 - DNA, 20 bp, Artificial Sequence
  Synthetic
gccactatccagcttttccc

SEQ ID NO: 33692 - DNA, 18 bp, Artificial Sequence
  Synthetic
tcaaggccgtatgcgtct

SEQ ID NO: 33693 - DNA, 18 bp, Artificial Sequence
  Synthetic
tttgtacggtgcggttcg

SEQ ID NO: 33694 - DNA, 17 bp, Artificial Sequence
  Synthetic
cgataccgccgcgattc

SEQ ID NO: 33695 - DNA, 19 bp, Artificial Sequence
  Synthetic
gccgtctgaaagaacacgg

SEQ ID NO: 33696 - DNA, 18 bp, Artificial Sequence
  Synthetic
tcgctaccaacaccacca

SEQ ID NO: 33697 - DNA, 16 bp, Artificial Sequence
  Synthetic
gggcaggacgacgagt

SEQ ID NO: 33698 - DNA, 18 bp, Artificial Sequence
  Synthetic
ggtgcagcaggatgtagc

SEQ ID NO: 33699 - DNA, 16 bp, Artificial Sequence
  Synthetic
ttcggggttcgcggac

SEQ ID NO: 33700 - DNA, 17 bp, Artificial Sequence
  Synthetic
gtttctgtaccggcggg

SEQ ID NO: 33701 - DNA, 16 bp, Artificial Sequence
  Synthetic
gcggtcgctcatcacg

SEQ ID NO: 33702 - DNA, 19 bp, Artificial Sequence
  Synthetic
cgcgcgtttcaaaaggtct

SEQ ID NO: 33703 - DNA, 16 bp, Artificial Sequence
  Synthetic
tgcagccgcctcttgc

SEQ ID NO: 33704 - DNA, 18 bp, Artificial Sequence
  Synthetic
gcatgggccgaagtcctc

SEQ ID NO: 33705 - DNA, 16 bp, Artificial Sequence
  Synthetic
ccaccgcctacctcgt

SEQ ID NO: 33706 - DNA, 16 bp, Artificial Sequence
  Synthetic
accgccatcgccgaag

SEQ ID NO: 33707 - DNA, 20 bp, Artificial Sequence
  Synthetic
ggacgaagtgttctttgccg

SEQ ID NO: 33708 - DNA, 20 bp, Artificial Sequence
  Synthetic
ttttcgacacgttcctgtgt

SEQ ID NO: 33709 - DNA, 17 bp, Artificial Sequence
  Synthetic
ccatttcggcggcgttt

SEQ ID NO: 33710 - DNA, 17 bp, Artificial Sequence
  Synthetic
gccggtttgcagcatgg

SEQ ID NO: 33711 - DNA, 20 bp, Artificial Sequence
  Synthetic
gcaggattcggcgaaaatgg

SEQ ID NO: 33712 - DNA, 16 bp, Artificial Sequence
  Synthetic
gggcgtgccgttcaat

SEQ ID NO: 33713 - DNA, 16 bp, Artificial Sequence
  Synthetic
tcggtgtgtcgggcgt

SEQ ID NO: 33714 - DNA, 20 bp, Artificial Sequence
  Synthetic
cggtaattgttcccgaacgt

SEQ ID NO: 33715 - DNA, 16 bp, Artificial Sequence
  Synthetic
aggtcaaccgcgtgct

SEQ ID NO: 33716 - DNA, 17 bp, Artificial Sequence
  Synthetic
ccgacagccgtattgcg

SEQ ID NO: 33717 - DNA, 16 bp, Artificial Sequence
  Synthetic
gtgcagggcggtggat

SEQ ID NO: 33718 - DNA, 20 bp, Artificial Sequence
  Synthetic
cgaggtggatgttcggaatc

SEQ ID NO: 33719 - DNA, 16 bp, Artificial Sequence
  Synthetic
atacggttcgggcggc

SEQ ID NO: 33720 - DNA, 18 bp, Artificial Sequence
  Synthetic
gcacggcggattttttcc

SEQ ID NO: 33721 - DNA, 17 bp, Artificial Sequence
  Synthetic
ggacttcgggttgtgcc

SEQ ID NO: 33722 - DNA, 17 bp, Artificial Sequence
  Synthetic
gggctgcccgtgttgaa

SEQ ID NO: 33723 - DNA, 18 bp, Artificial Sequence
  Synthetic
cggcagcttcaattcgcg

SEQ ID NO: 33724 - DNA, 18 bp, Artificial Sequence
  Synthetic
gctcgatgacttcggcag

SEQ ID NO: 33725 - DNA, 17 bp, Artificial Sequence
  Synthetic
caaggcgggtttgcagt

SEQ ID NO: 33726 - DNA, 18 bp, Artificial Sequence
  Synthetic
catcagacgggacacggg

SEQ ID NO: 33727 - DNA, 16 bp, Artificial Sequence
  Synthetic
ggccaggttgtcggca

SEQ ID NO: 33728 - DNA, 16 bp, Artificial Sequence
  Synthetic
ggtgggcgtgctgcat

SEQ ID NO: 33729 - DNA, 16 bp, Artificial Sequence
  Synthetic
gtcgatgcggatgcgg

SEQ ID NO: 33730 - DNA, 16 bp, Artificial Sequence
  Synthetic
ttggcgcaggtgttgg

SEQ ID NO: 33731 - DNA, 16 bp, Artificial Sequence
  Synthetic
ttgcggcgttcctcgg

SEQ ID NO: 33732 - DNA, 15 bp, Artificial Sequence
  Synthetic
aaccgcaccgccgat

SEQ ID NO: 33733 - DNA, 20 bp, Artificial Sequence
  Synthetic
gcagtttcgactcgtacgtc

SEQ ID NO: 33734 - DNA, 16 bp, Artificial Sequence
  Synthetic
cgggaagatgccggca

SEQ ID NO: 33735 - DNA, 16 bp, Artificial Sequence
  Synthetic
ccgccaacacgccttc

SEQ ID NO: 33736 - DNA, 18 bp, Artificial Sequence
  Synthetic
gttcaccaagcgtttgcc

SEQ ID NO: 33737 - DNA, 16 bp, Artificial Sequence
  Synthetic
gcaggttgcggactgc

SEQ ID NO: 33738 - DNA, 19 bp, Artificial Sequence
  Synthetic
ggaaaaaacatggctcgta

SEQ ID NO: 33739 - DNA, 19 bp, Artificial Sequence
  Synthetic
cgtgcaacattagatggtt

SEQ ID NO: 33740 - DNA, 18 bp, Artificial Sequence
  Synthetic
gcaacgtattggctgaaa

SEQ ID NO: 33741 - DNA, 20 bp, Artificial Sequence
  Synthetic
ccaataattcggactgtcga

SEQ ID NO: 33742 - DNA, 17 bp, Artificial Sequence
  Synthetic
gcgacgtttgccgagga

SEQ ID NO: 33743 - DNA, 20 bp, Artificial Sequence
  Synthetic
gaaggtctgaccgtattgca

SEQ ID NO: 33744 - DNA, 20 bp, Artificial Sequence
  Synthetic
cagtcggtgtgatgcactat

SEQ ID NO: 33745 - DNA, 20 bp, Artificial Sequence
  Synthetic
cgctaccactattggggacg

SEQ ID NO: 33746 - DNA, 15 bp, Artificial Sequence
  Synthetic
attgccgcgctgtcg

SEQ ID NO: 33747 - DNA, 17 bp, Artificial Sequence
  Synthetic
ggacgggcaggaaatcg

SEQ ID NO: 33748 - DNA, 17 bp, Artificial Sequence
  Synthetic
gggcaaggcgacggtat

SEQ ID NO: 33749 - DNA, 19 bp, Artificial Sequence
  Synthetic
ggcaccatattgaagcggt

SEQ ID NO: 33750 - DNA, 17 bp, Artificial Sequence
  Synthetic
ctcaaccgttcggtgcg

SEQ ID NO: 33751 - DNA, 18 bp, Artificial Sequence
  Synthetic
ccgttgagcgaatcctgc

SEQ ID NO: 33752 - DNA, 18 bp, Artificial Sequence
  Synthetic
agccgctggtgatgatgt

SEQ ID NO: 33753 - DNA, 15 bp, Artificial Sequence
  Synthetic
ttgtttcgccgccgc

SEQ ID NO: 33754 - DNA, 21 bp, Artificial Sequence
  Synthetic
gcacacaccacttacctatat

SEQ ID NO: 33755 - DNA, 16 bp, Artificial Sequence
  Synthetic
ggcgcgttcgtggaca

SEQ ID NO: 33756 - DNA, 19 bp, Artificial Sequence
  Synthetic
gcgcgagtttcccgactta

SEQ ID NO: 33757 - DNA, 20 bp, Artificial Sequence
  Synthetic
cgcgcctgattaaacaacac

SEQ ID NO: 33758 - DNA, 20 bp, Artificial Sequence
  Synthetic
gcaaatcaatgccgctatcg

SEQ ID NO: 33759 - DNA, 19 bp, Artificial Sequence
  Synthetic
gggcatttcgattgcttgg

SEQ ID NO: 33760 - DNA, 18 bp, Artificial Sequence
  Synthetic
tccaacgcgatggtttgg

SEQ ID NO: 33761 - DNA, 22 bp, Artificial Sequence
  Synthetic
cctatctaagtttttgtgtcgt

SEQ ID NO: 33762 - DNA, 18 bp, Artificial Sequence
  Synthetic
cgcaggatatggaagccg

SEQ ID NO: 33763 - DNA, 20 bp, Artificial Sequence
  Synthetic
tcagcaggttttgggagatg

SEQ ID NO: 33764 - DNA, 16 bp, Artificial Sequence
  Synthetic
cgttcgagcgactgcg

SEQ ID NO: 33765 - DNA, 16 bp, Artificial Sequence
  Synthetic
tcagccgtccggtcag

SEQ ID NO: 33766 - DNA, 19 bp, Artificial Sequence
  Synthetic
gctttggcttcgaggtagc

SEQ ID NO: 33767 - DNA, 16 bp, Artificial Sequence
  Synthetic
tttcggcgggggagtc

SEQ ID NO: 33768 - DNA, 18 bp, Artificial Sequence
  Synthetic
gccgaggttgaggttgag

SEQ ID NO: 33769 - DNA, 18 bp, Artificial Sequence
  Synthetic
ggtaccggcgatgacgat

SEQ ID NO: 33770 - DNA, 16 bp, Artificial Sequence
  Synthetic
tgggcggtgtgttcgg

SEQ ID NO: 33771 - DNA, 18 bp, Artificial Sequence
  Synthetic
gcgcggtagtagggttcg

SEQ ID NO: 33772 - DNA, 16 bp, Artificial Sequence
  Synthetic
atcgggacaaggcggc

SEQ ID NO: 33773 - DNA, 17 bp, Artificial Sequence
  Synthetic
gcctgtctcaacgcctc

SEQ ID NO: 33774 - DNA, 17 bp, Artificial Sequence
  Synthetic
acactttgctgccggca

SEQ ID NO: 33775 - DNA, 16 bp, Artificial Sequence
  Synthetic
ccggcccgttccaaac

SEQ ID NO: 33776 - DNA, 18 bp, Artificial Sequence
  Synthetic
cgactcgcatgagcatca

SEQ ID NO: 33777 - DNA, 18 bp, Artificial Sequence
  Synthetic
acgcccatgtcgtagtcg

SEQ ID NO: 33778 - DNA, 19 bp, Artificial Sequence
  Synthetic
ttggcatctttacgcgaca

SEQ ID NO: 33779 - DNA, 16 bp, Artificial Sequence
  Synthetic
cgtttcacgcggcgga

SEQ ID NO: 33780 - DNA, 18 bp, Artificial Sequence
  Synthetic
aacggctgttgtttgttc

SEQ ID NO: 33781 - DNA, 18 bp, Artificial Sequence
  Synthetic
aactattccaaccgcgtg

SEQ ID NO: 33782 - DNA, 19 bp, Artificial Sequence
  Synthetic
aacacaatccatcagcgtt

SEQ ID NO: 33783 - DNA, 20 bp, Artificial Sequence
  Synthetic
gaatgttttcagacggcatt

SEQ ID NO: 33784 - DNA, 19 bp, Artificial Sequence
  Synthetic
tggcgttattccttgggac

SEQ ID NO: 33785 - DNA, 18 bp, Artificial Sequence
  Synthetic
agcctgaaattccggcac

SEQ ID NO: 33786 - DNA, 20 bp, Artificial Sequence
  Synthetic
cgtttcggacggattaacgc

SEQ ID NO: 33787 - DNA, 17 bp, Artificial Sequence
  Synthetic
acggcgactgggatgtc

SEQ ID NO: 33788 - DNA, 16 bp, Artificial Sequence
  Synthetic
acatcggcaaagcggc

SEQ ID NO: 33789 - DNA, 17 bp, Artificial Sequence
  Synthetic
ccccgcaaacgaacagc

SEQ ID NO: 33790 - DNA, 18 bp, Artificial Sequence
  Synthetic
gcactgctgtctgtcctg

SEQ ID NO: 33791 - DNA, 19 bp, Artificial Sequence
  Synthetic
ccgaaaacggccattacct

SEQ ID NO: 33792 - DNA, 16 bp, Artificial Sequence
  Synthetic
ttctccggcggcatct

SEQ ID NO: 33793 - DNA, 20 bp, Artificial Sequence
  Synthetic
aaactgccgccatatcttgg

SEQ ID NO: 33794 - DNA, 23 bp, Artificial Sequence
  Synthetic
tggtgcaaattacaactatgatt

SEQ ID NO: 33795 - DNA, 17 bp, Artificial Sequence
  Synthetic
cgcgttgccaatgctgt

SEQ ID NO: 33796 - DNA, 19 bp, Artificial Sequence
  Synthetic
cctgatcgacgtaacccac

SEQ ID NO: 33797 - DNA, 17 bp, Artificial Sequence
  Synthetic
ccctccaaaccgaaccg

SEQ ID NO: 33798 - DNA, 16 bp, Artificial Sequence
  Synthetic
tcgaccgccgaaccac

SEQ ID NO: 33799 - DNA, 16 bp, Artificial Sequence
  Synthetic
tcatcgccctgaccgg

SEQ ID NO: 33800 - DNA, 16 bp, Artificial Sequence
  Synthetic
tcgccttcttcgccgg

SEQ ID NO: 33801 - DNA, 16 bp, Artificial Sequence
  Synthetic
ccacgcccaagttcgg

SEQ ID NO: 33802 - DNA, 18 bp, Artificial Sequence
  Synthetic
atggcgagtgcttcttcg

SEQ ID NO: 33803 - DNA, 16 bp, Artificial Sequence
  Synthetic
gcggacacggctttgg

SEQ ID NO: 33804 - DNA, 16 bp, Artificial Sequence
  Synthetic
gcatccgcgagctgac

SEQ ID NO: 33805 - DNA, 19 bp, Artificial Sequence
  Synthetic
tgatgctgatggctttggg

SEQ ID NO: 33806 - DNA, 18 bp, Artificial Sequence
  Synthetic
cgaatattgtcggccgcc

SEQ ID NO: 33807 - DNA, 18 bp, Artificial Sequence
  Synthetic
atcgaaaaccgccaaggg

SEQ ID NO: 33808 - DNA, 17 bp, Artificial Sequence
  Synthetic
gcgtccgacgaccaaat

SEQ ID NO: 33809 - DNA, 17 bp, Artificial Sequence
  Synthetic
gttttccacccacgccc

SEQ ID NO: 33810 - DNA, 17 bp, Artificial Sequence
  Synthetic
gcatcggcggcattcac

SEQ ID NO: 33811 - DNA, 20 bp, Artificial Sequence
  Synthetic
ggtttcaccgcttttgcatc

SEQ ID NO: 33812 - DNA, 18 bp, Artificial Sequence
  Synthetic
cgccgctgattatcgacg

SEQ ID NO: 33813 - DNA, 16 bp, Artificial Sequence
  Synthetic
accttgccgccatcgc

SEQ ID NO: 33814 - DNA, 16 bp, Artificial Sequence
  Synthetic
acgaatgcgcccccca

SEQ ID NO: 33815 - DNA, 16 bp, Artificial Sequence
  Synthetic
ggcaacgcccgaagtc

SEQ ID NO: 33816 - DNA, 16 bp, Artificial Sequence
  Synthetic
gtccggcacaaacgcc

SEQ ID NO: 33817 - DNA, 17 bp, Artificial Sequence
  Synthetic
gtcgggcaatgcctcct

SEQ ID NO: 33818 - DNA, 15 bp, Artificial Sequence
  Synthetic
tgttcgcggcgttcg

SEQ ID NO: 33819 - DNA, 20 bp, Artificial Sequence
  Synthetic
gtgatttcgtccagcaggat

SEQ ID NO: 33820 - DNA, 20 bp, Artificial Sequence
  Synthetic
ggtaaagttggcgaggatga

SEQ ID NO: 33821 - DNA, 18 bp, Artificial Sequence
  Synthetic
cgcggcaataatcggcaa

SEQ ID NO: 33822 - DNA, 18 bp, Artificial Sequence
  Synthetic
ggatgacggaatcgcgga

SEQ ID NO: 33823 - DNA, 16 bp, Artificial Sequence
  Synthetic
cttcggcgtgctctcg

SEQ ID NO: 33824 - DNA, 18 bp, Artificial Sequence
  Synthetic
gcgcgccataatgtaggc

SEQ ID NO: 33825 - DNA, 18 bp, Artificial Sequence
  Synthetic
gtccgacaatgcctgcat

SEQ ID NO: 33826 - DNA, 18 bp, Artificial Sequence
  Synthetic
gccgtctgaaaggcgttc

SEQ ID NO: 33827 - DNA, 20 bp, Artificial Sequence
  Synthetic
cgtactgtttgagcagctct

SEQ ID NO: 33828 - DNA, 18 bp, Artificial Sequence
  Synthetic
gttccttgccttctgcca

SEQ ID NO: 33829 - DNA, 16 bp, Artificial Sequence
  Synthetic
gcagcgtctcccttgc

SEQ ID NO: 33830 - DNA, 16 bp, Artificial Sequence
  Synthetic
ggtcggggcaggaaca

SEQ ID NO: 33831 - DNA, 19 bp, Artificial Sequence
  Synthetic
ggaaggaatcgcacgcaaa

SEQ ID NO: 33832 - DNA, 18 bp, Artificial Sequence
  Synthetic
ccttaccatgctgcttgc

SEQ ID NO: 33833 - DNA, 20 bp, Artificial Sequence
  Synthetic
gcagacgccgtttaaaatgt

SEQ ID NO: 33834 - DNA, 16 bp, Artificial Sequence
  Synthetic
ttcctccgtaccgcgc

SEQ ID NO: 33835 - DNA, 17 bp, Artificial Sequence
  Synthetic
tgggctgagcgcatcaa

SEQ ID NO: 33836 - DNA, 16 bp, Artificial Sequence
  Synthetic
agctctcggcgcgttc

SEQ ID NO: 33837 - DNA, 17 bp, Artificial Sequence
  Synthetic
ctctccctgtgggccaa

SEQ ID NO: 33838 - DNA, 18 bp, Artificial Sequence
  Synthetic
gggagctcgccaaacaag

SEQ ID NO: 33839 - DNA, 20 bp, Artificial Sequence
  Synthetic
gtcgtcgattttctgaccga

SEQ ID NO: 33840 - DNA, 15 bp, Artificial Sequence
  Synthetic
tttgcggggcgggaa

SEQ ID NO: 33841 - DNA, 19 bp, Artificial Sequence
  Synthetic
gggccgtctataccgttgt

SEQ ID NO: 33842 - DNA, 17 bp, Artificial Sequence
  Synthetic
tcaacgcgccaatcacg

SEQ ID NO: 33843 - DNA, 18 bp, Artificial Sequence
  Synthetic
ccgaccaccagcggatac

SEQ ID NO: 33844 - DNA, 23 bp, Artificial Sequence
  Synthetic
acataaaagagttgggaagaaac

SEQ ID NO: 33845 - DNA, 18 bp, Artificial Sequence
  Synthetic
cgatgagaaccccggcac

SEQ ID NO: 33846 - DNA, 16 bp, Artificial Sequence
  Synthetic
acgacaccgtcaccgc

SEQ ID NO: 33847 - DNA, 19 bp, Artificial Sequence
  Synthetic
tcggacggcatttttttgc

SEQ ID NO: 33848 - DNA, 16 bp, Artificial Sequence
  Synthetic
agccccgccttttggg

SEQ ID NO: 33849 - DNA, 16 bp, Artificial Sequence
  Synthetic
ccacggcaggcagctt

SEQ ID NO: 33850 - DNA, 16 bp, Artificial Sequence
  Synthetic
agatggcgcgggtctg

SEQ ID NO: 33851 - DNA, 20 bp, Artificial Sequence
  Synthetic
ttttcagcctgtggaacagt

SEQ ID NO: 33852 - DNA, 18 bp, Artificial Sequence
  Synthetic
gccctcgaacacgggtac

SEQ ID NO: 33853 - DNA, 17 bp, Artificial Sequence
  Synthetic
accaactcccggttcgg

SEQ ID NO: 33854 - DNA, 18 bp, Artificial Sequence
  Synthetic
caaaccgaactgcccgtc

SEQ ID NO: 33855 - DNA, 16 bp, Artificial Sequence
  Synthetic
tcatctgcggcggcac

SEQ ID NO: 33856 - DNA, 18 bp, Artificial Sequence
  Synthetic
cctgctcacctacgccta

SEQ ID NO: 33857 - DNA, 19 bp, Artificial Sequence
  Synthetic
tgcattttcgccaacatcg

SEQ ID NO: 33858 - DNA, 18 bp, Artificial Sequence
  Synthetic
cgtggatgatgcccgaag

SEQ ID NO: 33859 - DNA, 16 bp, Artificial Sequence
  Synthetic
gcgcgactggatgacg

SEQ ID NO: 33860 - DNA, 18 bp, Artificial Sequence
  Synthetic
cgttatgggcgtatgcgg

SEQ ID NO: 33861 - DNA, 16 bp, Artificial Sequence
  Synthetic
gcaaacgcggcgaaag

SEQ ID NO: 33862 - DNA, 17 bp, Artificial Sequence
  Synthetic
gcgaacatcggccaggt

SEQ ID NO: 33863 - DNA, 19 bp, Artificial Sequence
  Synthetic
cttcgatgccggactgatc

SEQ ID NO: 33864 - DNA, 16 bp, Artificial Sequence
  Synthetic
tcgcccacacacgtcg

SEQ ID NO: 33865 - DNA, 16 bp, Artificial Sequence
  Synthetic
ccgccgccataccttg

SEQ ID NO: 33866 - DNA, 19 bp, Artificial Sequence
  Synthetic
ggtaaaagtaggcggaacc

SEQ ID NO: 33867 - DNA, 18 bp, Artificial Sequence
  Synthetic
agggcgacttttcaagcg

SEQ ID NO: 33868 - DNA, 16 bp, Artificial Sequence
  Synthetic
ggcggctttgccccaa

SEQ ID NO: 33869 - DNA, 15 bp, Artificial Sequence
  Synthetic
atttggcagccgcgc

SEQ ID NO: 33870 - DNA, 18 bp, Artificial Sequence
  Synthetic
cttcggggatttcggcaa

SEQ ID NO: 33871 - DNA, 16 bp, Artificial Sequence
  Synthetic
cacgttccaccagccg

SEQ ID NO: 33872 - DNA, 20 bp, Artificial Sequence
  Synthetic
gcatatagccgagcatcacg

SEQ ID NO: 33873 - DNA, 16 bp, Artificial Sequence
  Synthetic
tttcggcgggctgcac

SEQ ID NO: 33874 - DNA, 17 bp, Artificial Sequence
  Synthetic
gggcgagacgttttcgg

SEQ ID NO: 33875 - DNA, 18 bp, Artificial Sequence
  Synthetic
aaacaccttcgacgacgg

SEQ ID NO: 33876 - DNA, 16 bp, Artificial Sequence
  Synthetic
cgcaacgccgtttgga

SEQ ID NO: 33877 - DNA, 17 bp, Artificial Sequence
  Synthetic
gcagcagcgcgaaagac

SEQ ID NO: 33878 - DNA, 17 bp, Artificial Sequence
  Synthetic
gacaaggcggggaaacg

SEQ ID NO: 33879 - DNA, 17 bp, Artificial Sequence
  Synthetic
cgctcgaaaccgaagcg

SEQ ID NO: 33880 - DNA, 17 bp, Artificial Sequence
  Synthetic
cagacggcaccatcagc

SEQ ID NO: 33881 - DNA, 18 bp, Artificial Sequence
  Synthetic
aacattgccctgcactgg

SEQ ID NO: 33882 - DNA, 17 bp, Artificial Sequence
  Synthetic
gccgcgatgaaaggcgt

SEQ ID NO: 33883 - DNA, 19 bp, Artificial Sequence
  Synthetic
catcagggtgatgtcggct

SEQ ID NO: 33884 - DNA, 17 bp, Artificial Sequence
  Synthetic
gcctgccagtgcttcga

SEQ ID NO: 33885 - DNA, 19 bp, Artificial Sequence
  Synthetic
cctccatactccggacgac

SEQ ID NO: 33886 - DNA, 18 bp, Artificial Sequence
  Synthetic
gcgaaaatgcgccgtcag

SEQ ID NO: 33887 - DNA, 18 bp, Artificial Sequence
  Synthetic
catccggcttgttggacg

SEQ ID NO: 33888 - DNA, 16 bp, Artificial Sequence
  Synthetic
agtttccgcgccaacg

SEQ ID NO: 33889 - DNA, 16 bp, Artificial Sequence
  Synthetic
tgcctctgtcgcgcac

SEQ ID NO: 33890 - DNA, 19 bp, Artificial Sequence
  Synthetic
ggcttccaaaacaacaggc

SEQ ID NO: 33891 - DNA, 20 bp, Artificial Sequence
  Synthetic
ccaaaccgtactgcatcagc

SEQ ID NO: 33892 - DNA, 17 bp, Artificial Sequence
  Synthetic
ggcagcgtacagggctt

SEQ ID NO: 33893 - DNA, 19 bp, Artificial Sequence
  Synthetic
ctctgtgaaacgttccgca

SEQ ID NO: 33894 - DNA, 20 bp, Artificial Sequence
  Synthetic
ccccgaatattgttcccaca

SEQ ID NO: 33895 - DNA, 16 bp, Artificial Sequence
  Synthetic
gctatgccggctgctg

SEQ ID NO: 33896 - DNA, 17 bp, Artificial Sequence
  Synthetic
ctatggcgcgcgaagtc

SEQ ID NO: 33897 - DNA, 17 bp, Artificial Sequence
  Synthetic
gcctgatcgacgcatcc

SEQ ID NO: 33898 - DNA, 18 bp, Artificial Sequence
  Synthetic
ggcattcatcgtcgcgat

SEQ ID NO: 33899 - DNA, 19 bp, Artificial Sequence
  Synthetic
caaaatccgcatcgttgcc

SEQ ID NO: 33900 - DNA, 19 bp, Artificial Sequence
  Synthetic
gtcgaagccgtcaacttca

SEQ ID NO: 33901 - DNA, 19 bp, Artificial Sequence
  Synthetic
gccgcctcaggatttcgtc

SEQ ID NO: 33902 - DNA, 18 bp, Artificial Sequence
  Synthetic
acacaatgatgctccgat

SEQ ID NO: 33903 - DNA, 18 bp, Artificial Sequence
  Synthetic
aagacgctggaaagcttg

SEQ ID NO: 33904 - DNA, 21 bp, Artificial Sequence
  Synthetic
ccattttcatcttcctgtgta

SEQ ID NO: 33905 - DNA, 25 bp, Artificial Sequence
  Synthetic
gactcttctactttcttattgtcat

SEQ ID NO: 33906 - DNA, 19 bp, Artificial Sequence
  Synthetic
acagtttttagggggagag

SEQ ID NO: 33907 - DNA, 18 bp, Artificial Sequence
  Synthetic
gtttctctgtggtcccag

SEQ ID NO: 33908 - DNA, 18 bp, Artificial Sequence
  Synthetic
aggttaacagcatcctgc

SEQ ID NO: 33909 - DNA, 25 bp, Artificial Sequence
  Synthetic
tagtagatgttacactaggatgttc

SEQ ID NO: 33910 - DNA, 20 bp, Artificial Sequence
  Synthetic
cgtttgtgacatcagtctct

SEQ ID NO: 33911 - DNA, 22 bp, Artificial Sequence
  Synthetic
tggaataataatttgggtggtg

SEQ ID NO: 33912 - DNA, 22 bp, Artificial Sequence
  Synthetic
aggattttctgtatcttgcaaa

SEQ ID NO: 33913 - DNA, 23 bp, Artificial Sequence
  Synthetic
gaattttcctatactgttgtgtg

SEQ ID NO: 33914 - DNA, 22 bp, Artificial Sequence
  Synthetic
acacatagttgctaaagacttt

SEQ ID NO: 33915 - DNA, 24 bp, Artificial Sequence
  Synthetic
acttatataagagtaagggtggag

SEQ ID NO: 33916 - DNA, 18 bp, Artificial Sequence
  Synthetic
cgccttgctcattgatga

SEQ ID NO: 33917 - DNA, 19 bp, Artificial Sequence
  Synthetic
cttccccagtgaatgagaa

SEQ ID NO: 33918 - DNA, 21 bp, Artificial Sequence
  Synthetic
cttgatcgcatcatatagtgg

SEQ ID NO: 33919 - DNA, 22 bp, Artificial Sequence
  Synthetic
tcatattgcttcaaatcgctta

SEQ ID NO: 33920 - DNA, 21 bp, Artificial Sequence
  Synthetic
gcattaagcaaggcagtatta

SEQ ID NO: 33921 - DNA, 24 bp, Artificial Sequence
  Synthetic
cttagtagcatatctcctatctca

SEQ ID NO: 33922 - DNA, 22 bp, Artificial Sequence
  Synthetic
tattgaataccgacttggctaa

SEQ ID NO: 33923 - DNA, 18 bp, Artificial Sequence
  Synthetic
ctcactcgtcccctctcg

SEQ ID NO: 33924 - DNA, 16 bp, Artificial Sequence
  Synthetic
gcggaccctgcagagt

SEQ ID NO: 33925 - DNA, 18 bp, Artificial Sequence
  Synthetic
ttccactcgcaggtttgc

SEQ ID NO: 33926 - DNA, 20 bp, Artificial Sequence
  Synthetic
aggaagacgagagaagggaa

SEQ ID NO: 33927 - DNA, 20 bp, Artificial Sequence
  Synthetic
ggctgggaaacatcaaagga

SEQ ID NO: 33928 - DNA, 20 bp, Artificial Sequence
  Synthetic
ccattgtaaggtttccttgc

SEQ ID NO: 33929 - DNA, 19 bp, Artificial Sequence
  Synthetic
gtacacaaccctttccact

SEQ ID NO: 33930 - DNA, 21 bp, Artificial Sequence
  Synthetic
gcttcaattctgtaacacact

SEQ ID NO: 33931 - DNA, 25 bp, Artificial Sequence
  Synthetic
atcatctataaatcctattaggtcc

SEQ ID NO: 33932 - DNA, 22 bp, Artificial Sequence
  Synthetic
gcctgtgaattatttacttggt

SEQ ID NO: 33933 - DNA, 25 bp, Artificial Sequence
  Synthetic
cagttaatttattactgtccagttc

SEQ ID NO: 33934 - DNA, 19 bp, Artificial Sequence
  Synthetic
tgttaccgttgttccttct

SEQ ID NO: 33935 - DNA, 20 bp, Artificial Sequence
  Synthetic
ttcaggacaacagattacct

SEQ ID NO: 33936 - DNA, 18 bp, Artificial Sequence
  Synthetic
tactcgtgtcccttcccg

SEQ ID NO: 33937 - DNA, 22 bp, Artificial Sequence
  Synthetic
acttgttacatgtacagtacca

SEQ ID NO: 33938 - DNA, 21 bp, Artificial Sequence
  Synthetic
atgtactgtagctccaatttg

SEQ ID NO: 33939 - DNA, 18 bp, Artificial Sequence
  Synthetic
gaggtggataaaggcaca

SEQ ID NO: 33940 - DNA, 21 bp, Artificial Sequence
  Synthetic
cgagttacatattcatccgtg

SEQ ID NO: 33941 - DNA, 19 bp, Artificial Sequence
  Synthetic
taatggctgtcctctacca

SEQ ID NO: 33942 - DNA, 22 bp, Artificial Sequence
  Synthetic
agtaaaatccatagctccaaag

SEQ ID NO: 33943 - DNA, 18 bp, Artificial Sequence
  Synthetic
gccactaggtgtagcaga

SEQ ID NO: 33944 - DNA, 22 bp, Artificial Sequence
  Synthetic
caagtatgcatacaaacaggaa

SEQ ID NO: 33945 - DNA, 18 bp, Artificial Sequence
  Synthetic
acccatgaacgcccatca

SEQ ID NO: 33946 - DNA, 18 bp, Artificial Sequence
  Synthetic
tgttcttgcgcgttctgg

SEQ ID NO: 33947 - DNA, 20 bp, Artificial Sequence
  Synthetic
tttgtgtctgggtcagtgac

SEQ ID NO: 33948 - DNA, 18 bp, Artificial Sequence
  Synthetic
caccaatgtcaagggcgt

SEQ ID NO: 33949 - DNA, 18 bp, Artificial Sequence
  Synthetic
cgttccacactgcatcag

SEQ ID NO: 33950 - DNA, 23 bp, Artificial Sequence
  Synthetic
taagacctgataatttttccagg

SEQ ID NO: 33951 - DNA, 19 bp, Artificial Sequence
  Synthetic
agcacagcgaggtaacaag

SEQ ID NO: 33952 - DNA, 23 bp, Artificial Sequence
  Synthetic
aagtgcttatagaaaaacacacc

SEQ ID NO: 33953 - DNA, 17 bp, Artificial Sequence
  Synthetic
ctgccatcgctgacagc

SEQ ID NO: 33954 - DNA, 20 bp, Artificial Sequence
  Synthetic
gcacacacaccaataagggt

SEQ ID NO: 33955 - DNA, 23 bp, Artificial Sequence
  Synthetic
gtacatttgccattaaaatagca

SEQ ID NO: 33956 - DNA, 21 bp, Artificial Sequence
  Synthetic
gttttttggtagcctcaaaga

SEQ ID NO: 33957 - DNA, 23 bp, Artificial Sequence
  Synthetic
aacaaaacataattgtcagcagt

SEQ ID NO: 33958 - DNA, 19 bp, Artificial Sequence
  Synthetic
aaacacgcatgatgcaaag

SEQ ID NO: 33959 - DNA, 19 bp, Artificial Sequence
  Synthetic
ctgttgggccagtgatctg

SEQ ID NO: 33960 - DNA, 21 bp, Artificial Sequence
  Synthetic
acagacatttggagaggatac

SEQ ID NO: 33961 - DNA, 18 bp, Artificial Sequence
  Synthetic
tccgcctgtttcggtcat

SEQ ID NO: 33962 - DNA, 25 bp, Artificial Sequence
  Synthetic
gaggttgtctattaatagtgacttt

SEQ ID NO: 33963 - DNA, 18 bp, Artificial Sequence
  Synthetic
ttctggggggtcttcacg

SEQ ID NO: 33964 - DNA, 19 bp, Artificial Sequence
  Synthetic
cggccatcataagcgatca

SEQ ID NO: 33965 - DNA, 19 bp, Artificial Sequence
  Synthetic
tttgggttgaggcacacaa

SEQ ID NO: 33966 - DNA, 19 bp, Artificial Sequence
  Synthetic
gggcatggtcatgtctgtt

SEQ ID NO: 33967 - DNA, 21 bp, Artificial Sequence
  Synthetic
caaaaacaatgacagccaaat

SEQ ID NO: 33968 - DNA, 18 bp, Artificial Sequence
  Synthetic
gcttcccacacagccagg

SEQ ID NO: 33969 - DNA, 18 bp, Artificial Sequence
  Synthetic
ctatggtggtgttggtca

SEQ ID NO: 33970 - DNA, 20 bp, Artificial Sequence
  Synthetic
tcatttgaatgcacgttgtt

SEQ ID NO: 33971 - DNA, 22 bp, Artificial Sequence
  Synthetic
ggatttttttggaccatgaaac

SEQ ID NO: 33972 - DNA, 23 bp, Artificial Sequence
  Synthetic
tggaaacaatgctataatccttt

SEQ ID NO: 33973 - DNA, 22 bp, Artificial Sequence
  Synthetic
tgcctatttatctgcaatttgg

SEQ ID NO: 33974 - DNA, 22 bp, Artificial Sequence
  Synthetic
ttgaggcaatactaattcttgt

SEQ ID NO: 33975 - DNA, 22 bp, Artificial Sequence
  Synthetic
agtttcaaattgttcagtacct

SEQ ID NO: 33976 - DNA, 23 bp, Artificial Sequence
  Synthetic
gggcttttaatatactttcgttt

SEQ ID NO: 33977 - DNA, 23 bp, Artificial Sequence
  Synthetic
gaaaagctcacaccatataattc

SEQ ID NO: 33978 - DNA, 19 bp, Artificial Sequence
  Synthetic
acaggttgcctatgcttta

SEQ ID NO: 33979 - DNA, 18 bp, Artificial Sequence
  Synthetic
aggttagacgctggggac

SEQ ID NO: 33980 - DNA, 23 bp, Artificial Sequence
  Synthetic
tgtttatttctatttctccagca

SEQ ID NO: 33981 - DNA, 18 bp, Artificial Sequence
  Synthetic
taggtctgcttggtctgc

SEQ ID NO: 33982 - DNA, 21 bp, Artificial Sequence
  Synthetic
tggtactaatctttcctctgg

SEQ ID NO: 33983 - DNA, 18 bp, Artificial Sequence
  Synthetic
ccatagctggttcgcaac

SEQ ID NO: 33984 - DNA, 22 bp, Artificial Sequence
  Synthetic
caaaataatgtctggcataggc

SEQ ID NO: 33985 - DNA, 19 bp, Artificial Sequence
  Synthetic
taccactcccggtacaaag

SEQ ID NO: 33986 - DNA, 22 bp, Artificial Sequence
  Synthetic
tggattctttggtaggaactag

SEQ ID NO: 33987 - DNA, 18 bp, Artificial Sequence
  Synthetic
gttgtcacgcttgttgtt

SEQ ID NO: 33988 - DNA, 19 bp, Artificial Sequence
  Synthetic
ccacctttttcagtctgac

SEQ ID NO: 33989 - DNA, 25 bp, Artificial Sequence
  Synthetic
gactatattattcaccttggatgtt

SEQ ID NO: 33990 - DNA, 23 bp, Artificial Sequence
  Synthetic
actgatcatcacatttatggtat

SEQ ID NO: 33991 - DNA, 17 bp, Artificial Sequence
  Synthetic
ggcctttcgcgacccaa

SEQ ID NO: 33992 - DNA, 17 bp, Artificial Sequence
  Synthetic
tgggaataggctggcgc

SEQ ID NO: 33993 - DNA, 16 bp, Artificial Sequence
  Synthetic
ccacacgcgtctccga

SEQ ID NO: 33994 - DNA, 18 bp, Artificial Sequence
  Synthetic
gccagctcccgttggtat

SEQ ID NO: 33995 - DNA, 20 bp, Artificial Sequence
  Synthetic
tgggctaggtgtgaaacagt

SEQ ID NO: 33996 - DNA, 18 bp, Artificial Sequence
  Synthetic
tagtgcaccaaacaccgg

SEQ ID NO: 33997 - DNA, 18 bp, Artificial Sequence
  Synthetic
gacgatgctggagctcag

SEQ ID NO: 33998 - DNA, 17 bp, Artificial Sequence
  Synthetic
ttgagtccagggccagg

SEQ ID NO: 33999 - DNA, 19 bp, Artificial Sequence
  Synthetic
gttgcagcaggtacaaggg

SEQ ID NO: 34000 - DNA, 18 bp, Artificial Sequence
  Synthetic
aggaaaatttcgcggccc

SEQ ID NO: 34001 - DNA, 18 bp, Artificial Sequence
  Synthetic
gagcgaaccctttccagg

SEQ ID NO: 34002 - DNA, 18 bp, Artificial Sequence
  Synthetic
aacacaggtgagcgcatc

SEQ ID NO: 34003 - DNA, 16 bp, Artificial Sequence
  Synthetic
acgtcatacgcgccgc

SEQ ID NO: 34004 - DNA, 18 bp, Artificial Sequence
  Synthetic
aagtcgccggtaaaaccc

SEQ ID NO: 34005 - DNA, 18 bp, Artificial Sequence
  Synthetic
cataccatgcacacccgg

SEQ ID NO: 34006 - DNA, 20 bp, Artificial Sequence
  Synthetic
gtgctggtaatgacctccaa

SEQ ID NO: 34007 - DNA, 18 bp, Artificial Sequence
  Synthetic
ccgatgttaccgactgcg

SEQ ID NO: 34008 - DNA, 16 bp, Artificial Sequence
  Synthetic
ccgtctcgggcacgta

SEQ ID NO: 34009 - DNA, 20 bp, Artificial Sequence
  Synthetic
ggttccgttcttcacgtgac

SEQ ID NO: 34010 - DNA, 18 bp, Artificial Sequence
  Synthetic
ccacgtaggagtgcaacc

SEQ ID NO: 34011 - DNA, 19 bp, Artificial Sequence
  Synthetic
ctcgcgtgatattgcctcc

SEQ ID NO: 34012 - DNA, 16 bp, Artificial Sequence
  Synthetic
tgaacctggcgtccgc

SEQ ID NO: 34013 - DNA, 20 bp, Artificial Sequence
  Synthetic
cgagaggaggtggagtacac

SEQ ID NO: 34014 - DNA, 19 bp, Artificial Sequence
  Synthetic
gctccactgcgaacacttc

SEQ ID NO: 34015 - DNA, 19 bp, Artificial Sequence
  Synthetic
gtcataagctggaaccggg

SEQ ID NO: 34016 - DNA, 19 bp, Artificial Sequence
  Synthetic
gcgctaagtccatggagtc

SEQ ID NO: 34017 - DNA, 16 bp, Artificial Sequence
  Synthetic
aatgtcccccccgcca

SEQ ID NO: 34018 - DNA, 19 bp, Artificial Sequence
  Synthetic
ggacgaaacctaggtatgc

SEQ ID NO: 34019 - DNA, 19 bp, Artificial Sequence
  Synthetic
accagctcaacgaccttgt

SEQ ID NO: 34020 - DNA, 21 bp, Artificial Sequence
  Synthetic
tgcatattgttacactcctgt

SEQ ID NO: 34021 - DNA, 22 bp, Artificial Sequence
  Synthetic
ttcaaatgaaaatcgccaacaa

SEQ ID NO: 34022 - DNA, 20 bp, Artificial Sequence
  Synthetic
gcaaatcaggaattgagtgg

SEQ ID NO: 34023 - DNA, 20 bp, Artificial Sequence
  Synthetic
cgcctcaatccattcaaaga

SEQ ID NO: 34024 - DNA, 21 bp, Artificial Sequence
  Synthetic
gttacttcttttggtgcctta

SEQ ID NO: 34025 - DNA, 19 bp, Artificial Sequence
  Synthetic
ccttgaacttcccaaacag

SEQ ID NO: 34026 - DNA, 19 bp, Artificial Sequence
  Synthetic
cgaactgtttcagctgagg

SEQ ID NO: 34027 - DNA, 25 bp, Artificial Sequence
  Synthetic
ccatttagcttaatgtaatcatcac

SEQ ID NO: 34028 - DNA, 22 bp, Artificial Sequence
  Synthetic
ggcttcaggttatcaagataat

SEQ ID NO: 34029 - DNA, 20 bp, Artificial Sequence
  Synthetic
gcactttcttcaaagctctt

SEQ ID NO: 34030 - DNA, 19 bp, Artificial Sequence
  Synthetic
aaagaagaatcggacacca

SEQ ID NO: 34031 - DNA, 19 bp, Artificial Sequence
  Synthetic
cctaactctgtacgctgtc

SEQ ID NO: 34032 - DNA, 21 bp, Artificial Sequence
  Synthetic
tcagcccatttaattgaagtt

SEQ ID NO: 34033 - DNA, 18 bp, Artificial Sequence
  Synthetic
tgtgtagcatcacgacca

SEQ ID NO: 34034 - DNA, 25 bp, Artificial Sequence
  Synthetic
ctctgtatagtaagcattatccttt

SEQ ID NO: 34035 - DNA, 19 bp, Artificial Sequence
  Synthetic
gttgtcttggttgtagcct

SEQ ID NO: 34036 - DNA, 21 bp, Artificial Sequence
  Synthetic
gctagtgaaagctcattaggt

SEQ ID NO: 34037 - DNA, 23 bp, Artificial Sequence
  Synthetic
cctaaaattgtcaagtctagctt

SEQ ID NO: 34038 - DNA, 18 bp, Artificial Sequence
  Synthetic
ttgtacactcaacgcgtg

SEQ ID NO: 34039 - DNA, 20 bp, Artificial Sequence
  Synthetic
aattgacaaaatgggagagc

SEQ ID NO: 34040 - DNA, 18 bp, Artificial Sequence
  Synthetic
caacaacaccttgtcggg

SEQ ID NO: 34041 - DNA, 22 bp, Artificial Sequence
  Synthetic
agtagttatgacattgacaacc

SEQ ID NO: 34042 - DNA, 22 bp, Artificial Sequence
  Synthetic
ctatgaaaccaatctctcttgt

SEQ ID NO: 34043 - DNA, 20 bp, Artificial Sequence
  Synthetic
actcagcatcaaaagttgtt

SEQ ID NO: 34044 - DNA, 18 bp, Artificial Sequence
  Synthetic
agcagcaacaacatggtt

SEQ ID NO: 34045 - DNA, 20 bp, Artificial Sequence
  Synthetic
agctggtagtatctaaggct

SEQ ID NO: 34046 - DNA, 21 bp, Artificial Sequence
  Synthetic
ccacaatccattaagagttgt

SEQ ID NO: 34047 - DNA, 21 bp, Artificial Sequence
  Synthetic
ggtatgattaggtctcatggc

SEQ ID NO: 34048 - DNA, 18 bp, Artificial Sequence
  Synthetic
taccattctgcagcagct

SEQ ID NO: 34049 - DNA, 20 bp, Artificial Sequence
  Synthetic
gaatgcgtgcttatgcttaa

SEQ ID NO: 34050 - DNA, 24 bp, Artificial Sequence
  Synthetic
cctaagaaacaataaacaagcatg

SEQ ID NO: 34051 - DNA, 18 bp, Artificial Sequence
  Synthetic
ttgaagaaccgagagcag

SEQ ID NO: 34052 - DNA, 18 bp, Artificial Sequence
  Synthetic
ctacagcctgctcatagg

SEQ ID NO: 34053 - DNA, 18 bp, Artificial Sequence
  Synthetic
tggaacacaaccatcacg

SEQ ID NO: 34054 - DNA, 19 bp, Artificial Sequence
  Synthetic
cacaaacctacctcccttc

SEQ ID NO: 34055 - DNA, 19 bp, Artificial Sequence
  Synthetic
attggttgtcctccacttg

SEQ ID NO: 34056 - DNA, 21 bp, Artificial Sequence
  Synthetic
ttaaaaacgttgatgcatccg

SEQ ID NO: 34057 - DNA, 20 bp, Artificial Sequence
  Synthetic
gcaattgtatgtgacgagta

SEQ ID NO: 34058 - DNA, 23 bp, Artificial Sequence
  Synthetic
cagcaatgagtaatatgaatcca

SEQ ID NO: 34059 - DNA, 21 bp, Artificial Sequence
  Synthetic
cgaaaatggtatccagttgaa

SEQ ID NO: 34060 - DNA, 18 bp, Artificial Sequence
  Synthetic
tgccatcctgagcaaaga

SEQ ID NO: 34061 - DNA, 24 bp, Artificial Sequence
  Synthetic
gtttttaacatattatgccagcca

SEQ ID NO: 34062 - DNA, 18 bp, Artificial Sequence
  Synthetic
cagttgtagcatcaccgg

SEQ ID NO: 34063 - DNA, 20 bp, Artificial Sequence
  Synthetic
gcctcagacatgaacacatt

SEQ ID NO: 34064 - DNA, 18 bp, Artificial Sequence
  Synthetic
ctcaggttcccagtaccg

SEQ ID NO: 34065 - DNA, 19 bp, Artificial Sequence
  Synthetic
tgggaggcttatgtgactt

SEQ ID NO: 34066 - DNA, 20 bp, Artificial Sequence
  Synthetic
aatggtggtctaggttttcc

SEQ ID NO: 34067 - DNA, 18 bp, Artificial Sequence
  Synthetic
tccgatggcaaaatgact

SEQ ID NO: 34068 - DNA, 24 bp, Artificial Sequence
  Synthetic
gcacactgaattaaaatattctgg

SEQ ID NO: 34069 - DNA, 21 bp, Artificial Sequence
  Synthetic
gcgttctgtgaattataaggt

SEQ ID NO: 34070 - DNA, 18 bp, Artificial Sequence
  Synthetic
gtgtaggtgcctgtgtag

SEQ ID NO: 34071 - DNA, 20 bp, Artificial Sequence
  Synthetic
cagtcggtacagctactaag

SEQ ID NO: 34072 - DNA, 20 bp, Artificial Sequence
  Synthetic
cagcaggcataagtatctga

SEQ ID NO: 34073 - DNA, 19 bp, Artificial Sequence
  Synthetic
tgagcatcgtagaacttcc

SEQ ID NO: 34074 - DNA, 21 bp, Artificial Sequence
  Synthetic
gactcacaaggactatcagaa

SEQ ID NO: 34075 - DNA, 21 bp, Artificial Sequence
  Synthetic
atctccacatcaataccatct

SEQ ID NO: 34076 - DNA, 20 bp, Artificial Sequence
  Synthetic
agacctttgactgaaccttc

SEQ ID NO: 34077 - DNA, 18 bp, Artificial Sequence
  Synthetic
aatcttgtgagcgcttgg

SEQ ID NO: 34078 - DNA, 22 bp, Artificial Sequence
  Synthetic
cacacttttcaagaagcattct

SEQ ID NO: 34079 - DNA, 21 bp, Artificial Sequence
  Synthetic
tcttttgtcacatgtttggtc

SEQ ID NO: 34080 - DNA, 20 bp, Artificial Sequence
  Synthetic
gctcatgtcaaagagtgaat

SEQ ID NO: 34081 - DNA, 25 bp, Artificial Sequence
  Synthetic
ccttataaacatagagaaacccatc

SEQ ID NO: 34082 - DNA, 21 bp, Artificial Sequence
  Synthetic
tttgtcaatctcaaagctctt

SEQ ID NO: 34083 - DNA, 21 bp, Artificial Sequence
  Synthetic
ccatgaaatcatctggcaatt

SEQ ID NO: 34084 - DNA, 21 bp, Artificial Sequence
  Synthetic
gtggataattttggtccacaa

SEQ ID NO: 34085 - DNA, 22 bp, Artificial Sequence
  Synthetic
tgagtctggaatacattgtttc

SEQ ID NO: 34086 - DNA, 21 bp, Artificial Sequence
  Synthetic
agaagcaaattagcacattca

SEQ ID NO: 34087 - DNA, 18 bp, Artificial Sequence
  Synthetic
cagtgtaggcagcaatca

SEQ ID NO: 34088 - DNA, 23 bp, Artificial Sequence
  Synthetic
acttgaaattgcaccaaaattag

SEQ ID NO: 34089 - DNA, 22 bp, Artificial Sequence
  Synthetic
taataaaccaagaagtgccatt

SEQ ID NO: 34090 - DNA, 23 bp, Artificial Sequence
  Synthetic
ttaaatttttagcgacctcattg

SEQ ID NO: 34091 - DNA, 23 bp, Artificial Sequence
  Synthetic
atccataagttcgtttatgtgta

SEQ ID NO: 34092 - DNA, 19 bp, Artificial Sequence
  Synthetic
attctacatgcgttgatgc

SEQ ID NO: 34093 - DNA, 22 bp, Artificial Sequence
  Synthetic
acaagcttgttaaagatgaaga

SEQ ID NO: 34094 - DNA, 18 bp, Artificial Sequence
  Synthetic
gcgagtagacgtaaaccg

SEQ ID NO: 34095 - DNA, 19 bp, Artificial Sequence
  Synthetic
atacaagccattgcaatcg

SEQ ID NO: 34096 - DNA, 19 bp, Artificial Sequence
  Synthetic
acggtagcggttgtatgca

SEQ ID NO: 34097 - DNA, 19 bp, Artificial Sequence
  Synthetic
aagagggtgaaatggtgaa

SEQ ID NO: 34098 - DNA, 21 bp, Artificial Sequence
  Synthetic
gtgccatctatgaaaaggtaa

SEQ ID NO: 34099 - DNA, 18 bp, Artificial Sequence
  Synthetic
ttgattggaacgccctgg

SEQ ID NO: 34100 - DNA, 19 bp, Artificial Sequence
  Synthetic
cgagaagaggcttgactgc

SEQ ID NO: 34101 - DNA, 21 bp, Artificial Sequence
  Synthetic
aatttccttgggtttgttctg

SEQ ID NO: 34102 - DNA, 18 bp, Artificial Sequence
  Synthetic
tttgtctctgcggcaaag

SEQ ID NO: 34103 - DNA, 21 bp, Artificial Sequence
  Synthetic
tctccctagcattattcactg

SEQ ID NO: 34104 - DNA, 19 bp, Artificial Sequence
  Synthetic
aggtttttgccttgggtaa

SEQ ID NO: 34105 - DNA, 19 bp, Artificial Sequence
  Synthetic
ggattatgggcaacggctg

SEQ ID NO: 34106 - DNA, 20 bp, Artificial Sequence
  Synthetic
atctagaagcaccacttgaa

SEQ ID NO: 34107 - DNA, 19 bp, Artificial Sequence
  Synthetic
agtcaagtatgatggccac

SEQ ID NO: 34108 - DNA, 18 bp, Artificial Sequence
  Synthetic
ttgatgttctgggatggc

SEQ ID NO: 34109 - DNA, 22 bp, Artificial Sequence
  Synthetic
cattggtacagcattgacataa

SEQ ID NO: 34110 - DNA, 20 bp, Artificial Sequence
  Synthetic
aatatttccttggtcgggtg

SEQ ID NO: 34111 - DNA, 21 bp, Artificial Sequence
  Synthetic
agaaccacaaaacataaagct

SEQ ID NO: 34112 - DNA, 21 bp, Artificial Sequence
  Synthetic
ataaccagctgaggaatatgt

SEQ ID NO: 34113 - DNA, 18 bp, Artificial Sequence
  Synthetic
gaacagagctggtgtgtc

SEQ ID NO: 34114 - DNA, 21 bp, Artificial Sequence
  Synthetic
catgtaataggctgatgcaat

SEQ ID NO: 34115 - DNA, 22 bp, Artificial Sequence
  Synthetic
gtaaaaacatcaggtctggttt

SEQ ID NO: 34116 - DNA, 25 bp, Artificial Sequence
  Synthetic
ggtaatattctgattcttgaatctc

SEQ ID NO: 34117 - DNA, 19 bp, Artificial Sequence
  Synthetic
ctgttgtttgatgctgtct

SEQ ID NO: 34118 - DNA, 18 bp, Artificial Sequence
  Synthetic
aatccactctagcccacg

SEQ ID NO: 34119 - DNA, 19 bp, Artificial Sequence
  Synthetic
tggcaaaacaaagtcatgt

SEQ ID NO: 34120 - DNA, 18 bp, Artificial Sequence
  Synthetic
tggtcgaaagctttttgc

SEQ ID NO: 34121 - DNA, 19 bp, Artificial Sequence
  Synthetic
tgtttgagtagtgagcgac

SEQ ID NO: 34122 - DNA, 19 bp, Artificial Sequence
  Synthetic
catcttcacgtgagggtaa

SEQ ID NO: 34123 - DNA, 20 bp, Artificial Sequence
  Synthetic
ttagtgattaaaccctgggt

SEQ ID NO: 34124 - DNA, 20 bp, Artificial Sequence
  Synthetic
aggctaccatcatagtttga

SEQ ID NO: 34125 - DNA, 19 bp, Artificial Sequence
  Synthetic
cgtgttcctgcatacatga

SEQ ID NO: 34126 - DNA, 20 bp, Artificial Sequence
  Synthetic
ctcgaagactgaatctggaa

SEQ ID NO: 34127 - DNA, 19 bp, Artificial Sequence
  Synthetic
acagtaaggtggctctaac

SEQ ID NO: 34128 - DNA, 23 bp, Artificial Sequence
  Synthetic
gtaagcctactgtgtaaatacat

SEQ ID NO: 34129 - DNA, 18 bp, Artificial Sequence
  Synthetic
gctctgagactgctgtag

SEQ ID NO: 34130 - DNA, 18 bp, Artificial Sequence
  Synthetic
tccttctagggctttccg

SEQ ID NO: 34131 - DNA, 20 bp, Artificial Sequence
  Synthetic
cagagtcacttcagttcctt

SEQ ID NO: 34132 - DNA, 22 bp, Artificial Sequence
  Synthetic
atatccctagtaggatcggata

SEQ ID NO: 34133 - DNA, 20 bp, Artificial Sequence
  Synthetic
cgtcatgctcaaatgctaaa

SEQ ID NO: 34134 - DNA, 24 bp, Artificial Sequence
  Synthetic
agaatctgtgattataagagaagg

SEQ ID NO: 34135 - DNA, 23 bp, Artificial Sequence
  Synthetic
tgtttcctactttgttccataat

SEQ ID NO: 34136 - DNA, 23 bp, Artificial Sequence
  Synthetic
tggtgaaatacaaataagatcct

SEQ ID NO: 34137 - DNA, 18 bp, Artificial Sequence
  Synthetic
ctggtgtatccgttggtg

SEQ ID NO: 34138 - DNA, 18 bp, Artificial Sequence
  Synthetic
gcacaagaggtcaggaag

SEQ ID NO: 34139 - DNA, 19 bp, Artificial Sequence
  Synthetic
gccacaataggtgtcaacc

SEQ ID NO: 34140 - DNA, 20 bp, Artificial Sequence
  Synthetic
tgaaacaacagaaccacttg

SEQ ID NO: 34141 - DNA, 19 bp, Artificial Sequence
  Synthetic
atttgcagcttcatcttcc

SEQ ID NO: 34142 - DNA, 25 bp, Artificial Sequence
  Synthetic
cctcgaatagtacattaaaacattg

SEQ ID NO: 34143 - DNA, 18 bp, Artificial Sequence
  Synthetic
tctggaagaagtgccttc

SEQ ID NO: 34144 - DNA, 20 bp, Artificial Sequence
  Synthetic
agtcttccaagtcgtcccaa

SEQ ID NO: 34145 - DNA, 25 bp, Artificial Sequence
  Synthetic
ttgtagttacttcaacttcagctat

SEQ ID NO: 34146 - DNA, 20 bp, Artificial Sequence
  Synthetic
ggtctagtacatcctgctga

SEQ ID NO: 34147 - DNA, 23 bp, Artificial Sequence
  Synthetic
aattcctgactcagatactttcg

SEQ ID NO: 34148 - DNA, 23 bp, Artificial Sequence
  Synthetic
ttgtatatcagttaggcaccttt

SEQ ID NO: 34149 - DNA, 22 bp, Artificial Sequence
  Synthetic
ttcctagttttacttgcattga

SEQ ID NO: 34150 - DNA, 21 bp, Artificial Sequence
  Synthetic
tttgacttgctcctagagatc

SEQ ID NO: 34151 - DNA, 23 bp, Artificial Sequence
  Synthetic
tgcacatctgtatataaaacctc

SEQ ID NO: 34152 - DNA, 22 bp, Artificial Sequence
  Synthetic
catcatttagattggaatgcca

SEQ ID NO: 34153 - DNA, 20 bp, Artificial Sequence
  Synthetic
cgaccagagagtacccttct

SEQ ID NO: 34154 - DNA, 18 bp, Artificial Sequence
  Synthetic
gttcaagagtgctggagt

SEQ ID NO: 34155 - DNA, 21 bp, Artificial Sequence
  Synthetic
tgattttggtctgattttgct

SEQ ID NO: 34156 - DNA, 25 bp, Artificial Sequence
  Synthetic
ctcattaataaagttttcagctgtg

SEQ ID NO: 34157 - DNA, 22 bp, Artificial Sequence
  Synthetic
ttgtgttcgtttagtagcttta

SEQ ID NO: 34158 - DNA, 18 bp, Artificial Sequence
  Synthetic
agaaggcacgttccatag

SEQ ID NO: 34159 - DNA, 23 bp, Artificial Sequence
  Synthetic
tattggttgcaaatatagctaga

SEQ ID NO: 34160 - DNA, 18 bp, Artificial Sequence
  Synthetic
aggttgtcggaactgttt

SEQ ID NO: 34161 - DNA, 25 bp, Artificial Sequence
  Synthetic
gacattagctacatataaaacaggt

SEQ ID NO: 34162 - DNA, 19 bp, Artificial Sequence
  Synthetic
cacgaacctctttttcacc

SEQ ID NO: 34163 - DNA, 23 bp, Artificial Sequence
  Synthetic
aaaagtagtaggtttcacaaagt

SEQ ID NO: 34164 - DNA, 20 bp, Artificial Sequence
  Synthetic
aaacttgacagcattgacaa

SEQ ID NO: 34165 - DNA, 23 bp, Artificial Sequence
  Synthetic
ttgaatgattccaaaaataccag

SEQ ID NO: 34166 - DNA, 23 bp, Artificial Sequence
  Synthetic
ggaatagtataagccacaatttg

SEQ ID NO: 34167 - DNA, 24 bp, Artificial Sequence
  Synthetic
gacctattactcattttgctcata

SEQ ID NO: 34168 - DNA, 23 bp, Artificial Sequence
  Synthetic
tttctaaaagaagtcgattttgc

SEQ ID NO: 34169 - DNA, 20 bp, Artificial Sequence
  Synthetic
cgttttattccagcgtcaaa

SEQ ID NO: 34170 - DNA, 19 bp, Artificial Sequence
  Synthetic
aacattttgacccagacct

SEQ ID NO: 34171 - DNA, 20 bp, Artificial Sequence
  Synthetic
agtccatactgttgcacaat

SEQ ID NO: 34172 - DNA, 22 bp, Artificial Sequence
  Synthetic
tcagctttttctttactcatca

SEQ ID NO: 34173 - DNA, 18 bp, Artificial Sequence
  Synthetic
tctcacatcacgcttagc

SEQ ID NO: 34174 - DNA, 21 bp, Artificial Sequence
  Synthetic
tgaattgatgattagccacca

SEQ ID NO: 34175 - DNA, 23 bp, Artificial Sequence
  Synthetic
tcggaaattgaccaaaagaatta

SEQ ID NO: 34176 - DNA, 20 bp, Artificial Sequence
  Synthetic
tgtcaaacttgtagcccaaa

SEQ ID NO: 34177 - DNA, 20 bp, Artificial Sequence
  Synthetic
ccactatttttgctggacaa

SEQ ID NO: 34178 - DNA, 21 bp, Artificial Sequence
  Synthetic
agaacttttaagtgcgttagt

SEQ ID NO: 34179 - DNA, 21 bp, Artificial Sequence
  Synthetic
cgattaatttccctagtggtc

SEQ ID NO: 34180 - DNA, 18 bp, Artificial Sequence
  Synthetic
tcacatcagtcgttccac

SEQ ID NO: 34181 - DNA, 19 bp, Artificial Sequence
  Synthetic
ttatcgtcaagggctttga

SEQ ID NO: 34182 - DNA, 18 bp, Artificial Sequence
  Synthetic
tgggtaaagtcgtgcaac

SEQ ID NO: 34183 - DNA, 20 bp, Artificial Sequence
  Synthetic
agcatgttacgtaaggcttt

SEQ ID NO: 34184 - DNA, 21 bp, Artificial Sequence
  Synthetic
tctttaccaagagatgcttca

SEQ ID NO: 34185 - DNA, 22 bp, Artificial Sequence
  Synthetic
caaaatcattggtatgctttgg

SEQ ID NO: 34186 - DNA, 18 bp, Artificial Sequence
  Synthetic
aatccccattgcttcagc

SEQ ID NO: 34187 - DNA, 19 bp, Artificial Sequence
  Synthetic
tgcagatgcgaatggtgtc

SEQ ID NO: 34188 - DNA, 22 bp, Artificial Sequence
  Synthetic
ataaaatcaatggccaaacctt

SEQ ID NO: 34189 - DNA, 21 bp, Artificial Sequence
  Synthetic
gcttactctgtcagaattgtc

SEQ ID NO: 34190 - DNA, 18 bp, Artificial Sequence
  Synthetic
gatgaatgcgttccccag

SEQ ID NO: 34191 - DNA, 23 bp, Artificial Sequence
  Synthetic
tctgtcttcatgattaaatggat

SEQ ID NO: 34192 - DNA, 20 bp, Artificial Sequence
  Synthetic
cctttttaccagctgtttgc

SEQ ID NO: 34193 - DNA, 23 bp, Artificial Sequence
  Synthetic
acgttctatataaggctcgatag

SEQ ID NO: 34194 - DNA, 22 bp, Artificial Sequence
  Synthetic
tgatatagtcctgactcgctaa

SEQ ID NO: 34195 - DNA, 23 bp, Artificial Sequence
  Synthetic
aaggttgttttccaatataagct

SEQ ID NO: 34196 - DNA, 18 bp, Artificial Sequence
  Synthetic
caacacctgtcccacaac

SEQ ID NO: 34197 - DNA, 19 bp, Artificial Sequence
  Synthetic
cttggtcgatgtctttgac

SEQ ID NO: 34198 - DNA, 21 bp, Artificial Sequence
  Synthetic
aaaaactgatgaaaagcgtga

SEQ ID NO: 34199 - DNA, 24 bp, Artificial Sequence
  Synthetic
acaaatatcccttttcttagcttc

SEQ ID NO: 34200 - DNA, 18 bp, Artificial Sequence
  Synthetic
catctccacttccaaccc

SEQ ID NO: 34201 - DNA, 20 bp, Artificial Sequence
  Synthetic
tcaattgtcttaatgccacc

SEQ ID NO: 34202 - DNA, 20 bp, Artificial Sequence
  Synthetic
tgattgcccgaataaaggat

SEQ ID NO: 34203 - DNA, 18 bp, Artificial Sequence
  Synthetic
acaaaacatcctgacgct

SEQ ID NO: 34204 - DNA, 23 bp, Artificial Sequence
  Synthetic
tgttattggtctgtagaaagtcc

SEQ ID NO: 34205 - DNA, 21 bp, Artificial Sequence
  Synthetic
tgaaatagcaagatcagcttt

SEQ ID NO: 34206 - DNA, 18 bp, Artificial Sequence
  Synthetic
gctaaaaaaccagcagct

SEQ ID NO: 34207 - DNA, 18 bp, Artificial Sequence
  Synthetic
cccttgcttcttctggat

SEQ ID NO: 34208 - DNA, 23 bp, Artificial Sequence
  Synthetic
tattttaaacccagctttgaaag

SEQ ID NO: 34209 - DNA, 21 bp, Artificial Sequence
  Synthetic
tcttttccttatgaaatgggc

SEQ ID NO: 34210 - DNA, 22 bp, Artificial Sequence
  Synthetic
aaactgcatggtaaaatttagc

SEQ ID NO: 34211 - DNA, 18 bp, Artificial Sequence
  Synthetic
tttccatatcagctgccg

SEQ ID NO: 34212 - DNA, 24 bp, Artificial Sequence
  Synthetic
cattttattggggattctgacaat

SEQ ID NO: 34213 - DNA, 18 bp, Artificial Sequence
  Synthetic
ttggcattggtaaggtca

SEQ ID NO: 34214 - DNA, 23 bp, Artificial Sequence
  Synthetic
caacttgaacgttaaaagttgtt

SEQ ID NO: 34215 - DNA, 21 bp, Artificial Sequence
  Synthetic
tgtctagctcttttagaaggt

SEQ ID NO: 34216 - DNA, 23 bp, Artificial Sequence
  Synthetic
ccataggtttttgctaaatcaat

SEQ ID NO: 34217 - DNA, 20 bp, Artificial Sequence
  Synthetic
tggtcattttggtaagcaaa

SEQ ID NO: 34218 - DNA, 24 bp, Artificial Sequence
  Synthetic
caatctattctttctattgggtga

SEQ ID NO: 34219 - DNA, 22 bp, Artificial Sequence
  Synthetic
gtaagttttaatgccaattggt

SEQ ID NO: 34220 - DNA, 19 bp, Artificial Sequence
  Synthetic
tcttccaactcaacgtctt

SEQ ID NO: 34221 - DNA, 24 bp, Artificial Sequence
  Synthetic
ttgtgccattaaataatcacttcc

SEQ ID NO: 34222 - DNA, 22 bp, Artificial Sequence
  Synthetic
agccagcattattaatcaagac

SEQ ID NO: 34223 - DNA, 22 bp, Artificial Sequence
  Synthetic
agtaaatttaccaacgctttcc

SEQ ID NO: 34224 - DNA, 19 bp, Artificial Sequence
  Synthetic
gccctcttcaatagcttga

SEQ ID NO: 34225 - DNA, 23 bp, Artificial Sequence
  Synthetic
cctcatgttgttctttaaagaca

SEQ ID NO: 34226 - DNA, 24 bp, Artificial Sequence
  Synthetic
ttagagaaataacttcttgcctct

SEQ ID NO: 34227 - DNA, 18 bp, Artificial Sequence
  Synthetic
ttgatcacaggaaccacc

SEQ ID NO: 34228 - DNA, 21 bp, Artificial Sequence
  Synthetic
tgttgaacagatttggcaaat

SEQ ID NO: 34229 - DNA, 25 bp, Artificial Sequence
  Synthetic
aatcgactgacaattctaaatcaac

SEQ ID NO: 34230 - DNA, 19 bp, Artificial Sequence
  Synthetic
accaactgccttatagtgg

SEQ ID NO: 34231 - DNA, 21 bp, Artificial Sequence
  Synthetic
cctttgtgtcataaacctctt

SEQ ID NO: 34232 - DNA, 18 bp, Artificial Sequence
  Synthetic
gagattgctggcatttcc

SEQ ID NO: 34233 - DNA, 19 bp, Artificial Sequence
  Synthetic
cagagtgacggtaaccaaa

SEQ ID NO: 34234 - DNA, 21 bp, Artificial Sequence
  Synthetic
tcataatctttagctgtgcca

SEQ ID NO: 34235 - DNA, 22 bp, Artificial Sequence
  Synthetic
tgaatatgccaaaaaaggacct

SEQ ID NO: 34236 - DNA, 18 bp, Artificial Sequence
  Synthetic
ttcactaacgacaccagc

SEQ ID NO: 34237 - DNA, 20 bp, Artificial Sequence
  Synthetic
ggcacaggttttggaatcct

SEQ ID NO: 34238 - DNA, 18 bp, Artificial Sequence
  Synthetic
ttggaaaggagtggcaac

SEQ ID NO: 34239 - DNA, 22 bp, Artificial Sequence
  Synthetic
gttttcagatgaagtacaacag

SEQ ID NO: 34240 - DNA, 18 bp, Artificial Sequence
  Synthetic
aaaggggtcaacgctaaa

SEQ ID NO: 34241 - DNA, 21 bp, Artificial Sequence
  Synthetic
gcaagactgtcaatgttcaag

SEQ ID NO: 34242 - DNA, 18 bp, Artificial Sequence
  Synthetic
cctgatgaggtccgatca

SEQ ID NO: 34243 - DNA, 18 bp, Artificial Sequence
  Synthetic
aaggggaagggcaatttg

SEQ ID NO: 34244 - DNA, 20 bp, Artificial Sequence
  Synthetic
ctatcgtctttgatggacca

SEQ ID NO: 34245 - DNA, 22 bp, Artificial Sequence
  Synthetic
ttaaaccgtatgacgaaacaga

SEQ ID NO: 34246 - DNA, 18 bp, Artificial Sequence
  Synthetic
tgcagaccttggacatct

SEQ ID NO: 34247 - DNA, 19 bp, Artificial Sequence
  Synthetic
gggaaaaatggagttgagc

SEQ ID NO: 34248 - DNA, 21 bp, Artificial Sequence
  Synthetic
aatgaaaaatggggttgttcc

SEQ ID NO: 34249 - DNA, 18 bp, Artificial Sequence
  Synthetic
gctcgcacagataccatt

SEQ ID NO: 34250 - DNA, 24 bp, Artificial Sequence
  Synthetic
cgatatatcctaaagaagacagat

SEQ ID NO: 34251 - DNA, 23 bp, Artificial Sequence
  Synthetic
tggatgctattattgaagctaaa

SEQ ID NO: 34252 - DNA, 19 bp, Artificial Sequence
  Synthetic
ggcatgattatcaaaggcc

SEQ ID NO: 34253 - DNA, 20 bp, Artificial Sequence
  Synthetic
gggattcttgaagtggttga

SEQ ID NO: 34254 - DNA, 22 bp, Artificial Sequence
  Synthetic
acatataccttgcctatctctt

SEQ ID NO: 34255 - DNA, 18 bp, Artificial Sequence
  Synthetic
gtggcagaaaccttctcg

SEQ ID NO: 34256 - DNA, 23 bp, Artificial Sequence
  Synthetic
acaattgtctttaatcagttggt

SEQ ID NO: 34257 - DNA, 22 bp, Artificial Sequence
  Synthetic
cttaattacatctgtggctgtt

SEQ ID NO: 34258 - DNA, 22 bp, Artificial Sequence
  Synthetic
ctgatttgttccaagaaaatgg

SEQ ID NO: 34259 - DNA, 20 bp, Artificial Sequence
  Synthetic
ggtgatcttttattggcaca

SEQ ID NO: 34260 - DNA, 20 bp, Artificial Sequence
  Synthetic
ctagccataaaggagctgat

SEQ ID NO: 34261 - DNA, 21 bp, Artificial Sequence
  Synthetic
gttacatctatcgtggtgcta

SEQ ID NO: 34262 - DNA, 19 bp, Artificial Sequence
  Synthetic
tccatgtctggctttcaag

SEQ ID NO: 34263 - DNA, 20 bp, Artificial Sequence
  Synthetic
gctctgaactaaggtggtac

SEQ ID NO: 34264 - DNA, 18 bp, Artificial Sequence
  Synthetic
aagaattgcaacgtcgtg

SEQ ID NO: 34265 - DNA, 22 bp, Artificial Sequence
  Synthetic
cccacaatatcttctgtcagat

SEQ ID NO: 34266 - DNA, 18 bp, Artificial Sequence
  Synthetic
tcaggtggttagagtgca

SEQ ID NO: 34267 - DNA, 24 bp, Artificial Sequence
  Synthetic
ttacggattcttgttagactatag

SEQ ID NO: 34268 - DNA, 19 bp, Artificial Sequence
  Synthetic
gctgttcgcccattaaagc

SEQ ID NO: 34269 - DNA, 20 bp, Artificial Sequence
  Synthetic
ctaaagagtaacggaggcgc

SEQ ID NO: 34270 - DNA, 19 bp, Artificial Sequence
  Synthetic
caggtagtcgaggcgagta

SEQ ID NO: 34271 - DNA, 20 bp, Artificial Sequence
  Synthetic
acctaaggagagaccgaaag

SEQ ID NO: 34272 - DNA, 25 bp, Artificial Sequence
  Synthetic
caaaataactgttaagtggaaaagg

SEQ ID NO: 34273 - DNA, 20 bp, Artificial Sequence
  Synthetic
acacgtgaaatctcgttgga

SEQ ID NO: 34274 - DNA, 19 bp, Artificial Sequence
  Synthetic
acctattaggagccagccg

SEQ ID NO: 34275 - DNA, 22 bp, Artificial Sequence
  Synthetic
acacatcgttatcaaatcaaac

SEQ ID NO: 34276 - DNA, 18 bp, Artificial Sequence
  Synthetic
aaacaatgggtggtgtct

SEQ ID NO: 34277 - DNA, 21 bp, Artificial Sequence
  Synthetic
atgagcttatctcgtgctaaa

SEQ ID NO: 34278 - DNA, 19 bp, Artificial Sequence
  Synthetic
ccgcacttgcttatggtat

SEQ ID NO: 34279 - DNA, 22 bp, Artificial Sequence
  Synthetic
tggtattgacttaggtacaaca

SEQ ID NO: 34280 - DNA, 18 bp, Artificial Sequence
  Synthetic
cagttcagaccctcccag

SEQ ID NO: 34281 - DNA, 18 bp, Artificial Sequence
  Synthetic
acgtgctgatgagtttga

SEQ ID NO: 34282 - DNA, 18 bp, Artificial Sequence
  Synthetic
tagtcaagaagccgcact

SEQ ID NO: 34283 - DNA, 21 bp, Artificial Sequence
  Synthetic
cgtttaacagggtttgatgtt

SEQ ID NO: 34284 - DNA, 23 bp, Artificial Sequence
  Synthetic
ttaatcgttgagctatttacaca

SEQ ID NO: 34285 - DNA, 22 bp, Artificial Sequence
  Synthetic
ctttttgacttggttaaaagct

SEQ ID NO: 34286 - DNA, 18 bp, Artificial Sequence
  Synthetic
gaacctgttgtgtgccag

SEQ ID NO: 34287 - DNA, 21 bp, Artificial Sequence
  Synthetic
acgctcttttagtttcttgaa

SEQ ID NO: 34288 - DNA, 20 bp, Artificial Sequence
  Synthetic
gcatatcaggaatggttgtc

SEQ ID NO: 34289 - DNA, 19 bp, Artificial Sequence
  Synthetic
agtgccaaagaggtgatta

SEQ ID NO: 34290 - DNA, 19 bp, Artificial Sequence
  Synthetic
ttggaaagtcacaacctga

SEQ ID NO: 34291 - DNA, 25 bp, Artificial Sequence
  Synthetic
gtgcctttataagtatcaatcactt

SEQ ID NO: 34292 - DNA, 21 bp, Artificial Sequence
  Synthetic
tcataaacaatgcttttccct

SEQ ID NO: 34293 - DNA, 18 bp, Artificial Sequence
  Synthetic
tttcttcccactcccctt

SEQ ID NO: 34294 - DNA, 19 bp, Artificial Sequence
  Synthetic
cctgaggaaggtttgcttt

SEQ ID NO: 34295 - DNA, 25 bp, Artificial Sequence
  Synthetic
cctttattgaaagaaatgatatccc

SEQ ID NO: 34296 - DNA, 24 bp, Artificial Sequence
  Synthetic
aaaagaccttgataagcttgaaag

SEQ ID NO: 34297 - DNA, 18 bp, Artificial Sequence
  Synthetic
ttaacatctgctcaggcg

SEQ ID NO: 34298 - DNA, 21 bp, Artificial Sequence
  Synthetic
ttttggtgtctgagctgatta

SEQ ID NO: 34299 - DNA, 23 bp, Artificial Sequence
  Synthetic
gcttagcacattaaaaatagcaa

SEQ ID NO: 34300 - DNA, 19 bp, Artificial Sequence
  Synthetic
aaccaacacgtctagaagt

SEQ ID NO: 34301 - DNA, 22 bp, Artificial Sequence
  Synthetic
gccaatttcatgtagataatgc

SEQ ID NO: 34302 - DNA, 21 bp, Artificial Sequence
  Synthetic
aggtaccttttcaaatggaac

SEQ ID NO: 34303 - DNA, 23 bp, Artificial Sequence
  Synthetic
ctacattgaacgatatcggaatc

SEQ ID NO: 34304 - DNA, 22 bp, Artificial Sequence
  Synthetic
aactatttcctgtttcagctta

SEQ ID NO: 34305 - DNA, 20 bp, Artificial Sequence
  Synthetic
cgggttcaaagacaagctgc

SEQ ID NO: 34306 - DNA, 15 bp, Artificial Sequence
  Synthetic
acagcgcgatgccga

SEQ ID NO: 34307 - DNA, 18 bp, Artificial Sequence
  Synthetic
tagccggccgatgtatcc

SEQ ID NO: 34308 - DNA, 17 bp, Artificial Sequence
  Synthetic
attaatgggggggggcc

SEQ ID NO: 34309 - DNA, 18 bp, Artificial Sequence
  Synthetic
ggcgcttgatccccatag

SEQ ID NO: 34310 - DNA, 18 bp, Artificial Sequence
  Synthetic
tttcaacttacgggcggc

SEQ ID NO: 34311 - DNA, 17 bp, Artificial Sequence
  Synthetic
acccaatctccggccac

SEQ ID NO: 34312 - DNA, 18 bp, Artificial Sequence
  Synthetic
ggaagcgggagacgactc

SEQ ID NO: 34313 - DNA, 16 bp, Artificial Sequence
  Synthetic
ggccaccgacccgtta

SEQ ID NO: 34314 - DNA, 18 bp, Artificial Sequence
  Synthetic
atccaaccaggcctgcat

SEQ ID NO: 34315 - DNA, 16 bp, Artificial Sequence
  Synthetic
acggtgggggcctcat

SEQ ID NO: 34316 - DNA, 20 bp, Artificial Sequence
  Synthetic
ccagggatctaactacggga

SEQ ID NO: 34317 - DNA, 19 bp, Artificial Sequence
  Synthetic
cggccggacatgttgaaag

SEQ ID NO: 34318 - DNA, 20 bp, Artificial Sequence
  Synthetic
tgcatgccttatcggtgaaa

SEQ ID NO: 34319 - DNA, 20 bp, Artificial Sequence
  Synthetic
actgccatgttccagactgt

SEQ ID NO: 34320 - DNA, 16 bp, Artificial Sequence
  Synthetic
ccgggccccagttctt

SEQ ID NO: 34321 - DNA, 19 bp, Artificial Sequence
  Synthetic
ttcttcccctccaactgga

SEQ ID NO: 34322 - DNA, 18 bp, Artificial Sequence
  Synthetic
gctgtcattggcgactgc

SEQ ID NO: 34323 - DNA, 17 bp, Artificial Sequence
  Synthetic
taatgcagccgctcccg

SEQ ID NO: 34324 - DNA, 18 bp, Artificial Sequence
  Synthetic
tgcagtagccacctgagc

SEQ ID NO: 34325 - DNA, 18 bp, Artificial Sequence
  Synthetic
gttgaccagtggcaacgt

SEQ ID NO: 34326 - DNA, 19 bp, Artificial Sequence
  Synthetic
tgatattaacaggcccagc

SEQ ID NO: 34327 - DNA, 20 bp, Artificial Sequence
  Synthetic
cttccacaataagcagtgac

SEQ ID NO: 34328 - DNA, 18 bp, Artificial Sequence
  Synthetic
aaaatgagccaacctcgc

SEQ ID NO: 34329 - DNA, 20 bp, Artificial Sequence
  Synthetic
gacattaccaggaacaacac

SEQ ID NO: 34330 - DNA, 18 bp, Artificial Sequence
  Synthetic
ccagaagctttgcgtaca

SEQ ID NO: 34331 - DNA, 21 bp, Artificial Sequence
  Synthetic
ccatcaagcttaaaaccacta

SEQ ID NO: 34332 - DNA, 20 bp, Artificial Sequence
  Synthetic
tgcttgaacaatagcacatt

SEQ ID NO: 34333 - DNA, 22 bp, Artificial Sequence
  Synthetic
ctctacgaattacacgacttac

SEQ ID NO: 34334 - DNA, 20 bp, Artificial Sequence
  Synthetic
gcttcaacaacacaaccatt

SEQ ID NO: 34335 - DNA, 21 bp, Artificial Sequence
  Synthetic
aacatataggtttcacaggga

SEQ ID NO: 34336 - DNA, 22 bp, Artificial Sequence
  Synthetic
gataatgactgaagttgacctt

SEQ ID NO: 34337 - DNA, 24 bp, Artificial Sequence
  Synthetic
ccataacattactctctacaacaa

SEQ ID NO: 34338 - DNA, 23 bp, Artificial Sequence
  Synthetic
accaacaaaatcattagggtaac

SEQ ID NO: 34339 - DNA, 24 bp, Artificial Sequence
  Synthetic
gaaattataggttcaccaacattg

SEQ ID NO: 34340 - DNA, 18 bp, Artificial Sequence
  Synthetic
ttccaaaagcagcctgta

SEQ ID NO: 34341 - DNA, 19 bp, Artificial Sequence
  Synthetic
acatagccacaacgctaaa

SEQ ID NO: 34342 - DNA, 18 bp, Artificial Sequence
  Synthetic
ataacagacgcgaaccac

SEQ ID NO: 34343 - DNA, 24 bp, Artificial Sequence
  Synthetic
ggtgtatgtacattagattgtgaa

SEQ ID NO: 34344 - DNA, 20 bp, Artificial Sequence
  Synthetic
cacctacaaccattcaacaa

SEQ ID NO: 34345 - DNA, 25 bp, Artificial Sequence
  Synthetic
ggacagttgaaatttttatacaacg

SEQ ID NO: 34346 - DNA, 20 bp, Artificial Sequence
  Synthetic
gagcgtgcttctttatacat

SEQ ID NO: 34347 - DNA, 20 bp, Artificial Sequence
  Synthetic
ccctcagctttcataggttt

SEQ ID NO: 34348 - DNA, 25 bp, Artificial Sequence
  Synthetic
cagcaccattagataacatcttaat

SEQ ID NO: 34349 - DNA, 18 bp, Artificial Sequence
  Synthetic
tcgagctgcactagaacc

SEQ ID NO: 34350 - DNA, 21 bp, Artificial Sequence
  Synthetic
tgttcatcaaagttacgcata

SEQ ID NO: 34351 - DNA, 23 bp, Artificial Sequence
  Synthetic
caccaaaatcataaaagttacca

SEQ ID NO: 34352 - DNA, 21 bp, Artificial Sequence
  Synthetic
aacagaaaaacaaatagtgcg

SEQ ID NO: 34353 - DNA, 22 bp, Artificial Sequence
  Synthetic
tgcgtgtattaacaatggattt

SEQ ID NO: 34354 - DNA, 19 bp, Artificial Sequence
  Synthetic
gtactagcgtcaccagaag

SEQ ID NO: 34355 - DNA, 22 bp, Artificial Sequence
  Synthetic
gttctaacaaaacaacagcatc

SEQ ID NO: 34356 - DNA, 21 bp, Artificial Sequence
  Synthetic
aaataaacttgtggtcggtac

SEQ ID NO: 34357 - DNA, 20 bp, Artificial Sequence
  Synthetic
aatgtgacttaccactacca

SEQ ID NO: 34358 - DNA, 25 bp, Artificial Sequence
  Synthetic
ggtttaataacatcaccaaaattgg

SEQ ID NO: 34359 - DNA, 18 bp, Artificial Sequence
  Synthetic
tactgccaaacaacgtgt

SEQ ID NO: 34360 - DNA, 19 bp, Artificial Sequence
  Synthetic
gtacgtgtgtcaaaacgac

SEQ ID NO: 34361 - DNA, 22 bp, Artificial Sequence
  Synthetic
ctttcagcttcataatcccata

SEQ ID NO: 34362 - DNA, 21 bp, Artificial Sequence
  Synthetic
aaacacatacgttgaagctta

SEQ ID NO: 34363 - DNA, 22 bp, Artificial Sequence
  Synthetic
cacaatcacctgtaatgctaaa

SEQ ID NO: 34364 - DNA, 19 bp, Artificial Sequence
  Synthetic
gcaaaagcactacggtgat

SEQ ID NO: 34365 - DNA, 23 bp, Artificial Sequence
  Synthetic
ccattacaatcatcacaaacagt

SEQ ID NO: 34366 - DNA, 23 bp, Artificial Sequence
  Synthetic
ttacaattaacatcagaaccagt

SEQ ID NO: 34367 - DNA, 22 bp, Artificial Sequence
  Synthetic
tctatgaaacccaaatcgaaat

SEQ ID NO: 34368 - DNA, 23 bp, Artificial Sequence
  Synthetic
tggtttacaaacataacaagaac

SEQ ID NO: 34369 - DNA, 20 bp, Artificial Sequence
  Synthetic
gtgcaattgttaccaccatt

SEQ ID NO: 34370 - DNA, 18 bp, Artificial Sequence
  Synthetic
cacaagcaaggtcagcaa

SEQ ID NO: 34371 - DNA, 18 bp, Artificial Sequence
  Synthetic
tgaaccacgaacttcagt

SEQ ID NO: 34372 - DNA, 23 bp, Artificial Sequence
  Synthetic
acacgagatatgttaacaaaagt

SEQ ID NO: 34373 - DNA, 25 bp, Artificial Sequence
  Synthetic
ccttttcaaattcgtaataaggaag

SEQ ID NO: 34374 - DNA, 23 bp, Artificial Sequence
  Synthetic
tgctatacttataatgcccatac

SEQ ID NO: 34375 - DNA, 23 bp, Artificial Sequence
  Synthetic
agcaactattacatatttaggca

SEQ ID NO: 34376 - DNA, 20 bp, Artificial Sequence
  Synthetic
ttacccttaccaatagggac

SEQ ID NO: 34377 - DNA, 18 bp, Artificial Sequence
  Synthetic
gctagcacgagatgagtt

SEQ ID NO: 34378 - DNA, 20 bp, Artificial Sequence
  Synthetic
gtttcttcaactgagaaggc

SEQ ID NO: 34379 - DNA, 21 bp, Artificial Sequence
  Synthetic
aatctgctcaatgaacttagg

SEQ ID NO: 34380 - DNA, 18 bp, Artificial Sequence
  Synthetic
cgtttgacacaacctcca

SEQ ID NO: 34381 - DNA, 18 bp, Artificial Sequence
  Synthetic
ttcctgttcgctttccag

SEQ ID NO: 34382 - DNA, 22 bp, Artificial Sequence
  Synthetic
tgaatatacacacaatgggttt

SEQ ID NO: 34383 - DNA, 22 bp, Artificial Sequence
  Synthetic
gaaccattttacaaagctcaaa

SEQ ID NO: 34384 - DNA, 22 bp, Artificial Sequence
  Synthetic
gtaacaccatttcaatagctgt

SEQ ID NO: 34385 - DNA, 21 bp, Artificial Sequence
  Synthetic
ccactggatacttttctccat

SEQ ID NO: 34386 - DNA, 18 bp, Artificial Sequence
  Synthetic
gccgtctgcgtacaggtg

SEQ ID NO: 34387 - DNA, 18 bp, Artificial Sequence
  Synthetic
tacacacgtccaagcaaa

SEQ ID NO: 34388 - DNA, 18 bp, Artificial Sequence
  Synthetic
ccgaggggagtataacca

SEQ ID NO: 34389 - DNA, 22 bp, Artificial Sequence
  Synthetic
ctcgtaacacatctaatatggc

SEQ ID NO: 34390 - DNA, 23 bp, Artificial Sequence
  Synthetic
attatagaatcttgagggcctaa

SEQ ID NO: 34391 - DNA, 18 bp, Artificial Sequence
  Synthetic
ccaattgctgtgcccagg

SEQ ID NO: 34392 - DNA, 23 bp, Artificial Sequence
  Synthetic
gtctaaaagctcttcttctgaat

SEQ ID NO: 34393 - DNA, 21 bp, Artificial Sequence
  Synthetic
aactctaaatgcatttggtga

SEQ ID NO: 34394 - DNA, 18 bp, Artificial Sequence
  Synthetic
ggcaacgactacttgtcc

SEQ ID NO: 34395 - DNA, 20 bp, Artificial Sequence
  Synthetic
cgagtaaaaaagtgcctggt

SEQ ID NO: 34396 - DNA, 23 bp, Artificial Sequence
  Synthetic
cttgcattgtttttcatactgat

SEQ ID NO: 34397 - DNA, 20 bp, Artificial Sequence
  Synthetic
ccataagggattagccacaa

SEQ ID NO: 34398 - DNA, 23 bp, Artificial Sequence
  Synthetic
aattcttgaaaagagtacacacc

SEQ ID NO: 34399 - DNA, 21 bp, Artificial Sequence
  Synthetic
atctagtaaccaaccaccata

SEQ ID NO: 34400 - DNA, 22 bp, Artificial Sequence
  Synthetic
cggtttcatcaaagttacttct

SEQ ID NO: 34401 - DNA, 20 bp, Artificial Sequence
  Synthetic
aagtagctttggcattcttg

SEQ ID NO: 34402 - DNA, 19 bp, Artificial Sequence
  Synthetic
aggggcagctatagcatag

SEQ ID NO: 34403 - DNA, 22 bp, Artificial Sequence
  Synthetic
ttgggagctctatgttttaaat

SEQ ID NO: 34404 - DNA, 18 bp, Artificial Sequence
  Synthetic
tagcttgtttggctctgg

SEQ ID NO: 34405 - DNA, 18 bp, Artificial Sequence
  Synthetic
gcctcacaggaacagaag

SEQ ID NO: 34406 - DNA, 23 bp, Artificial Sequence
  Synthetic
tgtattgtgatctgctaacagtt

SEQ ID NO: 34407 - DNA, 23 bp, Artificial Sequence
  Synthetic
tctctttgttcaaaataccttct

SEQ ID NO: 34408 - DNA, 19 bp, Artificial Sequence
  Synthetic
tccagtgttctccttttgg

SEQ ID NO: 34409 - DNA, 24 bp, Artificial Sequence
  Synthetic
ccctactaaaaatatgtctggtat

SEQ ID NO: 34410 - DNA, 19 bp, Artificial Sequence
  Synthetic
ttctccatgctacaccatt

SEQ ID NO: 34411 - DNA, 19 bp, Artificial Sequence
  Synthetic
acggtgccaaacaaatttg

SEQ ID NO: 34412 - DNA, 23 bp, Artificial Sequence
  Synthetic
tgttgtgagtctttattcttgat

SEQ ID NO: 34413 - DNA, 23 bp, Artificial Sequence
  Synthetic
cttcttctatgtcatcaaggtac

SEQ ID NO: 34414 - DNA, 21 bp, Artificial Sequence
  Synthetic
gatcatcagtagcaacaagtt

SEQ ID NO: 34415 - DNA, 23 bp, Artificial Sequence
  Synthetic
gctattactgttttgtggaacaa

SEQ ID NO: 34416 - DNA, 25 bp, Artificial Sequence
  Synthetic
tgagtgttcttatagagaaacagat

SEQ ID NO: 34417 - DNA, 23 bp, Artificial Sequence
  Synthetic
tttttgtcttaacaactcaccaa

SEQ ID NO: 34418 - DNA, 19 bp, Artificial Sequence
  Synthetic
ggttctcaaaggttcaacc

SEQ ID NO: 34419 - DNA, 21 bp, Artificial Sequence
  Synthetic
gctatagaaccatagctctgg

SEQ ID NO: 34420 - DNA, 23 bp, Artificial Sequence
  Synthetic
ttgtgtagaaagaggagttaatc

SEQ ID NO: 34421 - DNA, 24 bp, Artificial Sequence
  Synthetic
gaaaaaatatgggtcaactggaat

SEQ ID NO: 34422 - DNA, 21 bp, Artificial Sequence
  Synthetic
acacgaaatctcaaagttgac

SEQ ID NO: 34423 - DNA, 22 bp, Artificial Sequence
  Synthetic
tgtagtaacatccatagcatga

SEQ ID NO: 34424 - DNA, 23 bp, Artificial Sequence
  Synthetic
aacttgtagatggacatatgatc

SEQ ID NO: 34425 - DNA, 18 bp, Artificial Sequence
  Synthetic
aggagtatcaacggcaag

SEQ ID NO: 34426 - DNA, 19 bp, Artificial Sequence
  Synthetic
acagtcccttcattttcct

SEQ ID NO: 34427 - DNA, 22 bp, Artificial Sequence
  Synthetic
catttctgtccatttctcatca

SEQ ID NO: 34428 - DNA, 25 bp, Artificial Sequence
  Synthetic
gaagttgctattataaaaggagaag

SEQ ID NO: 34429 - DNA, 18 bp, Artificial Sequence
  Synthetic
gggattggttcctcctct

SEQ ID NO: 34430 - DNA, 22 bp, Artificial Sequence
  Synthetic
caaatttataagcatgggaagg

SEQ ID NO: 34431 - DNA, 24 bp, Artificial Sequence
  Synthetic
cactttcataattctctgactttc

SEQ ID NO: 34432 - DNA, 21 bp, Artificial Sequence
  Synthetic
cctgtaatggccatatcaaga

SEQ ID NO: 34433 - DNA, 20 bp, Artificial Sequence
  Synthetic
tcatcttttggacaggttgt

SEQ ID NO: 34434 - DNA, 23 bp, Artificial Sequence
  Synthetic
agagaaatctaaatcaagaccaa

SEQ ID NO: 34435 - DNA, 21 bp, Artificial Sequence
  Synthetic
tgaaccagttcagtagcatta

SEQ ID NO: 34436 - DNA, 19 bp, Artificial Sequence
  Synthetic
ttttgagtgactccagtcc

SEQ ID NO: 34437 - DNA, 20 bp, Artificial Sequence
  Synthetic
tttgttggcttcttttggta

SEQ ID NO: 34438 - DNA, 21 bp, Artificial Sequence
  Synthetic
cccatatgtgatcctgtttac

SEQ ID NO: 34439 - DNA, 19 bp, Artificial Sequence
  Synthetic
tgcttttgagatctgctgc

SEQ ID NO: 34440 - DNA, 21 bp, Artificial Sequence
  Synthetic
tgcttctttgttctttcaaac

SEQ ID NO: 34441 - DNA, 20 bp, Artificial Sequence
  Synthetic
acctaatgttgcctttttgg

SEQ ID NO: 34442 - DNA, 22 bp, Artificial Sequence
  Synthetic
agctcctcaaaggttaaaaatt

SEQ ID NO: 34443 - DNA, 22 bp, Artificial Sequence
  Synthetic
aagttttcttgatacccacaaa

SEQ ID NO: 34444 - DNA, 23 bp, Artificial Sequence
  Synthetic
tacaatcttgtacagagttctct

SEQ ID NO: 34445 - DNA, 23 bp, Artificial Sequence
  Synthetic
ccccatcatcaattaaatcagat

SEQ ID NO: 34446 - DNA, 22 bp, Artificial Sequence
  Synthetic
agtatcttcacactcatgagtt

SEQ ID NO: 34447 - DNA, 24 bp, Artificial Sequence
  Synthetic
gccatatataaccacaatgttctt

SEQ ID NO: 34448 - DNA, 25 bp, Artificial Sequence
  Synthetic
cccttaggtaatttcataacattga

SEQ ID NO: 34449 - DNA, 18 bp, Artificial Sequence
  Synthetic
aaccagtactgcctccag

SEQ ID NO: 34450 - DNA, 21 bp, Artificial Sequence
  Synthetic
tgttacatctgacacaggatg

SEQ ID NO: 34451 - DNA, 18 bp, Artificial Sequence
  Synthetic
ctactgggccttgaacaa

SEQ ID NO: 34452 - DNA, 24 bp, Artificial Sequence
  Synthetic
cggtcagtattagcatgataatag

SEQ ID NO: 34453 - DNA, 20 bp, Artificial Sequence
  Synthetic
cgaccaatttccattcctct

SEQ ID NO: 34454 - DNA, 19 bp, Artificial Sequence
  Synthetic
ttccaaaccctatgtctcc

SEQ ID NO: 34455 - DNA, 22 bp, Artificial Sequence
  Synthetic
gtatctctgttttgatcactgg

SEQ ID NO: 34456 - DNA, 24 bp, Artificial Sequence
  Synthetic
aatacactatctctgttatgttcc

SEQ ID NO: 34457 - DNA, 23 bp, Artificial Sequence
  Synthetic
atttgaatgtttgttgtctagtg

SEQ ID NO: 34458 - DNA, 22 bp, Artificial Sequence
  Synthetic
tgaggatattttgagaccatga

SEQ ID NO: 34459 - DNA, 24 bp, Artificial Sequence
  Synthetic
ggaatcaatgctataatcttccat

SEQ ID NO: 34460 - DNA, 21 bp, Artificial Sequence
  Synthetic
gaccaattattgctgtcaact

SEQ ID NO: 34461 - DNA, 18 bp, Artificial Sequence
  Synthetic
gaacagagaccccccctg

SEQ ID NO: 34462 - DNA, 16 bp, Artificial Sequence
  Synthetic
aagtgttccgcgacgc

SEQ ID NO: 34463 - DNA, 16 bp, Artificial Sequence
  Synthetic
agctccaggtcgtccg

SEQ ID NO: 34464 - DNA, 16 bp, Artificial Sequence
  Synthetic
acagggggtgtgacgg

SEQ ID NO: 34465 - DNA, 19 bp, Artificial Sequence
  Synthetic
cgttcgttccgcacatacg

SEQ ID NO: 34466 - DNA, 16 bp, Artificial Sequence
  Synthetic
tctctacgcgcgtccg

SEQ ID NO: 34467 - DNA, 17 bp, Artificial Sequence
  Synthetic
ggcggcatgagtggagt

SEQ ID NO: 34468 - DNA, 17 bp, Artificial Sequence
  Synthetic
agaagtttccgcgctgg

SEQ ID NO: 34469 - DNA, 20 bp, Artificial Sequence
  Synthetic
aataaacgctgtctcggata

SEQ ID NO: 34470 - DNA, 22 bp, Artificial Sequence
  Synthetic
ccatgattacgagtctaaatgt

SEQ ID NO: 34471 - DNA, 19 bp, Artificial Sequence
  Synthetic
ccgaggaaatgaaggtgtt

SEQ ID NO: 34472 - DNA, 21 bp, Artificial Sequence
  Synthetic
tcgacatacgtagaacagaag

SEQ ID NO: 34473 - DNA, 21 bp, Artificial Sequence
  Synthetic
tgagtatgtgttttttgtcgt

SEQ ID NO: 34474 - DNA, 22 bp, Artificial Sequence
  Synthetic
tgtatgaggctattctgtttac

SEQ ID NO: 34475 - DNA, 19 bp, Artificial Sequence
  Synthetic
tcaacaaactcaacatggc

SEQ ID NO: 34476 - DNA, 20 bp, Artificial Sequence
  Synthetic
gcctcataagacttaccctc

SEQ ID NO: 34477 - DNA, 18 bp, Artificial Sequence
  Synthetic
gttgactccctgttacgg

SEQ ID NO: 34478 - DNA, 18 bp, Artificial Sequence
  Synthetic
tctgcaatcttagcagcc

SEQ ID NO: 34479 - DNA, 19 bp, Artificial Sequence
  Synthetic
ttctcacagtctttttgcg

SEQ ID NO: 34480 - DNA, 21 bp, Artificial Sequence
  Synthetic
actgcaacaaaatagaatgga

SEQ ID NO: 34481 - DNA, 20 bp, Artificial Sequence
  Synthetic
ggacatgtagactgttttcg

SEQ ID NO: 34482 - DNA, 18 bp, Artificial Sequence
  Synthetic
tcagcattaacgccgaag

SEQ ID NO: 34483 - DNA, 21 bp, Artificial Sequence
  Synthetic
tctctagctccagtttccatt

SEQ ID NO: 34484 - DNA, 22 bp, Artificial Sequence
  Synthetic
ggatttcccttgtaatcaatca

SEQ ID NO: 34485 - DNA, 18 bp, Artificial Sequence
  Synthetic
cgtagtctccgatacacc

SEQ ID NO: 34486 - DNA, 21 bp, Artificial Sequence
  Synthetic
atgtattcacaaagctgaact

SEQ ID NO: 34487 - DNA, 21 bp, Artificial Sequence
  Synthetic
cggagcagataatgactttta

SEQ ID NO: 34488 - DNA, 17 bp, Artificial Sequence
  Synthetic
agatggcctcgcagtgg

SEQ ID NO: 34489 - DNA, 18 bp, Artificial Sequence
  Synthetic
gccagacgtgcggagatg

SEQ ID NO: 34490 - DNA, 16 bp, Artificial Sequence
  Synthetic
aggacactccggcgtg

SEQ ID NO: 34491 - DNA, 20 bp, Artificial Sequence
  Synthetic
ggaaaacgagtttgccagac

SEQ ID NO: 34492 - DNA, 19 bp, Artificial Sequence
  Synthetic
catcagtaacacggagcgt

SEQ ID NO: 34493 - DNA, 22 bp, Artificial Sequence
  Synthetic
gtagtcttgattgtagctgaat

SEQ ID NO: 34494 - DNA, 21 bp, Artificial Sequence
  Synthetic
ctattgctcctttagggtcta

SEQ ID NO: 34495 - DNA, 23 bp, Artificial Sequence
  Synthetic
tttctagacattccttagctaag

SEQ ID NO: 34496 - DNA, 18 bp, Artificial Sequence
  Synthetic
tctctgcctgaacccaag

SEQ ID NO: 34497 - DNA, 18 bp, Artificial Sequence
  Synthetic
agcttccattccccattt

SEQ ID NO: 34498 - DNA, 21 bp, Artificial Sequence
  Synthetic
tccaattgagcatttccaaat

SEQ ID NO: 34499 - DNA, 18 bp, Artificial Sequence
  Synthetic
gatttcccaggatccagc

SEQ ID NO: 34500 - DNA, 18 bp, Artificial Sequence
  Synthetic
gggccatgaacttgtctt

SEQ ID NO: 34501 - DNA, 23 bp, Artificial Sequence
  Synthetic
agtaatagttcattctcccttct

SEQ ID NO: 34502 - DNA, 21 bp, Artificial Sequence
  Synthetic
acattttccaattgtgatcgg

SEQ ID NO: 34503 - DNA, 21 bp, Artificial Sequence
  Synthetic
tgctgtgaactgtgtattcat

SEQ ID NO: 34504 - DNA, 20 bp, Artificial Sequence
  Synthetic
gcccgtctttagaaagagcg

SEQ ID NO: 34505 - DNA, 16 bp, Artificial Sequence
  Synthetic
tcttttccccccgccg

SEQ ID NO: 34506 - DNA, 16 bp, Artificial Sequence
  Synthetic
aggaagccggagccct

SEQ ID NO: 34507 - DNA, 16 bp, Artificial Sequence
  Synthetic
tatcggggcggatcgg

SEQ ID NO: 34508 - DNA, 16 bp, Artificial Sequence
  Synthetic
ggagcgttgccgtgga

SEQ ID NO: 34509 - DNA, 16 bp, Artificial Sequence
  Synthetic
tcgtgttcgtcggcgg

SEQ ID NO: 34510 - DNA, 16 bp, Artificial Sequence
  Synthetic
acaacggtcccgccac

SEQ ID NO: 34511 - DNA, 20 bp, Artificial Sequence
  Synthetic
tttcgccgtgtctttcgata

SEQ ID NO: 34512 - DNA, 20 bp, Artificial Sequence
  Synthetic
gagtgcggggagatatacgc

SEQ ID NO: 34513 - DNA, 16 bp, Artificial Sequence
  Synthetic
ttggcgctctcgtggc

SEQ ID NO: 34514 - DNA, 23 bp, Artificial Sequence
  Synthetic
gtgtgtgataattttgagcaatt

SEQ ID NO: 34515 - DNA, 21 bp, Artificial Sequence
  Synthetic
tgttgcgattatagctagcat

SEQ ID NO: 34516 - DNA, 23 bp, Artificial Sequence
  Synthetic
agcatttattaagttggaaaacg

SEQ ID NO: 34517 - DNA, 19 bp, Artificial Sequence
  Synthetic
aaatgatttcagcgtctgc

SEQ ID NO: 34518 - DNA, 19 bp, Artificial Sequence
  Synthetic
gggagaagacgaacgattc

SEQ ID NO: 34519 - DNA, 22 bp, Artificial Sequence
  Synthetic
tgtcagttttgtaatgtgtctt

SEQ ID NO: 34520 - DNA, 19 bp, Artificial Sequence
  Synthetic
ggttgttttcggagactct

SEQ ID NO: 34521 - DNA, 20 bp, Artificial Sequence
  Synthetic
ttcgtgaaggttatgtacgt

SEQ ID NO: 34522 - DNA, 21 bp, Artificial Sequence
  Synthetic
tttgtcgttttcagcagtttg

SEQ ID NO: 34523 - DNA, 19 bp, Artificial Sequence
  Synthetic
tcctcacgaataccgaaat

SEQ ID NO: 34524 - DNA, 21 bp, Artificial Sequence
  Synthetic
gcaatttaacctggatcactc

SEQ ID NO: 34525 - DNA, 18 bp, Artificial Sequence
  Synthetic
ctttctttgcagtgcgtc

SEQ ID NO: 34526 - DNA, 18 bp, Artificial Sequence
  Synthetic
caacttcacccagcatct

SEQ ID NO: 34527 - DNA, 23 bp, Artificial Sequence
  Synthetic
gcatttacatccagatttcgata

SEQ ID NO: 34528 - DNA, 20 bp, Artificial Sequence
  Synthetic
attccggaaaccattcaact

SEQ ID NO: 34529 - DNA, 18 bp, Artificial Sequence
  Synthetic
agaactgcgactcaatcc

SEQ ID NO: 34530 - DNA, 18 bp, Artificial Sequence
  Synthetic
tatccctcgcacgacatt

SEQ ID NO: 34531 - DNA, 20 bp, Artificial Sequence
  Synthetic
accaaatgttcgaaaggaaa

SEQ ID NO: 34532 - DNA, 21 bp, Artificial Sequence
  Synthetic
accccctctataatagaccaa

SEQ ID NO: 34533 - DNA, 20 bp, Artificial Sequence
  Synthetic
aaatccaaacaagcaaatgc

SEQ ID NO: 34534 - DNA, 17 bp, Artificial Sequence
  Synthetic
cggagtgcgacaggaga

SEQ ID NO: 34535 - DNA, 18 bp, Artificial Sequence
  Synthetic
cgttccatgtgtctccgg

SEQ ID NO: 34536 - DNA, 16 bp, Artificial Sequence
  Synthetic
gcggatctggccctca

SEQ ID NO: 34537 - DNA, 16 bp, Artificial Sequence
  Synthetic
actaccgcgtggctga

SEQ ID NO: 34538 - DNA, 20 bp, Artificial Sequence
  Synthetic
gtcgaacagatgtctgacgt

SEQ ID NO: 34539 - DNA, 20 bp, Artificial Sequence
  Synthetic
tcctgttgtatatgaggccc

SEQ ID NO: 34540 - DNA, 18 bp, Artificial Sequence
  Synthetic
gcactctgctgttccttt

SEQ ID NO: 34541 - DNA, 20 bp, Artificial Sequence
  Synthetic
tgtctcgctggattcctctt

SEQ ID NO: 34542 - DNA, 21 bp, Artificial Sequence
  Synthetic
aatggtgaaatttctccaact

SEQ ID NO: 34543 - DNA, 24 bp, Artificial Sequence
  Synthetic
tcaattaaccaccttatttcctca

SEQ ID NO: 34544 - DNA, 18 bp, Artificial Sequence
  Synthetic
tgcaacgtaggcaatgtt

SEQ ID NO: 34545 - DNA, 19 bp, Artificial Sequence
  Synthetic
tccacgaatcttgcagttt

SEQ ID NO: 34546 - DNA, 18 bp, Artificial Sequence
  Synthetic
tggactactaggcgaact

SEQ ID NO: 34547 - DNA, 24 bp, Artificial Sequence
  Synthetic
atctaccatatcatatccactgtc

SEQ ID NO: 34548 - DNA, 22 bp, Artificial Sequence
  Synthetic
aaactgtctaaccaaatcgtga

SEQ ID NO: 34549 - DNA, 18 bp, Artificial Sequence
  Synthetic
caaaataaagccgctgca

SEQ ID NO: 34550 - DNA, 23 bp, Artificial Sequence
  Synthetic
cctataatgcttacacatagctg

SEQ ID NO: 34551 - DNA, 18 bp, Artificial Sequence
  Synthetic
taaacttggcaccacctg

SEQ ID NO: 34552 - DNA, 23 bp, Artificial Sequence
  Synthetic
gcattatgttcattacagtcaaa

SEQ ID NO: 34553 - DNA, 25 bp, Artificial Sequence
  Synthetic
ctttgttagcctatatctaaaacac

SEQ ID NO: 34554 - DNA, 18 bp, Artificial Sequence
  Synthetic
agaggaatgcgacacaat

SEQ ID NO: 34555 - DNA, 18 bp, Artificial Sequence
  Synthetic
gctaatatgcgctttcgg

SEQ ID NO: 34556 - DNA, 18 bp, Artificial Sequence
  Synthetic
cctcaacaccaacacagg

SEQ ID NO: 34557 - DNA, 18 bp, Artificial Sequence
  Synthetic
atcaaccatgtcgccatc

SEQ ID NO: 34558 - DNA, 23 bp, Artificial Sequence
  Synthetic
acattctcacacataaacaacat

SEQ ID NO: 34559 - DNA, 22 bp, Artificial Sequence
  Synthetic
ttaaccatagtgttatgtggtg

SEQ ID NO: 34560 - DNA, 19 bp, Artificial Sequence
  Synthetic
ctgtcaatgccttcttgca

SEQ ID NO: 34561 - DNA, 18 bp, Artificial Sequence
  Synthetic
gacccggtccacatatgt

SEQ ID NO: 34562 - DNA, 23 bp, Artificial Sequence
  Synthetic
gtgtttcaattaggtaacaagga

SEQ ID NO: 34563 - DNA, 18 bp, Artificial Sequence
  Synthetic
tattgccatacccgctgt

SEQ ID NO: 34564 - DNA, 20 bp, Artificial Sequence
  Synthetic
aactctgaaaatggtatgcc

SEQ ID NO: 34565 - DNA, 23 bp, Artificial Sequence
  Synthetic
gtcttttacatattttgcttgca

SEQ ID NO: 34566 - DNA, 18 bp, Artificial Sequence
  Synthetic
tacccgtgtttggaggac

SEQ ID NO: 34567 - DNA, 22 bp, Artificial Sequence
  Synthetic
gctatctctttcaaaacagtct

SEQ ID NO: 34568 - DNA, 22 bp, Artificial Sequence
  Synthetic
gtcgggacaataaatactttgt

SEQ ID NO: 34569 - DNA, 20 bp, Artificial Sequence
  Synthetic
gggaggtgttttctggtgtt

SEQ ID NO: 34570 - DNA, 23 bp, Artificial Sequence
  Synthetic
acattacatatcaacacatgtca

SEQ ID NO: 34571 - DNA, 23 bp, Artificial Sequence
  Synthetic
ccacaacaaaccaaaataaaagt

SEQ ID NO: 34572 - DNA, 23 bp, Artificial Sequence
  Synthetic
ataggagtactactgataggttc

SEQ ID NO: 34573 - DNA, 18 bp, Artificial Sequence
  Synthetic
atagtggcctttgtgcca

SEQ ID NO: 34574 - DNA, 20 bp, Artificial Sequence
  Synthetic
tttacataggcatccgttgt

SEQ ID NO: 34575 - DNA, 21 bp, Artificial Sequence
  Synthetic
gcaaattgacctcccaaaatt

SEQ ID NO: 34576 - DNA, 21 bp, Artificial Sequence
  Synthetic
actagacagatacttggctag

SEQ ID NO: 34577 - DNA, 20 bp, Artificial Sequence
  Synthetic
atctgttgtttttgccctgt

SEQ ID NO: 34578 - DNA, 18 bp, Artificial Sequence
  Synthetic
ggttagccgcattcaggg

SEQ ID NO: 34579 - DNA, 19 bp, Artificial Sequence
  Synthetic
ttaagtaatgcggccagac

SEQ ID NO: 34580 - DNA, 25 bp, Artificial Sequence
  Synthetic
cggaatagatatttctttagtagga

SEQ ID NO: 34581 - DNA, 18 bp, Artificial Sequence
  Synthetic
tgtttgcagtcccacaaa

SEQ ID NO: 34582 - DNA, 21 bp, Artificial Sequence
  Synthetic
ccaacatgtgatataaccagc

SEQ ID NO: 34583 - DNA, 18 bp, Artificial Sequence
  Synthetic
agcaatacaaggcaccaa

SEQ ID NO: 34584 - DNA, 20 bp, Artificial Sequence
  Synthetic
acgctaccatacttggaaga

SEQ ID NO: 34585 - DNA, 25 bp, Artificial Sequence
  Synthetic
ccttcttactaatgttattgattgg

SEQ ID NO: 34586 - DNA, 21 bp, Artificial Sequence
  Synthetic
cagcattacacatttcagtga

SEQ ID NO: 34587 - DNA, 24 bp, Artificial Sequence
  Synthetic
tgttctaactgattgtaacagatc

SEQ ID NO: 34588 - DNA, 23 bp, Artificial Sequence
  Synthetic
ttgtatatggcaatgatagttgg

SEQ ID NO: 34589 - DNA, 18 bp, Artificial Sequence
  Synthetic
tacaagttctacacggcc

SEQ ID NO: 34590 - DNA, 21 bp, Artificial Sequence
  Synthetic
catgaatagctctatcgcatt

SEQ ID NO: 34591 - DNA, 22 bp, Artificial Sequence
  Synthetic
tgtacattcattagtgtgcaaa

SEQ ID NO: 34592 - DNA, 19 bp, Artificial Sequence
  Synthetic
gtgcaatcggtttccaatc

SEQ ID NO: 34593 - DNA, 19 bp, Artificial Sequence
  Synthetic
aggttcaccatcatcagtt

SEQ ID NO: 34594 - DNA, 20 bp, Artificial Sequence
  Synthetic
ccacttcataaggttgcttt

SEQ ID NO: 34595 - DNA, 18 bp, Artificial Sequence
  Synthetic
ttcctctggagaaggcgc

SEQ ID NO: 34596 - DNA, 22 bp, Artificial Sequence
  Synthetic
aaaccatttaagaagtcgatca

SEQ ID NO: 34597 - DNA, 21 bp, Artificial Sequence
  Synthetic
tgttaaatgtgtacctgaagg

SEQ ID NO: 34598 - DNA, 18 bp, Artificial Sequence
  Synthetic
tagaccgcttctggttgt

SEQ ID NO: 34599 - DNA, 18 bp, Artificial Sequence
  Synthetic
ttgccgttgtctcgtaac

SEQ ID NO: 34600 - DNA, 19 bp, Artificial Sequence
  Synthetic
ccagtattctccccatgga

SEQ ID NO: 34601 - DNA, 19 bp, Artificial Sequence
  Synthetic
cattgtttgtaccctgagc

SEQ ID NO: 34602 - DNA, 20 bp, Artificial Sequence
  Synthetic
gcactctttttctggacaaa

SEQ ID NO: 34603 - DNA, 20 bp, Artificial Sequence
  Synthetic
cggaaggattctacgtggag

SEQ ID NO: 34604 - DNA, 21 bp, Artificial Sequence
  Synthetic
atacttaatcacggatccacc

SEQ ID NO: 34605 - DNA, 18 bp, Artificial Sequence
  Synthetic
aagtatttgggccactcc

SEQ ID NO: 34606 - DNA, 22 bp, Artificial Sequence
  Synthetic
gccactattagacaaccactat

SEQ ID NO: 34607 - DNA, 18 bp, Artificial Sequence
  Synthetic
cctgagcatgttgtccat

SEQ ID NO: 34608 - DNA, 21 bp, Artificial Sequence
  Synthetic
tatgtttgtgatcctaccagg

SEQ ID NO: 34609 - DNA, 22 bp, Artificial Sequence
  Synthetic
ggtgtgtatgctagcaaaaatt

SEQ ID NO: 34610 - DNA, 25 bp, Artificial Sequence
  Synthetic
atttgagttgattacatacctagtc

SEQ ID NO: 34611 - DNA, 21 bp, Artificial Sequence
  Synthetic
tcaatactatctggtgcatct

SEQ ID NO: 34612 - DNA, 21 bp, Artificial Sequence
  Synthetic
actctaatgctgtgttcattg

SEQ ID NO: 34613 - DNA, 20 bp, Artificial Sequence
  Synthetic
gttttgtcattcaagctggt

SEQ ID NO: 34614 - DNA, 18 bp, Artificial Sequence
  Synthetic
taacttccctccgcagtc

SEQ ID NO: 34615 - DNA, 20 bp, Artificial Sequence
  Synthetic
gtgcactgatgatacgtact

SEQ ID NO: 34616 - DNA, 23 bp, Artificial Sequence
  Synthetic
gcagtctatttttaagccattct

SEQ ID NO: 34617 - DNA, 20 bp, Artificial Sequence
  Synthetic
gggggaatgaaattagtggt

SEQ ID NO: 34618 - DNA, 21 bp, Artificial Sequence
  Synthetic
gcaaaggacaacattgtttgt

SEQ ID NO: 34619 - DNA, 20 bp, Artificial Sequence
  Synthetic
tgacataagcaaaatctcgc

SEQ ID NO: 34620 - DNA, 23 bp, Artificial Sequence
  Synthetic
ggttaaattctcctttgtcagtg

SEQ ID NO: 34621 - DNA, 19 bp, Artificial Sequence
  Synthetic
aaatgatggcaccttgttc

SEQ ID NO: 34622 - DNA, 19 bp, Artificial Sequence
  Synthetic
gcttgttccatggtgattg

SEQ ID NO: 34623 - DNA, 18 bp, Artificial Sequence
  Synthetic
tcattgacactagcagcc

SEQ ID NO: 34624 - DNA, 21 bp, Artificial Sequence
  Synthetic
ctgatctaacactttcccaag

SEQ ID NO: 34625 - DNA, 18 bp, Artificial Sequence
  Synthetic
cttctccattgtgccagg

SEQ ID NO: 34626 - DNA, 21 bp, Artificial Sequence
  Synthetic
cctttcaggaatcatctccat

SEQ ID NO: 34627 - DNA, 23 bp, Artificial Sequence
  Synthetic
cgtattttaacttggtttcggaa

SEQ ID NO: 34628 - DNA, 18 bp, Artificial Sequence
  Synthetic
tacacactgcttgttccg

SEQ ID NO: 34629 - DNA, 22 bp, Artificial Sequence
  Synthetic
gattgattgttcatctcttcca

SEQ ID NO: 34630 - DNA, 22 bp, Artificial Sequence
  Synthetic
tcatgtcaggtaatattccgat

SEQ ID NO: 34631 - DNA, 22 bp, Artificial Sequence
  Synthetic
taagtgttaacaagcactgact

SEQ ID NO: 34632 - DNA, 19 bp, Artificial Sequence
  Synthetic
gcgccaccatgtcctaatt

SEQ ID NO: 34633 - DNA, 21 bp, Artificial Sequence
  Synthetic
taaactttgggagcacagttt

SEQ ID NO: 34634 - DNA, 20 bp, Artificial Sequence
  Synthetic
agcttatcctcctcttccaa

SEQ ID NO: 34635 - DNA, 22 bp, Artificial Sequence
  Synthetic
tagcctctcttacatttactcc

SEQ ID NO: 34636 - DNA, 20 bp, Artificial Sequence
  Synthetic
cgcccatgagtcataaacca

SEQ ID NO: 34637 - DNA, 24 bp, Artificial Sequence
  Synthetic
aaaatttaaagaatctagcaggcc

SEQ ID NO: 34638 - DNA, 18 bp, Artificial Sequence
  Synthetic
cctcgggttctcgtccat

SEQ ID NO: 34639 - DNA, 19 bp, Artificial Sequence
  Synthetic
cccatcatgcaacacctga

SEQ ID NO: 34640 - DNA, 20 bp, Artificial Sequence
  Synthetic
tgttgtacatgcgctcatcc

SEQ ID NO: 34641 - DNA, 18 bp, Artificial Sequence
  Synthetic
tcacatccagggccactg

SEQ ID NO: 34642 - DNA, 16 bp, Artificial Sequence
  Synthetic
aggccagtctcgtcgc

SEQ ID NO: 34643 - DNA, 18 bp, Artificial Sequence
  Synthetic
catcatccagcaccacgc

SEQ ID NO: 34644 - DNA, 20 bp, Artificial Sequence
  Synthetic
ggcgtctccaaattcttcca

SEQ ID NO: 34645 - DNA, 18 bp, Artificial Sequence
  Synthetic
aaccaggtagcccccctc

SEQ ID NO: 34646 - DNA, 18 bp, Artificial Sequence
  Synthetic
ggaccctgagaccctgga

SEQ ID NO: 34647 - DNA, 18 bp, Artificial Sequence
  Synthetic
gctcacctggcttgtcga

SEQ ID NO: 34648 - DNA, 19 bp, Artificial Sequence
  Synthetic
gcacacggtggaaaaggtg

SEQ ID NO: 34649 - DNA, 18 bp, Artificial Sequence
  Synthetic
tccaacgccctctatggc

SEQ ID NO: 34650 - DNA, 17 bp, Artificial Sequence
  Synthetic
acctttttgctcgcgca

SEQ ID NO: 34651 - DNA, 19 bp, Artificial Sequence
  Synthetic
ccatctttcgccagatcgt

SEQ ID NO: 34652 - DNA, 20 bp, Artificial Sequence
  Synthetic
ccgattttgagctctgggag

SEQ ID NO: 34653 - DNA, 18 bp, Artificial Sequence
  Synthetic
tgcaagccaacccacatc

SEQ ID NO: 34654 - DNA, 18 bp, Artificial Sequence
  Synthetic
cggctctcatcctcgcac

SEQ ID NO: 34655 - DNA, 16 bp, Artificial Sequence
  Synthetic
ttggacctggctcccg

SEQ ID NO: 34656 - DNA, 20 bp, Artificial Sequence
  Synthetic
cagttcatgtccgagatcgc

SEQ ID NO: 34657 - DNA, 18 bp, Artificial Sequence
  Synthetic
gcgacatcagcgaaatgc

SEQ ID NO: 34658 - DNA, 16 bp, Artificial Sequence
  Synthetic
tcgcgaacagggtcgc

SEQ ID NO: 34659 - DNA, 19 bp, Artificial Sequence
  Synthetic
cgcctcaaaaacgcctact

SEQ ID NO: 34660 - DNA, 16 bp, Artificial Sequence
  Synthetic
gggcctaccaccgctt

SEQ ID NO: 34661 - DNA, 17 bp, Artificial Sequence
  Synthetic
cctaccgctgcgcaaca

SEQ ID NO: 34662 - DNA, 20 bp, Artificial Sequence
  Synthetic
gcaaaaaaggctcttcaccg

SEQ ID NO: 34663 - DNA, 20 bp, Artificial Sequence
  Synthetic
ccaagtccatctctgtctgc

SEQ ID NO: 34664 - DNA, 17 bp, Artificial Sequence
  Synthetic
gcttgctgtccgggttt

SEQ ID NO: 34665 - DNA, 16 bp, Artificial Sequence
  Synthetic
tcgcggtcgctcagct

SEQ ID NO: 34666 - DNA, 19 bp, Artificial Sequence
  Synthetic
gtcgtcagggccataatgc

SEQ ID NO: 34667 - DNA, 16 bp, Artificial Sequence
  Synthetic
cccaggccctcgttct

SEQ ID NO: 34668 - DNA, 16 bp, Artificial Sequence
  Synthetic
tacgctgccgctgtcg

SEQ ID NO: 34669 - DNA, 16 bp, Artificial Sequence
  Synthetic
cgcggtcatgtccagc

SEQ ID NO: 34670 - DNA, 16 bp, Artificial Sequence
  Synthetic
gcgctgtccacgtcgt

SEQ ID NO: 34671 - DNA, 16 bp, Artificial Sequence
  Synthetic
tgcgcgaacgggttgg

SEQ ID NO: 34672 - DNA, 18 bp, Artificial Sequence
  Synthetic
tggtgtcgtactgcggag

SEQ ID NO: 34673 - DNA, 18 bp, Artificial Sequence
  Synthetic
atgcccaggaggttgctc

SEQ ID NO: 34674 - DNA, 21 bp, Artificial Sequence
  Synthetic
taacttctgttgctgtcatcc

SEQ ID NO: 34675 - DNA, 20 bp, Artificial Sequence
  Synthetic
cggatgagctgggagtagac

SEQ ID NO: 34676 - DNA, 17 bp, Artificial Sequence
  Synthetic
agtaagaccccagccgg

SEQ ID NO: 34677 - DNA, 16 bp, Artificial Sequence
  Synthetic
ggctcttgcgtctggc

SEQ ID NO: 34678 - DNA, 20 bp, Artificial Sequence
  Synthetic
gggggaggacacaagcatta

SEQ ID NO: 34679 - DNA, 17 bp, Artificial Sequence
  Synthetic
tcgccgtacacctcgtc

SEQ ID NO: 34680 - DNA, 19 bp, Artificial Sequence
  Synthetic
gtcggtggggatctgaatg

SEQ ID NO: 34681 - DNA, 16 bp, Artificial Sequence
  Synthetic
aataccgggtgccgcg

SEQ ID NO: 34682 - DNA, 17 bp, Artificial Sequence
  Synthetic
tggggataagcgcaggc

SEQ ID NO: 34683 - DNA, 18 bp, Artificial Sequence
  Synthetic
ttccaggccttgttccca

SEQ ID NO: 34684 - DNA, 16 bp, Artificial Sequence
  Synthetic
tgtggtgggcatgccg

SEQ ID NO: 34685 - DNA, 20 bp, Artificial Sequence
  Synthetic
agctctccctttagtgtcct

SEQ ID NO: 34686 - DNA, 18 bp, Artificial Sequence
  Synthetic
agtacgtggtgtcctcgc

SEQ ID NO: 34687 - DNA, 18 bp, Artificial Sequence
  Synthetic
cttgaggttctggctgat

SEQ ID NO: 34688 - DNA, 22 bp, Artificial Sequence
  Synthetic
aagcaatagtttggaagttcat

SEQ ID NO: 34689 - DNA, 18 bp, Artificial Sequence
  Synthetic
tccatggggtccagtgac

SEQ ID NO: 34690 - DNA, 16 bp, Artificial Sequence
  Synthetic
agggtggaggcggtgt

SEQ ID NO: 34691 - DNA, 19 bp, Artificial Sequence
  Synthetic
ggtccttgtagccctcagg

SEQ ID NO: 34692 - DNA, 19 bp, Artificial Sequence
  Synthetic
ccctgtcgcagaggaactt

SEQ ID NO: 34693 - DNA, 16 bp, Artificial Sequence
  Synthetic
aagtagggcccgcagc

SEQ ID NO: 34694 - DNA, 16 bp, Artificial Sequence
  Synthetic
gcacggtctgggtgga

SEQ ID NO: 34695 - DNA, 15 bp, Artificial Sequence
  Synthetic
ttcaatggcggcgcg

SEQ ID NO: 34696 - DNA, 17 bp, Artificial Sequence
  Synthetic
cgtgtaccgcaactcgc

SEQ ID NO: 34697 - DNA, 18 bp, Artificial Sequence
  Synthetic
gggtgcgggaataaccag

SEQ ID NO: 34698 - DNA, 16 bp, Artificial Sequence
  Synthetic
cgggatcgcgcacaaa

SEQ ID NO: 34699 - DNA, 18 bp, Artificial Sequence
  Synthetic
aaacgcattgtccagccc

SEQ ID NO: 34700 - DNA, 16 bp, Artificial Sequence
  Synthetic
tatccgccggagcagg

SEQ ID NO: 34701 - DNA, 18 bp, Artificial Sequence
  Synthetic
ctggcgctgcaagtgttt

SEQ ID NO: 34702 - DNA, 18 bp, Artificial Sequence
  Synthetic
tgtggggcatgatgagct

SEQ ID NO: 34703 - DNA, 16 bp, Artificial Sequence
  Synthetic
cgtgcctcgcccttga

SEQ ID NO: 34704 - DNA, 20 bp, Artificial Sequence
  Synthetic
gcggtagttttgcaacatgc

SEQ ID NO: 34705 - DNA, 17 bp, Artificial Sequence
  Synthetic
gacctgggtctcgctca

SEQ ID NO: 34706 - DNA, 18 bp, Artificial Sequence
  Synthetic
taagcacttcgcccgtct

SEQ ID NO: 34707 - DNA, 19 bp, Artificial Sequence
  Synthetic
caggcaataatcgcggctt

SEQ ID NO: 34708 - DNA, 18 bp, Artificial Sequence
  Synthetic
cggcgtcttcaagagtgc

SEQ ID NO: 34709 - DNA, 20 bp, Artificial Sequence
  Synthetic
gagctcaccaactcgttgtt

SEQ ID NO: 34710 - DNA, 19 bp, Artificial Sequence
  Synthetic
gccgagtcaccataggaca

SEQ ID NO: 34711 - DNA, 18 bp, Artificial Sequence
  Synthetic
ttcttgtggggtttgcag

SEQ ID NO: 34712 - DNA, 22 bp, Artificial Sequence
  Synthetic
aaatgtaatgttgagagggcat

SEQ ID NO: 34713 - DNA, 24 bp, Artificial Sequence
  Synthetic
ggttaaagtattcatggtactgta

SEQ ID NO: 34714 - DNA, 21 bp, Artificial Sequence
  Synthetic
ggtggtatgactgtaacctta

SEQ ID NO: 34715 - DNA, 20 bp, Artificial Sequence
  Synthetic
agttcgccatcataccaaat

SEQ ID NO: 34716 - DNA, 18 bp, Artificial Sequence
  Synthetic
tagagttacaaagcccgc

SEQ ID NO: 34717 - DNA, 18 bp, Artificial Sequence
  Synthetic
tagacccccttccacttg

SEQ ID NO: 34718 - DNA, 20 bp, Artificial Sequence
  Synthetic
tttggctacgttcttgtccc

SEQ ID NO: 34719 - DNA, 22 bp, Artificial Sequence
  Synthetic
tcttctaagtactgaatcaggg

SEQ ID NO: 34720 - DNA, 18 bp, Artificial Sequence
  Synthetic
taggaggtcgcgaagtcc

SEQ ID NO: 34721 - DNA, 23 bp, Artificial Sequence
  Synthetic
cgtctaaagcaatacctaatttg

SEQ ID NO: 34722 - DNA, 21 bp, Artificial Sequence
  Synthetic
ccaaagttagcttagagtcct

SEQ ID NO: 34723 - DNA, 25 bp, Artificial Sequence
  Synthetic
gcccaactaaaatcaaatgtaatag

SEQ ID NO: 34724 - DNA, 20 bp, Artificial Sequence
  Synthetic
tcaaaggacggcttcatctc

SEQ ID NO: 34725 - DNA, 21 bp, Artificial Sequence
  Synthetic
attgtgaacagaaatatgccc

SEQ ID NO: 34726 - DNA, 20 bp, Artificial Sequence
  Synthetic
tttgactgaacaacaccctc

SEQ ID NO: 34727 - DNA, 18 bp, Artificial Sequence
  Synthetic
tttcaccaacacagcggc

SEQ ID NO: 34728 - DNA, 19 bp, Artificial Sequence
  Synthetic
gttttaaacacgctgcagg

SEQ ID NO: 34729 - DNA, 22 bp, Artificial Sequence
  Synthetic
ctttgtgtttttcagactttca

SEQ ID NO: 34730 - DNA, 24 bp, Artificial Sequence
  Synthetic
ggtattggtttacctaaaagtcag

SEQ ID NO: 34731 - DNA, 23 bp, Artificial Sequence
  Synthetic
ttaagtcacaaaatcgatacgag

SEQ ID NO: 34732 - DNA, 19 bp, Artificial Sequence
  Synthetic
tgcatcatctgtcacactc

SEQ ID NO: 34733 - DNA, 19 bp, Artificial Sequence
  Synthetic
ggttccatcctgtctgaat

SEQ ID NO: 34734 - DNA, 21 bp, Artificial Sequence
  Synthetic
atcagcatctttagctacagc

SEQ ID NO: 34735 - DNA, 22 bp, Artificial Sequence
  Synthetic
atcatttgtctcttcttcaagt

SEQ ID NO: 34736 - DNA, 23 bp, Artificial Sequence
  Synthetic
cattcaccctaagtttttcttac

SEQ ID NO: 34737 - DNA, 21 bp, Artificial Sequence
  Synthetic
ttgagattgctctgtctttgt

SEQ ID NO: 34738 - DNA, 20 bp, Artificial Sequence
  Synthetic
cgattctggtgtttctttca

SEQ ID NO: 34739 - DNA, 21 bp, Artificial Sequence
  Synthetic
gttctctctgatcttgtttgg

SEQ ID NO: 34740 - DNA, 19 bp, Artificial Sequence
  Synthetic
ttcctcttcatttgcggtt

SEQ ID NO: 34741 - DNA, 21 bp, Artificial Sequence
  Synthetic
tgatgtcatctctcagttcat

SEQ ID NO: 34742 - DNA, 21 bp, Artificial Sequence
  Synthetic
caagatacctgactccatgtt

SEQ ID NO: 34743 - DNA, 18 bp, Artificial Sequence
  Synthetic
ctgggagacattgaggtg

SEQ ID NO: 34744 - DNA, 21 bp, Artificial Sequence
  Synthetic
tcttttctccatcatcgtcta

SEQ ID NO: 34745 - DNA, 19 bp, Artificial Sequence
  Synthetic
attctttcggaattgcagg

SEQ ID NO: 34746 - DNA, 22 bp, Artificial Sequence
  Synthetic
tcttcccttttttgttcttgtt

SEQ ID NO: 34747 - DNA, 18 bp, Artificial Sequence
  Synthetic
tgtccttcctggcttctc

SEQ ID NO: 34748 - DNA, 21 bp, Artificial Sequence
  Synthetic
gaagctctgtatatcaacacg

SEQ ID NO: 34749 - DNA, 18 bp, Artificial Sequence
  Synthetic
cccaagtagtgtctcgtc

SEQ ID NO: 34750 - DNA, 20 bp, Artificial Sequence
  Synthetic
gaattgtcatttcgggttgt

SEQ ID NO: 34751 - DNA, 23 bp, Artificial Sequence
  Synthetic
gtgattaagtttgatgaatacgc

SEQ ID NO: 34752 - DNA, 23 bp, Artificial Sequence
  Synthetic
cccttgagatctaatatgtcaaa

SEQ ID NO: 34753 - DNA, 24 bp, Artificial Sequence
  Synthetic
caagttatcttaagagcatcattg

SEQ ID NO: 34754 - DNA, 18 bp, Artificial Sequence
  Synthetic
tcttggtttcctggtcga

SEQ ID NO: 34755 - DNA, 18 bp, Artificial Sequence
  Synthetic
agtagcccttcccgaaat

SEQ ID NO: 34756 - DNA, 23 bp, Artificial Sequence
  Synthetic
gaaatccagatgatagttctctt

SEQ ID NO: 34757 - DNA, 22 bp, Artificial Sequence
  Synthetic
gtcatccaactgtattaaagca

SEQ ID NO: 34758 - DNA, 23 bp, Artificial Sequence
  Synthetic
gggattattgtaaactgagttgg

SEQ ID NO: 34759 - DNA, 18 bp, Artificial Sequence
  Synthetic
ctctcaaggcaccgaaat

SEQ ID NO: 34760 - DNA, 23 bp, Artificial Sequence
  Synthetic
atcacacgatataatacctgttt

SEQ ID NO: 34761 - DNA, 23 bp, Artificial Sequence
  Synthetic
agaaccaagtatacatagggtta

SEQ ID NO: 34762 - DNA, 22 bp, Artificial Sequence
  Synthetic
agcacttgaaaatttcatctgt

SEQ ID NO: 34763 - DNA, 19 bp, Artificial Sequence
  Synthetic
gctctacaactcctgcatc

SEQ ID NO: 34764 - DNA, 18 bp, Artificial Sequence
  Synthetic
aagtcgcagaacttgtga

SEQ ID NO: 34765 - DNA, 22 bp, Artificial Sequence
  Synthetic
tcacaagaattaacacctgaat

SEQ ID NO: 34766 - DNA, 20 bp, Artificial Sequence
  Synthetic
ccacttccccttttctgaat

SEQ ID NO: 34767 - DNA, 20 bp, Artificial Sequence
  Synthetic
attagctgtcagtccattcg

SEQ ID NO: 34768 - DNA, 19 bp, Artificial Sequence
  Synthetic
gtgttcaatgtcagtgctc

SEQ ID NO: 34769 - DNA, 20 bp, Artificial Sequence
  Synthetic
ccagaaacactcgaggattt

SEQ ID NO: 34770 - DNA, 21 bp, Artificial Sequence
  Synthetic
ggagaggccttattttctcaa

SEQ ID NO: 34771 - DNA, 22 bp, Artificial Sequence
  Synthetic
ggttctgtagaatctattcacc

SEQ ID NO: 34772 - DNA, 23 bp, Artificial Sequence
  Synthetic
cgtgtatctgtagtctttgatga

SEQ ID NO: 34773 - DNA, 18 bp, Artificial Sequence
  Synthetic
attccatgctcttggctg

SEQ ID NO: 34774 - DNA, 21 bp, Artificial Sequence
  Synthetic
tttcttaatccgtccagactc

SEQ ID NO: 34775 - DNA, 18 bp, Artificial Sequence
  Synthetic
tcctttagtgcaaacgcc

SEQ ID NO: 34776 - DNA, 19 bp, Artificial Sequence
  Synthetic
ccgtccactgtccagctat

SEQ ID NO: 34777 - DNA, 18 bp, Artificial Sequence
  Synthetic
ttcaggtctgcgtctccg

SEQ ID NO: 34778 - DNA, 25 bp, Artificial Sequence
  Synthetic
cacacatataggttgtattaaggtt

SEQ ID NO: 34779 - DNA, 22 bp, Artificial Sequence
  Synthetic
ttgtcttactatccattcaggt

SEQ ID NO: 34780 - DNA, 18 bp, Artificial Sequence
  Synthetic
catttttgcctgctctgc

SEQ ID NO: 34781 - DNA, 22 bp, Artificial Sequence
  Synthetic
tcccactttagtatctgctaaa

SEQ ID NO: 34782 - DNA, 18 bp, Artificial Sequence
  Synthetic
tgcttgtcgtgccttaaa

SEQ ID NO: 34783 - DNA, 18 bp, Artificial Sequence
  Synthetic
cactgctttgtggtcctc

SEQ ID NO: 34784 - DNA, 20 bp, Artificial Sequence
  Synthetic
acagacacaaggaacactat

SEQ ID NO: 34785 - DNA, 20 bp, Artificial Sequence
  Synthetic
cgctggattcctctacaagg

SEQ ID NO: 34786 - DNA, 20 bp, Artificial Sequence
  Synthetic
accctcagaggtagcaaagg

SEQ ID NO: 34787 - DNA, 18 bp, Artificial Sequence
  Synthetic
tgcagcagagagggaagg

SEQ ID NO: 34788 - DNA, 22 bp, Artificial Sequence
  Synthetic
tgataactttagacacaggagt

SEQ ID NO: 34789 - DNA, 18 bp, Artificial Sequence
  Synthetic
ccatcaggcaaagcaaat

SEQ ID NO: 34790 - DNA, 18 bp, Artificial Sequence
  Synthetic
ttgtcattcgcaccctta

SEQ ID NO: 34791 - DNA, 23 bp, Artificial Sequence
  Synthetic
gtggctttatattcagatacagg

SEQ ID NO: 34792 - DNA, 19 bp, Artificial Sequence
  Synthetic
aataaaaacttgcgcccca

SEQ ID NO: 34793 - DNA, 22 bp, Artificial Sequence
  Synthetic
acaatacacaaccatagcaaat

SEQ ID NO: 34794 - DNA, 18 bp, Artificial Sequence
  Synthetic
acaaccaaaaaggcgggc

SEQ ID NO: 34795 - DNA, 18 bp, Artificial Sequence
  Synthetic
atgcccaaagttgcaaga

SEQ ID NO: 34796 - DNA, 23 bp, Artificial Sequence
  Synthetic
cctttccattttgtatttcacct

SEQ ID NO: 34797 - DNA, 19 bp, Artificial Sequence
  Synthetic
tgttggcaggattttaggt

SEQ ID NO: 34798 - DNA, 16 bp, Artificial Sequence
  Synthetic
ggctggcagaggtggt

SEQ ID NO: 34799 - DNA, 20 bp, Artificial Sequence
  Synthetic
cagcttgggagttctaggga

SEQ ID NO: 34800 - DNA, 22 bp, Artificial Sequence
  Synthetic
cctcattaaaaacaagtagctg

SEQ ID NO: 34801 - DNA, 20 bp, Artificial Sequence
  Synthetic
ttcttagaaaccctcacacc

SEQ ID NO: 34802 - DNA, 16 bp, Artificial Sequence
  Synthetic
cggtagttggcgcacc

SEQ ID NO: 34803 - DNA, 16 bp, Artificial Sequence
  Synthetic
actacaggccccacgc

SEQ ID NO: 34804 - DNA, 16 bp, Artificial Sequence
  Synthetic
gccaggcccctcaaga

SEQ ID NO: 34805 - DNA, 17 bp, Artificial Sequence
  Synthetic
accgagtccgctccaaa

SEQ ID NO: 34806 - DNA, 18 bp, Artificial Sequence
  Synthetic
tccacgggctttgagact

SEQ ID NO: 34807 - DNA, 20 bp, Artificial Sequence
  Synthetic
gccactagcgcatattttgc

SEQ ID NO: 34808 - DNA, 19 bp, Artificial Sequence
  Synthetic
gcacccggaactatcgttg

SEQ ID NO: 34809 - DNA, 18 bp, Artificial Sequence
  Synthetic
gcagatgacgctctccgg

SEQ ID NO: 34810 - DNA, 17 bp, Artificial Sequence
  Synthetic
gcggctggcgcaaaatt

SEQ ID NO: 34811 - DNA, 23 bp, Artificial Sequence
  Synthetic
tccatgttctgtcatataaacac

SEQ ID NO: 34812 - DNA, 15 bp, Artificial Sequence
  Synthetic
accggaagcgacgct

SEQ ID NO: 34813 - DNA, 19 bp, Artificial Sequence
  Synthetic
gtcctgtggaccaccctat

SEQ ID NO: 34814 - DNA, 20 bp, Artificial Sequence
  Synthetic
gcccagagttttgactctcc

SEQ ID NO: 34815 - DNA, 19 bp, Artificial Sequence
  Synthetic
catgcagcgacctgatctc

SEQ ID NO: 34816 - DNA, 16 bp, Artificial Sequence
  Synthetic
ttgtcgcctctgccgc

SEQ ID NO: 34817 - DNA, 18 bp, Artificial Sequence
  Synthetic
ctgacgtcgtcatcctgc

SEQ ID NO: 34818 - DNA, 18 bp, Artificial Sequence
  Synthetic
ggcatctacagaaggccg

SEQ ID NO: 34819 - DNA, 18 bp, Artificial Sequence
  Synthetic
agccagctgaatcctgct

SEQ ID NO: 34820 - DNA, 18 bp, Artificial Sequence
  Synthetic
gggtctaggctgccatct

SEQ ID NO: 34821 - DNA, 18 bp, Artificial Sequence
  Synthetic
tcgccctcggaaatcgaa

SEQ ID NO: 34822 - DNA, 18 bp, Artificial Sequence
  Synthetic
taccggactccaggaggc

SEQ ID NO: 34823 - DNA, 16 bp, Artificial Sequence
  Synthetic
atcggcgccttgtccg

SEQ ID NO: 34824 - DNA, 19 bp, Artificial Sequence
  Synthetic
acgactagtggcgtgtagg

SEQ ID NO: 34825 - DNA, 19 bp, Artificial Sequence
  Synthetic
gcacgagagttccacgttt

SEQ ID NO: 34826 - DNA, 15 bp, Artificial Sequence
  Synthetic
tcccgacggttgcgt

SEQ ID NO: 34827 - DNA, 18 bp, Artificial Sequence
  Synthetic
gggcagaggaatgtccgg

SEQ ID NO: 34828 - DNA, 17 bp, Artificial Sequence
  Synthetic
cggttccctgcggtaac

SEQ ID NO: 34829 - DNA, 19 bp, Artificial Sequence
  Synthetic
caaagtctgcacgacctcg

SEQ ID NO: 34830 - DNA, 17 bp, Artificial Sequence
  Synthetic
aggagcagcagcaggat

SEQ ID NO: 34831 - DNA, 19 bp, Artificial Sequence
  Synthetic
gctgccagcatttgtgtct

SEQ ID NO: 34832 - DNA, 16 bp, Artificial Sequence
  Synthetic
actacccgcccaccct

SEQ ID NO: 34833 - DNA, 20 bp, Artificial Sequence
  Synthetic
cacacaacagcaagaaacgg

SEQ ID NO: 34834 - DNA, 19 bp, Artificial Sequence
  Synthetic
caagctccaggacgtagtg

SEQ ID NO: 34835 - DNA, 16 bp, Artificial Sequence
  Synthetic
aacggcctcatcgccc

SEQ ID NO: 34836 - DNA, 18 bp, Artificial Sequence
  Synthetic
ggtgtgtctgggcaggtt

SEQ ID NO: 34837 - DNA, 22 bp, Artificial Sequence
  Synthetic
agttcttttattgcaaatgccc

SEQ ID NO: 34838 - DNA, 19 bp, Artificial Sequence
  Synthetic
ggcctccacatgaaaccac

SEQ ID NO: 34839 - DNA, 18 bp, Artificial Sequence
  Synthetic
aaggtcagcacgctaccc

SEQ ID NO: 34840 - DNA, 21 bp, Artificial Sequence
  Synthetic
atactcaaatgcaagcacact

SEQ ID NO: 34841 - DNA, 18 bp, Artificial Sequence
  Synthetic
tatgagataacagcgccg

SEQ ID NO: 34842 - DNA, 21 bp, Artificial Sequence
  Synthetic
gcattatttatcgggtacagg

SEQ ID NO: 34843 - DNA, 20 bp, Artificial Sequence
  Synthetic
cacatctccagacacgtgtc

SEQ ID NO: 34844 - DNA, 16 bp, Artificial Sequence
  Synthetic
actcgttggcgcctgg

SEQ ID NO: 34845 - DNA, 18 bp, Artificial Sequence
  Synthetic
aagtagtccagggctgtg

SEQ ID NO: 34846 - DNA, 19 bp, Artificial Sequence
  Synthetic
agacatggttgcacgttta

SEQ ID NO: 34847 - DNA, 18 bp, Artificial Sequence
  Synthetic
tgtttggggagcctccac

SEQ ID NO: 34848 - DNA, 19 bp, Artificial Sequence
  Synthetic
gtagtggacccccgtagtg

SEQ ID NO: 34849 - DNA, 23 bp, Artificial Sequence
  Synthetic
agccaccttattattactcttct

SEQ ID NO: 34850 - DNA, 22 bp, Artificial Sequence
  Synthetic
attgaaaaaatgacgagtgaac

SEQ ID NO: 34851 - DNA, 24 bp, Artificial Sequence
  Synthetic
ggactgcaaatatctataggtatc

SEQ ID NO: 34852 - DNA, 24 bp, Artificial Sequence
  Synthetic
taacactttaggatgagagcaatt

SEQ ID NO: 34853 - DNA, 22 bp, Artificial Sequence
  Synthetic
gtggggagatatactaacagat

SEQ ID NO: 34854 - DNA, 23 bp, Artificial Sequence
  Synthetic
ttgtaagttctgtaaatgacact

SEQ ID NO: 34855 - DNA, 25 bp, Artificial Sequence
  Synthetic
ggtaattttacttgcatagcattct

SEQ ID NO: 34856 - DNA, 21 bp, Artificial Sequence
  Synthetic
ctagtgtcctgtaatgtccat

SEQ ID NO: 34857 - DNA, 18 bp, Artificial Sequence
  Synthetic
gagatgctggcagtgtcg

SEQ ID NO: 34858 - DNA, 18 bp, Artificial Sequence
  Synthetic
taacagtacccccagcag

SEQ ID NO: 34859 - DNA, 20 bp, Artificial Sequence
  Synthetic
tcttggtgtagtagtggatg

SEQ ID NO: 34860 - DNA, 18 bp, Artificial Sequence
  Synthetic
gggttcgtattgtccctc

SEQ ID NO: 34861 - DNA, 20 bp, Artificial Sequence
  Synthetic
tctgtttaaactcgggtgta

SEQ ID NO: 34862 - DNA, 21 bp, Artificial Sequence
  Synthetic
tgaaactttaggaactgtgac

SEQ ID NO: 34863 - DNA, 18 bp, Artificial Sequence
  Synthetic
ccagtaggagggacacat

SEQ ID NO: 34864 - DNA, 22 bp, Artificial Sequence
  Synthetic
accataaacatcacttgtcatt

SEQ ID NO: 34865 - DNA, 18 bp, Artificial Sequence
  Synthetic
tttaacccctgagccctg

SEQ ID NO: 34866 - DNA, 20 bp, Artificial Sequence
  Synthetic
tgtaattcgtctgcgcttta

SEQ ID NO: 34867 - DNA, 18 bp, Artificial Sequence
  Synthetic
actatttagggggtggcc

SEQ ID NO: 34868 - DNA, 21 bp, Artificial Sequence
  Synthetic
aggctcaagatctagttcaat

SEQ ID NO: 34869 - DNA, 23 bp, Artificial Sequence
  Synthetic
ggacttttcacatactttcgttt

SEQ ID NO: 34870 - DNA, 20 bp, Artificial Sequence
  Synthetic
tgcacgtctgttattgctaa

SEQ ID NO: 34871 - DNA, 21 bp, Artificial Sequence
  Synthetic
catgcatagtgataggcaatt

SEQ ID NO: 34872 - DNA, 19 bp, Artificial Sequence
  Synthetic
tccctagcttctgcctgaa

SEQ ID NO: 34873 - DNA, 18 bp, Artificial Sequence
  Synthetic
atcttctactgcagcacg

SEQ ID NO: 34874 - DNA, 19 bp, Artificial Sequence
  Synthetic
gtttgtggtgcctctagat

SEQ ID NO: 34875 - DNA, 23 bp, Artificial Sequence
  Synthetic
gtttgtacatctaaaatagcagg

SEQ ID NO: 34876 - DNA, 19 bp, Artificial Sequence
  Synthetic
tgctagttttgggttcact

SEQ ID NO: 34877 - DNA, 19 bp, Artificial Sequence
  Synthetic
cctgtctgcagtttcagaa

SEQ ID NO: 34878 - DNA, 18 bp, Artificial Sequence
  Synthetic
tacccacacagccatctg

SEQ ID NO: 34879 - DNA, 20 bp, Artificial Sequence
  Synthetic
actggttaggatctggaaga

SEQ ID NO: 34880 - DNA, 20 bp, Artificial Sequence
  Synthetic
cagcaggtttacatcctact

SEQ ID NO: 34881 - DNA, 18 bp, Artificial Sequence
  Synthetic
gccccatgcaataccatt

SEQ ID NO: 34882 - DNA, 20 bp, Artificial Sequence
  Synthetic
ccaatcttcagcctttgtct

SEQ ID NO: 34883 - DNA, 19 bp, Artificial Sequence
  Synthetic
cattgttggtgcagttgtt

SEQ ID NO: 34884 - DNA, 18 bp, Artificial Sequence
  Synthetic
agctgcataatgggtcag

SEQ ID NO: 34885 - DNA, 22 bp, Artificial Sequence
  Synthetic
gcataggaatgatatgtgtcag

SEQ ID NO: 34886 - DNA, 21 bp, Artificial Sequence
  Synthetic
tctttttgctgtgtaactgtt

SEQ ID NO: 34887 - DNA, 24 bp, Artificial Sequence
  Synthetic
atactttacatacagttccatccc

SEQ ID NO: 34888 - DNA, 23 bp, Artificial Sequence
  Synthetic
accattcctctattataaagcca

SEQ ID NO: 34889 - DNA, 18 bp, Artificial Sequence
  Synthetic
aacaggtctagccatgtg

SEQ ID NO: 34890 - DNA, 19 bp, Artificial Sequence
  Synthetic
ccttggataagctcctcct

SEQ ID NO: 34891 - DNA, 21 bp, Artificial Sequence
  Synthetic
aaatcactacagtctgcttca

SEQ ID NO: 34892 - DNA, 23 bp, Artificial Sequence
  Synthetic
gagatattgacatagactgcaac

SEQ ID NO: 34893 - DNA, 24 bp, Artificial Sequence
  Synthetic
cctgattattatgtgctaaccaag

SEQ ID NO: 34894 - DNA, 23 bp, Artificial Sequence
  Synthetic
tgtccattaacatctcttgtagt

SEQ ID NO: 34895 - DNA, 21 bp, Artificial Sequence
  Synthetic
agtccacttttcttttccaaa

SEQ ID NO: 34896 - DNA, 19 bp, Artificial Sequence
  Synthetic
caggagcaaacacagtttc

SEQ ID NO: 34897 - DNA, 20 bp, Artificial Sequence
  Synthetic
ggatgagagttcaggtgctc

SEQ ID NO: 34898 - DNA, 16 bp, Artificial Sequence
  Synthetic
aggtgggggtgggtga

SEQ ID NO: 34899 - DNA, 24 bp, Artificial Sequence
  Synthetic
ccaggtggtactataatgttttac

SEQ ID NO: 34900 - DNA, 24 bp, Artificial Sequence
  Synthetic
tcgcctattatatagtgatcttct

SEQ ID NO: 34901 - DNA, 18 bp, Artificial Sequence
  Synthetic
tccctgtggtgtttcaga

SEQ ID NO: 34902 - DNA, 22 bp, Artificial Sequence
  Synthetic
tgggtctacttctattacttga

SEQ ID NO: 34903 - DNA, 19 bp, Artificial Sequence
  Synthetic
agaagtccccagaggtatc

SEQ ID NO: 34904 - DNA, 20 bp, Artificial Sequence
  Synthetic
gtctgctgtatctctcacat

SEQ ID NO: 34905 - DNA, 21 bp, Artificial Sequence
  Synthetic
ctgtttagggtcaaatgaagt

SEQ ID NO: 34906 - DNA, 19 bp, Artificial Sequence
  Synthetic
agataccaaagagccactg

SEQ ID NO: 34907 - DNA, 20 bp, Artificial Sequence
  Synthetic
tttagacactctagaagccc

SEQ ID NO: 34908 - DNA, 20 bp, Artificial Sequence
  Synthetic
tgagatttcgcctacaattg

SEQ ID NO: 34909 - DNA, 18 bp, Artificial Sequence
  Synthetic
gtccatttctgagggcac

SEQ ID NO: 34910 - DNA, 21 bp, Artificial Sequence
  Synthetic
cttcaagagccattaggattt

SEQ ID NO: 34911 - DNA, 20 bp, Artificial Sequence
  Synthetic
gcaaatatactgctccgtca

SEQ ID NO: 34912 - DNA, 18 bp, Artificial Sequence
  Synthetic
cctcctcgaaaagtctcc

SEQ ID NO: 34913 - DNA, 19 bp, Artificial Sequence
  Synthetic
aaccacacctcaacttcaa

SEQ ID NO: 34914 - DNA, 18 bp, Artificial Sequence
  Synthetic
gagggaggtggaaggttc

SEQ ID NO: 34915 - DNA, 25 bp, Artificial Sequence
  Synthetic
ggatcacctatattatatccatcaa

SEQ ID NO: 34916 - DNA, 19 bp, Artificial Sequence
  Synthetic
gctgacaaacgagggctac

SEQ ID NO: 34917 - DNA, 18 bp, Artificial Sequence
  Synthetic
tctacatctagtgcggca

SEQ ID NO: 34918 - DNA, 22 bp, Artificial Sequence
  Synthetic
ctaaaggagcatctgatctact

SEQ ID NO: 34919 - DNA, 22 bp, Artificial Sequence
  Synthetic
gcattggaaaatatgtgctatt

SEQ ID NO: 34920 - DNA, 22 bp, Artificial Sequence
  Synthetic
ttgatccaaatcagaactgaat

SEQ ID NO: 34921 - DNA, 22 bp, Artificial Sequence
  Synthetic
tgcaaaagtttcagtacctttg

SEQ ID NO: 34922 - DNA, 18 bp, Artificial Sequence
  Synthetic
atctgccaaactgcgttc

SEQ ID NO: 34923 - DNA, 19 bp, Artificial Sequence
  Synthetic
cccatacggtacaccaaat

SEQ ID NO: 34924 - DNA, 20 bp, Artificial Sequence
  Synthetic
cactggcattactatcttcg

SEQ ID NO: 34925 - DNA, 19 bp, Artificial Sequence
  Synthetic
ttttcgcatctataccgcc

SEQ ID NO: 34926 - DNA, 22 bp, Artificial Sequence
  Synthetic
acctaatggatcaattggtaca

SEQ ID NO: 34927 - DNA, 21 bp, Artificial Sequence
  Synthetic
attagttttttggatggtggt

SEQ ID NO: 34928 - DNA, 24 bp, Artificial Sequence
  Synthetic
cctattactaatccacttcttgtt

SEQ ID NO: 34929 - DNA, 18 bp, Artificial Sequence
  Synthetic
gtcccaatgttgaccaac

SEQ ID NO: 34930 - DNA, 22 bp, Artificial Sequence
  Synthetic
aaaatgacgagcatataattgc

SEQ ID NO: 34931 - DNA, 25 bp, Artificial Sequence
  Synthetic
ctatatttatcttctaaaccagctg

SEQ ID NO: 34932 - DNA, 18 bp, Artificial Sequence
  Synthetic
gatgtccagatgcttccc

SEQ ID NO: 34933 - DNA, 18 bp, Artificial Sequence
  Synthetic
cgaagattgttgccaaca

SEQ ID NO: 34934 - DNA, 23 bp, Artificial Sequence
  Synthetic
tctaagttaaggtcaatgtctct

SEQ ID NO: 34935 - DNA, 22 bp, Artificial Sequence
  Synthetic
tttccaacattttcagtacctt

SEQ ID NO: 34936 - DNA, 23 bp, Artificial Sequence
  Synthetic
caaaatgtcttttaaactttgcc

SEQ ID NO: 34937 - DNA, 20 bp, Artificial Sequence
  Synthetic
cttttaagaaatgctgctgc

SEQ ID NO: 34938 - DNA, 20 bp, Artificial Sequence
  Synthetic
ctcttcgtcgtctgcgagaa

SEQ ID NO: 34939 - DNA, 19 bp, Artificial Sequence
  Synthetic
agctgtgctcatagaaaca

SEQ ID NO: 34940 - DNA, 20 bp, Artificial Sequence
  Synthetic
gctggatcaatagcatcaat

SEQ ID NO: 34941 - DNA, 18 bp, Artificial Sequence
  Synthetic
tatgtcagcaccttcagg

SEQ ID NO: 34942 - DNA, 18 bp, Artificial Sequence
  Synthetic
cgggaaggcctacttaaa

SEQ ID NO: 34943 - DNA, 21 bp, Artificial Sequence
  Synthetic
gtactaattctattgcagggc

SEQ ID NO: 34944 - DNA, 18 bp, Artificial Sequence
  Synthetic
gtcacccattacacctgc

SEQ ID NO: 34945 - DNA, 18 bp, Artificial Sequence
  Synthetic
cattagttctgcggcgtt

SEQ ID NO: 34946 - DNA, 18 bp, Artificial Sequence
  Synthetic
gcagcaagttttggctac

SEQ ID NO: 34947 - DNA, 23 bp, Artificial Sequence
  Synthetic
aacaataatagttggcaaccatc

SEQ ID NO: 34948 - DNA, 23 bp, Artificial Sequence
  Synthetic
atgatcactgagtttaagttcag

SEQ ID NO: 34949 - DNA, 23 bp, Artificial Sequence
  Synthetic
ttttgaagtagtttgaaagggtc

SEQ ID NO: 34950 - DNA, 18 bp, Artificial Sequence
  Synthetic
agagtgctcgatcccata

SEQ ID NO: 34951 - DNA, 19 bp, Artificial Sequence
  Synthetic
ccggaatgacacttcttct

SEQ ID NO: 34952 - DNA, 18 bp, Artificial Sequence
  Synthetic
acacactgtagctgtagc

SEQ ID NO: 34953 - DNA, 23 bp, Artificial Sequence
  Synthetic
tgttaattaggtaacaaggatgt

SEQ ID NO: 34954 - DNA, 22 bp, Artificial Sequence
  Synthetic
cgtctgtatcaattatccttcg

SEQ ID NO: 34955 - DNA, 22 bp, Artificial Sequence
  Synthetic
ccaattctgaaaatggaattcc

SEQ ID NO: 34956 - DNA, 18 bp, Artificial Sequence
  Synthetic
tggcctgcatattgcttt

SEQ ID NO: 34957 - DNA, 25 bp, Artificial Sequence
  Synthetic
gaaaaaattgtataaggctcatagc

SEQ ID NO: 34958 - DNA, 20 bp, Artificial Sequence
  Synthetic
ataggtgttgtaggtgttgt

SEQ ID NO: 34959 - DNA, 18 bp, Artificial Sequence
  Synthetic
cgatgcaacaacaaacca

SEQ ID NO: 34960 - DNA, 18 bp, Artificial Sequence
  Synthetic
cagatggacatgtgccag

SEQ ID NO: 34961 - DNA, 19 bp, Artificial Sequence
  Synthetic
catgcacagcaaatgtttg

SEQ ID NO: 34962 - DNA, 18 bp, Artificial Sequence
  Synthetic
acttcttgtgcgcattgt

SEQ ID NO: 34963 - DNA, 22 bp, Artificial Sequence
  Synthetic
ttacatatgcatctgttggtac

SEQ ID NO: 34964 - DNA, 20 bp, Artificial Sequence
  Synthetic
attggtatcaggtaacccaa

SEQ ID NO: 34965 - DNA, 25 bp, Artificial Sequence
  Synthetic
tgtaattcatattcctctacatgtc

SEQ ID NO: 34966 - DNA, 21 bp, Artificial Sequence
  Synthetic
cctgtaagttaacatcccaaa

SEQ ID NO: 34967 - DNA, 24 bp, Artificial Sequence
  Synthetic
catacatacagtcatacagaaaca

SEQ ID NO: 34968 - DNA, 19 bp, Artificial Sequence
  Synthetic
ggtaaaatggagggcacaa

SEQ ID NO: 34969 - DNA, 20 bp, Artificial Sequence
  Synthetic
ggttttacacacctgcttta

SEQ ID NO: 34970 - DNA, 19 bp, Artificial Sequence
  Synthetic
gttgtcgttcgcaatacac

SEQ ID NO: 34971 - DNA, 18 bp, Artificial Sequence
  Synthetic
acatctgctgcaatcagt

SEQ ID NO: 34972 - DNA, 22 bp, Artificial Sequence
  Synthetic
atcataattttcatctgctggt

SEQ ID NO: 34973 - DNA, 21 bp, Artificial Sequence
  Synthetic
gctttttaaaaatgcagcagc

SEQ ID NO: 34974 - DNA, 22 bp, Artificial Sequence
  Synthetic
ggtatcatctgctttaggattt

SEQ ID NO: 34975 - DNA, 18 bp, Artificial Sequence
  Synthetic
tgacacgcacttaaacgt

SEQ ID NO: 34976 - DNA, 21 bp, Artificial Sequence
  Synthetic
tgtctgttgtaatgtccattc

SEQ ID NO: 34977 - DNA, 20 bp, Artificial Sequence
  Synthetic
gatggagtagttgtgggtaa

SEQ ID NO: 34978 - DNA, 21 bp, Artificial Sequence
  Synthetic
ggtcagtaaaagttggattgt

SEQ ID NO: 34979 - DNA, 20 bp, Artificial Sequence
  Synthetic
cctaccacctatacgtttgc

SEQ ID NO: 34980 - DNA, 20 bp, Artificial Sequence
  Synthetic
gcgtgtactacctgcataat

SEQ ID NO: 34981 - DNA, 22 bp, Artificial Sequence
  Synthetic
tcaatcatatcaccatcctgta

SEQ ID NO: 34982 - DNA, 19 bp, Artificial Sequence
  Synthetic
agacccactaggagtagga

SEQ ID NO: 34983 - DNA, 22 bp, Artificial Sequence
  Synthetic
tgttaatcctaagtgcttgagt

SEQ ID NO: 34984 - DNA, 19 bp, Artificial Sequence
  Synthetic
gagaggcttcactccattt

SEQ ID NO: 34985 - DNA, 21 bp, Artificial Sequence
  Synthetic
acttttggggatgatctgaat

SEQ ID NO: 34986 - DNA, 19 bp, Artificial Sequence
  Synthetic
ccaatctctggttcagtgt

SEQ ID NO: 34987 - DNA, 18 bp, Artificial Sequence
  Synthetic
ggggtgtatgttgtggaa

SEQ ID NO: 34988 - DNA, 23 bp, Artificial Sequence
  Synthetic
aaactgagtgttcattttgtcaa

SEQ ID NO: 34989 - DNA, 18 bp, Artificial Sequence
  Synthetic
aacaaccattacccagct

SEQ ID NO: 34990 - DNA, 18 bp, Artificial Sequence
  Synthetic
cgatccattggagcacat

SEQ ID NO: 34991 - DNA, 22 bp, Artificial Sequence
  Synthetic
atcactgagtttaagttctgtg

SEQ ID NO: 34992 - DNA, 18 bp, Artificial Sequence
  Synthetic
catgtgagtcagaccagc

SEQ ID NO: 34993 - DNA, 23 bp, Artificial Sequence
  Synthetic
tttgaaatttccctttgagaatg

SEQ ID NO: 34994 - DNA, 19 bp, Artificial Sequence
  Synthetic
tgcttctcagttcaagtgt

SEQ ID NO: 34995 - DNA, 23 bp, Artificial Sequence
  Synthetic
cgtagctagtacatgtaatgcta

SEQ ID NO: 34996 - DNA, 24 bp, Artificial Sequence
  Synthetic
gtaacagaatcttcagtttcattg

SEQ ID NO: 34997 - DNA, 24 bp, Artificial Sequence
  Synthetic
gattagttataatttgccattccc

SEQ ID NO: 34998 - DNA, 19 bp, Artificial Sequence
  Synthetic
tgacactgcatttccatcc

SEQ ID NO: 34999 - DNA, 20 bp, Artificial Sequence
  Synthetic
ttacaaggtcccaatgtact

SEQ ID NO: 35000 - DNA, 21 bp, Artificial Sequence
  Synthetic
agtctatatagtacaggccgt

SEQ ID NO: 35001 - DNA, 21 bp, Artificial Sequence
  Synthetic
actttcaaatagcgccctata

SEQ ID NO: 35002 - DNA, 24 bp, Artificial Sequence
  Synthetic
tcaatagaaaatgtagaagaccct

SEQ ID NO: 35003 - DNA, 18 bp, Artificial Sequence
  Synthetic
atacaagtcagcctcacc

SEQ ID NO: 35004 - DNA, 18 bp, Artificial Sequence
  Synthetic
tagccacaaaccagccat

SEQ ID NO: 35005 - DNA, 20 bp, Artificial Sequence
  Synthetic
ggacaccaactgtaaaggag

SEQ ID NO: 35006 - DNA, 21 bp, Artificial Sequence
  Synthetic
gtgggtattatcaaccaaagt

SEQ ID NO: 35007 - DNA, 18 bp, Artificial Sequence
  Synthetic
gcagaccctgtttgatgt

SEQ ID NO: 35008 - DNA, 22 bp, Artificial Sequence
  Synthetic
aacaacaataagagaaaaaggc

SEQ ID NO: 35009 - DNA, 24 bp, Artificial Sequence
  Synthetic
tgtatgctttctaatccagtcagg

SEQ ID NO: 35010 - DNA, 23 bp, Artificial Sequence
  Synthetic
aagattttgcaaccagaaatggc

SEQ ID NO: 35011 - DNA, 23 bp, Artificial Sequence
  Synthetic
acaagttgccaatgctcaatttg

SEQ ID NO: 35012 - DNA, 21 bp, Artificial Sequence
  Synthetic
tggaggagctgacagaccctt

SEQ ID NO: 35013 - DNA, 22 bp, Artificial Sequence
  Synthetic
ctggctcgtcgttgtctcttgt

SEQ ID NO: 35014 - DNA, 22 bp, Artificial Sequence
  Synthetic
tgttcccctaaagatgtgggat

SEQ ID NO: 35015 - DNA, 22 bp, Artificial Sequence
  Synthetic
acctcttgcaagtcttgttgaa

SEQ ID NO: 35016 - DNA, 20 bp, Artificial Sequence
  Synthetic
gcctggtgtgactaggtctt

SEQ ID NO: 35017 - DNA, 22 bp, Artificial Sequence
  Synthetic
atacaacgtttctggcacatga

SEQ ID NO: 35018 - DNA, 23 bp, Artificial Sequence
  Synthetic
caacgaccacgaactaaatgaca

SEQ ID NO: 35019 - DNA, 22 bp, Artificial Sequence
  Synthetic
cactctacagttgcctgtgcat

SEQ ID NO: 35020 - DNA, 21 bp, Artificial Sequence
  Synthetic
cgtaggaggtggagggcctat

SEQ ID NO: 35021 - DNA, 24 bp, Artificial Sequence
  Synthetic
gttctatgtctcgatcccacttct

SEQ ID NO: 35022 - DNA, 25 bp, Artificial Sequence
  Synthetic
gataatggattataccctgtagccc

SEQ ID NO: 35023 - DNA, 22 bp, Artificial Sequence
  Synthetic
cctctgctacatcctgctcaaa

SEQ ID NO: 35024 - DNA, 21 bp, Artificial Sequence
  Synthetic
cagttaacagtctgccagtgc

SEQ ID NO: 35025 - DNA, 22 bp, Artificial Sequence
  Synthetic
ccacccgggaacttaacgttct

SEQ ID NO: 35026 - DNA, 20 bp, Artificial Sequence
  Synthetic
cggcaaacccgcaggtcatg

SEQ ID NO: 35027 - DNA, 20 bp, Artificial Sequence
  Synthetic
ttaccctcgcgaacgcaagg

SEQ ID NO: 35028 - DNA, 21 bp, Artificial Sequence
  Synthetic
gcatcatgtcccacgccatcc

SEQ ID NO: 35029 - DNA, 22 bp, Artificial Sequence
  Synthetic
tgtgtgtagaagagggccgcta

SEQ ID NO: 35030 - DNA, 20 bp, Artificial Sequence
  Synthetic
ccgcaggtcttcgtgaaccc

SEQ ID NO: 35031 - DNA, 20 bp, Artificial Sequence
  Synthetic
ctccaggtcgcatcgctcac

SEQ ID NO: 35032 - DNA, 20 bp, Artificial Sequence
  Synthetic
ttctccagagcggcttcagc

SEQ ID NO: 35033 - DNA, 20 bp, Artificial Sequence
  Synthetic
ccaggggggcgagatggtta

SEQ ID NO: 35034 - DNA, 20 bp, Artificial Sequence
  Synthetic
taagggaggacacagggcgc

SEQ ID NO: 35035 - DNA, 20 bp, Artificial Sequence
  Synthetic
ggcaccaaacccaagggtgg

SEQ ID NO: 35036 - DNA, 20 bp, Artificial Sequence
  Synthetic
tccaaggaccacacggccaa

SEQ ID NO: 35037 - DNA, 21 bp, Artificial Sequence
  Synthetic
tgaaggccatcagtgaggcca

SEQ ID NO: 35038 - DNA, 20 bp, Artificial Sequence
  Synthetic
gtagagcgcacccagacacc

SEQ ID NO: 35039 - DNA, 21 bp, Artificial Sequence
  Synthetic
cagtgctctctagccctgcag

SEQ ID NO: 35040 - DNA, 22 bp, Artificial Sequence
  Synthetic
gatcttggtcctgacagcccag

SEQ ID NO: 35041 - DNA, 22 bp, Artificial Sequence
  Synthetic
tccatgagaataagggggaaca

SEQ ID NO: 35042 - DNA, 22 bp, Artificial Sequence
  Synthetic
tcctattgccatgtctgctgat

SEQ ID NO: 35043 - DNA, 25 bp, Artificial Sequence
  Synthetic
cctcaagaatcatgttcctctgatc

SEQ ID NO: 35044 - DNA, 23 bp, Artificial Sequence
  Synthetic
tgctgtgaacaggagtatgagat

SEQ ID NO: 35045 - DNA, 20 bp, Artificial Sequence
  Synthetic
aggaccattctggcacactt

SEQ ID NO: 35046 - DNA, 22 bp, Artificial Sequence
  Synthetic
tggcaaccggataatttgatcc

SEQ ID NO: 35047 - DNA, 22 bp, Artificial Sequence
  Synthetic
ggtgcaactagattaccagtgc

SEQ ID NO: 35048 - DNA, 20 bp, Artificial Sequence
  Synthetic
tgttgtgtccatggttgggt

SEQ ID NO: 35049 - DNA, 25 bp, Artificial Sequence
  Synthetic
ggacattattagccctcctaatcac

SEQ ID NO: 35050 - DNA, 24 bp, Artificial Sequence
  Synthetic
tgcctaatactacactggagaagt

SEQ ID NO: 35051 - DNA, 20 bp, Artificial Sequence
  Synthetic
ccgagcagatgtaggtcctg

SEQ ID NO: 35052 - DNA, 25 bp, Artificial Sequence
  Synthetic
ttgtgatggcatttttgaattcagt

SEQ ID NO: 35053 - DNA, 20 bp, Artificial Sequence
  Synthetic
ctgaggctccagatgggttt

SEQ ID NO: 35054 - DNA, 22 bp, Artificial Sequence
  Synthetic
ttttctagtgtcttggtggtgc

SEQ ID NO: 35055 - DNA, 21 bp, Artificial Sequence
  Synthetic
tgtttggtggtttgttttggc

SEQ ID NO: 35056 - DNA, 25 bp, Artificial Sequence
  Synthetic
ttgtttgtggatagtagagcacttt

SEQ ID NO: 35057 - DNA, 22 bp, Artificial Sequence
  Synthetic
ccatcctctgtcggttcttgtt

SEQ ID NO: 35058 - DNA, 20 bp, Artificial Sequence
  Synthetic
tgtgactggtgtgcttctgg

SEQ ID NO: 35059 - DNA, 25 bp, Artificial Sequence
  Synthetic
gagaatattttgtttggagctgtgc

SEQ ID NO: 35060 - DNA, 22 bp, Artificial Sequence
  Synthetic
gccatggctagacgctttctgc

SEQ ID NO: 35061 - DNA, 20 bp, Artificial Sequence
  Synthetic
acttgacgtcctgtgggcga

SEQ ID NO: 35062 - DNA, 19 bp, Artificial Sequence
  Synthetic
ccccatgaggtcggcgaag

SEQ ID NO: 35063 - DNA, 19 bp, Artificial Sequence
  Synthetic
gggacacaccccggagtgt

SEQ ID NO: 35064 - DNA, 20 bp, Artificial Sequence
  Synthetic
gagctaccaccaacgctgcc

SEQ ID NO: 35065 - DNA, 20 bp, Artificial Sequence
  Synthetic
accgaaccaattgcccagcg

SEQ ID NO: 35066 - DNA, 19 bp, Artificial Sequence
  Synthetic
ttcgccccgcgtccagttg

SEQ ID NO: 35067 - DNA, 19 bp, Artificial Sequence
  Synthetic
acggccagatctcgcaggc

SEQ ID NO: 35068 - DNA, 20 bp, Artificial Sequence
  Synthetic
ccccattgatgcacgttgcc

SEQ ID NO: 35069 - DNA, 21 bp, Artificial Sequence
  Synthetic
ggggctgccagtggtaattgt

SEQ ID NO: 35070 - DNA, 19 bp, Artificial Sequence
  Synthetic
gctcccccggtgccacaaa

SEQ ID NO: 35071 - DNA, 22 bp, Artificial Sequence
  Synthetic
catcccttgctcgatgtacggt

SEQ ID NO: 35072 - DNA, 20 bp, Artificial Sequence
  Synthetic
ggggaaacatggttcccccg

SEQ ID NO: 35073 - DNA, 20 bp, Artificial Sequence
  Synthetic
tacctcctcccgcagcaagg

SEQ ID NO: 35074 - DNA, 20 bp, Artificial Sequence
  Synthetic
gagggacttgatggccacgc

SEQ ID NO: 35075 - DNA, 20 bp, Artificial Sequence
  Synthetic
ctctttccagcgccgtcgtg

SEQ ID NO: 35076 - DNA, 23 bp, Artificial Sequence
  Synthetic
gcaagctcgacaatcattggatt

SEQ ID NO: 35077 - DNA, 23 bp, Artificial Sequence
  Synthetic
ggtgttgcagatactattcacca

SEQ ID NO: 35078 - DNA, 23 bp, Artificial Sequence
  Synthetic
tcaatatcttggagctctgccag

SEQ ID NO: 35079 - DNA, 24 bp, Artificial Sequence
  Synthetic
cgtcttcccctatttcatcaagtt

SEQ ID NO: 35080 - DNA, 24 bp, Artificial Sequence
  Synthetic
actcacaaagtttaccacatcggt

SEQ ID NO: 35081 - DNA, 23 bp, Artificial Sequence
  Synthetic
cctcaatcatgctctcaatctgt

SEQ ID NO: 35082 - DNA, 21 bp, Artificial Sequence
  Synthetic
ttgggcattagcatgaaccag

SEQ ID NO: 35083 - DNA, 25 bp, Artificial Sequence
  Synthetic
ccccaaataactgttttctacaacc

SEQ ID NO: 35084 - DNA, 20 bp, Artificial Sequence
  Synthetic
cagtcccctcctcctctgta

SEQ ID NO: 35085 - DNA, 22 bp, Artificial Sequence
  Synthetic
acagggttcgctgtttgcaaca

SEQ ID NO: 35086 - DNA, 21 bp, Artificial Sequence
  Synthetic
tcctcctcgttatcgttgtcg

SEQ ID NO: 35087 - DNA, 23 bp, Artificial Sequence
  Synthetic
gcaatgtctctaatgcaagttgc

SEQ ID NO: 35088 - DNA, 21 bp, Artificial Sequence
  Synthetic
tgtgacctgatgagggcctaa

SEQ ID NO: 35089 - DNA, 19 bp, Artificial Sequence
  Synthetic
tcaaccggcgtggatggcg

SEQ ID NO: 35090 - DNA, 19 bp, Artificial Sequence
  Synthetic
gaatgggctgtcgctggct

SEQ ID NO: 35091 - DNA, 21 bp, Artificial Sequence
  Synthetic
ggccggggtatccttttggga

SEQ ID NO: 35092 - DNA, 20 bp, Artificial Sequence
  Synthetic
ggtacaggacgccttggcat

SEQ ID NO: 35093 - DNA, 20 bp, Artificial Sequence
  Synthetic
tttcctggcccggtgtaggg

SEQ ID NO: 35094 - DNA, 22 bp, Artificial Sequence
  Synthetic
actgaatctcgccaagtagggc

SEQ ID NO: 35095 - DNA, 21 bp, Artificial Sequence
  Synthetic
acaagtggccactgctgcttg

SEQ ID NO: 35096 - DNA, 22 bp, Artificial Sequence
  Synthetic
gatagtaagcggggcaggaggg

SEQ ID NO: 35097 - DNA, 21 bp, Artificial Sequence
  Synthetic
cgccggcagcttcttgaagag

SEQ ID NO: 35098 - DNA, 21 bp, Artificial Sequence
  Synthetic
gcaccctaggtatgggcattt

SEQ ID NO: 35099 - DNA, 22 bp, Artificial Sequence
  Synthetic
acctgctggtggaggaattggt

SEQ ID NO: 35100 - DNA, 22 bp, Artificial Sequence
  Synthetic
cgataacgcgtccatcgatggg

SEQ ID NO: 35101 - DNA, 20 bp, Artificial Sequence
  Synthetic
cagggcccggaaatcatagg

SEQ ID NO: 35102 - DNA, 20 bp, Artificial Sequence
  Synthetic
tggtgctgagctgtcctccg

SEQ ID NO: 35103 - DNA, 19 bp, Artificial Sequence
  Synthetic
agatgcgagccccctcctg

SEQ ID NO: 35104 - DNA, 22 bp, Artificial Sequence
  Synthetic
tttgttagtatctcgcgagtgc

SEQ ID NO: 35105 - DNA, 21 bp, Artificial Sequence
  Synthetic
catgtcactgccaaaggtgat

SEQ ID NO: 35106 - DNA, 22 bp, Artificial Sequence
  Synthetic
cccgtaagcacttcttcctctc

SEQ ID NO: 35107 - DNA, 21 bp, Artificial Sequence
  Synthetic
gcatgggattcaatcgctgat

SEQ ID NO: 35108 - DNA, 21 bp, Artificial Sequence
  Synthetic
acatttcctcgttggtctcga

SEQ ID NO: 35109 - DNA, 22 bp, Artificial Sequence
  Synthetic
caaatccactgtattggcctct

SEQ ID NO: 35110 - DNA, 20 bp, Artificial Sequence
  Synthetic
tgggtatgagcatggaccat

SEQ ID NO: 35111 - DNA, 23 bp, Artificial Sequence
  Synthetic
tccaactgcatttttgacatcct

SEQ ID NO: 35112 - DNA, 23 bp, Artificial Sequence
  Synthetic
ccagtataagggaatgtggtgct

SEQ ID NO: 35113 - DNA, 20 bp, Artificial Sequence
  Synthetic
ttgcgtgaccatcttcttgg

SEQ ID NO: 35114 - DNA, 21 bp, Artificial Sequence
  Synthetic
cttttcattgccccctactgg

SEQ ID NO: 35115 - DNA, 24 bp, Artificial Sequence
  Synthetic
cgaacatgtaccctttccctagtc

SEQ ID NO: 35116 - DNA, 25 bp, Artificial Sequence
  Synthetic
tcactgttactccaatactcatgtc

SEQ ID NO: 35117 - DNA, 19 bp, Artificial Sequence
  Synthetic
ggcccatggttccgaagcg

SEQ ID NO: 35118 - DNA, 22 bp, Artificial Sequence
  Synthetic
tcgttctaactgtacacggcgg

SEQ ID NO: 35119 - DNA, 19 bp, Artificial Sequence
  Synthetic
cgcgatccctgggctggta

SEQ ID NO: 35120 - DNA, 21 bp, Artificial Sequence
  Synthetic
tggggaatttgtgtgggtact

SEQ ID NO: 35121 - DNA, 22 bp, Artificial Sequence
  Synthetic
cccacagcatgctcttggtctt

SEQ ID NO: 35122 - DNA, 19 bp, Artificial Sequence
  Synthetic
tctgcgtccgcgtctcgtg

SEQ ID NO: 35123 - DNA, 18 bp, Artificial Sequence
  Synthetic
tcctcgaaacgccagcgc

SEQ ID NO: 35124 - DNA, 20 bp, Artificial Sequence
  Synthetic
cgatccgaaagccaggtcgc

SEQ ID NO: 35125 - DNA, 20 bp, Artificial Sequence
  Synthetic
cgcgatgctctggctgatga

SEQ ID NO: 35126 - DNA, 19 bp, Artificial Sequence
  Synthetic
cgtcgcgatgggaggtagc

SEQ ID NO: 35127 - DNA, 22 bp, Artificial Sequence
  Synthetic
ctgcgtctatgcaacctcaggt

SEQ ID NO: 35128 - DNA, 19 bp, Artificial Sequence
  Synthetic
tgtacctgcgcctggacgg

SEQ ID NO: 35129 - DNA, 22 bp, Artificial Sequence
  Synthetic
gccttttatcgcaccctctcgg

SEQ ID NO: 35130 - DNA, 19 bp, Artificial Sequence
  Synthetic
aaccgccatggacgagcag

SEQ ID NO: 35131 - DNA, 18 bp, Artificial Sequence
  Synthetic
aaggcgcgcggcatgttg

SEQ ID NO: 35132 - DNA, 18 bp, Artificial Sequence
  Synthetic
atgtcggtgcgcgagacg

SEQ ID NO: 35133 - DNA, 20 bp, Artificial Sequence
  Synthetic
ggccgtgaaaaccagctggt

SEQ ID NO: 35134 - DNA, 20 bp, Artificial Sequence
  Synthetic
gccaaagttgagcagcccca

SEQ ID NO: 35135 - DNA, 18 bp, Artificial Sequence
  Synthetic
cagcacgtcgagctgcgt

SEQ ID NO: 35136 - DNA, 19 bp, Artificial Sequence
  Synthetic
gccctgtgtgacagcccag

SEQ ID NO: 35137 - DNA, 21 bp, Artificial Sequence
  Synthetic
gacgactactggaacgccgtt

SEQ ID NO: 35138 - DNA, 19 bp, Artificial Sequence
  Synthetic
actgcagcccaccgcccta

SEQ ID NO: 35139 - DNA, 19 bp, Artificial Sequence
  Synthetic
tgtccgcttcgagaccggc

SEQ ID NO: 35140 - DNA, 19 bp, Artificial Sequence
  Synthetic
ggcaaggcgacgcagtgtc

SEQ ID NO: 35141 - DNA, 18 bp, Artificial Sequence
  Synthetic
atctgtggggcgtgacgc

SEQ ID NO: 35142 - DNA, 20 bp, Artificial Sequence
  Synthetic
gcgctggaaaaactgcgtcc

SEQ ID NO: 35143 - DNA, 19 bp, Artificial Sequence
  Synthetic
tgtgtcgccaactgcacgg

SEQ ID NO: 35144 - DNA, 22 bp, Artificial Sequence
  Synthetic
ccagatccctctgtgtaccggg

SEQ ID NO: 35145 - DNA, 20 bp, Artificial Sequence
  Synthetic
ccagctcgcgcaactgttct

SEQ ID NO: 35146 - DNA, 17 bp, Artificial Sequence
  Synthetic
tcgcgcctgccgttgat

SEQ ID NO: 35147 - DNA, 20 bp, Artificial Sequence
  Synthetic
catgtagccgtccaggtcgc

SEQ ID NO: 35148 - DNA, 21 bp, Artificial Sequence
  Synthetic
gaccctcgcagtgatacacgg

SEQ ID NO: 35149 - DNA, 20 bp, Artificial Sequence
  Synthetic
cgcgtcggttcagatcgctg

SEQ ID NO: 35150 - DNA, 22 bp, Artificial Sequence
  Synthetic
ctagcgcttccagctgagctag

SEQ ID NO: 35151 - DNA, 21 bp, Artificial Sequence
  Synthetic
ccaagagcagctcgagtgtgg

SEQ ID NO: 35152 - DNA, 22 bp, Artificial Sequence
  Synthetic
cgtgaccagatcagtccacagg

SEQ ID NO: 35153 - DNA, 19 bp, Artificial Sequence
  Synthetic
cggtgatttgcgcaagggc

SEQ ID NO: 35154 - DNA, 19 bp, Artificial Sequence
  Synthetic
ggctgcgcgctggttaaac

SEQ ID NO: 35155 - DNA, 21 bp, Artificial Sequence
  Synthetic
gtacgagaatctgctgcgcga

SEQ ID NO: 35156 - DNA, 19 bp, Artificial Sequence
  Synthetic
agagggcgcggaaaccacc

SEQ ID NO: 35157 - DNA, 18 bp, Artificial Sequence
  Synthetic
ggtggtactgcggcggtt

SEQ ID NO: 35158 - DNA, 20 bp, Artificial Sequence
  Synthetic
cgggttctgtggcggctatg

SEQ ID NO: 35159 - DNA, 19 bp, Artificial Sequence
  Synthetic
ttggtggacgcgcgttccc

SEQ ID NO: 35160 - DNA, 19 bp, Artificial Sequence
  Synthetic
ccgtatcagctaccgccgc

SEQ ID NO: 35161 - DNA, 19 bp, Artificial Sequence
  Synthetic
tcgtggatggctgcgaggc

SEQ ID NO: 35162 - DNA, 19 bp, Artificial Sequence
  Synthetic
gacgaggccctgggtttcg

SEQ ID NO: 35163 - DNA, 20 bp, Artificial Sequence
  Synthetic
tggaggcctacacgcccgag

SEQ ID NO: 35164 - DNA, 20 bp, Artificial Sequence
  Synthetic
ttcggcgtctctgtgcgtac

SEQ ID NO: 35165 - DNA, 21 bp, Artificial Sequence
  Synthetic
ggaccctccccgtggattcac

SEQ ID NO: 35166 - DNA, 22 bp, Artificial Sequence
  Synthetic
gctcatgcacaccgactacctg

SEQ ID NO: 35167 - DNA, 20 bp, Artificial Sequence
  Synthetic
cgacctgctccgtcacgtac

SEQ ID NO: 35168 - DNA, 19 bp, Artificial Sequence
  Synthetic
gcagtgtacgcgcgaaccg

SEQ ID NO: 35169 - DNA, 20 bp, Artificial Sequence
  Synthetic
acgtgaggcaatctccgcag

SEQ ID NO: 35170 - DNA, 19 bp, Artificial Sequence
  Synthetic
aagagaaccccgccgtccc

SEQ ID NO: 35171 - DNA, 20 bp, Artificial Sequence
  Synthetic
ggcaacagcaattcggcctc

SEQ ID NO: 35172 - DNA, 20 bp, Artificial Sequence
  Synthetic
gagaaagcgacggcggtgat

SEQ ID NO: 35173 - DNA, 19 bp, Artificial Sequence
  Synthetic
tcgtaacgccgaccccacc

SEQ ID NO: 35174 - DNA, 19 bp, Artificial Sequence
  Synthetic
tgacggtgctgcttctgcg

SEQ ID NO: 35175 - DNA, 22 bp, Artificial Sequence
  Synthetic
ggacaaagacgtcgaagcggta

SEQ ID NO: 35176 - DNA, 20 bp, Artificial Sequence
  Synthetic
ggaacaccgacagccgctag

SEQ ID NO: 35177 - DNA, 22 bp, Artificial Sequence
  Synthetic
gccaggctcagaaaacaacacg

SEQ ID NO: 35178 - DNA, 19 bp, Artificial Sequence
  Synthetic
gtctcgggactggcctgga

SEQ ID NO: 35179 - DNA, 20 bp, Artificial Sequence
  Synthetic
ccccagccaagagcccatgt

SEQ ID NO: 35180 - DNA, 19 bp, Artificial Sequence
  Synthetic
tcgcgctggaggacctgct

SEQ ID NO: 35181 - DNA, 21 bp, Artificial Sequence
  Synthetic
cgctagaggacagctccatgc

SEQ ID NO: 35182 - DNA, 20 bp, Artificial Sequence
  Synthetic
gaggtaaaggctgccgtgca

SEQ ID NO: 35183 - DNA, 19 bp, Artificial Sequence
  Synthetic
aagagagcacaagcggcgt

SEQ ID NO: 35184 - DNA, 19 bp, Artificial Sequence
  Synthetic
gccccccttcgttacgcac

SEQ ID NO: 35185 - DNA, 22 bp, Artificial Sequence
  Synthetic
tgctcgagtgtcgttttcagca

SEQ ID NO: 35186 - DNA, 22 bp, Artificial Sequence
  Synthetic
cccactgactttctgacgcacg

SEQ ID NO: 35187 - DNA, 18 bp, Artificial Sequence
  Synthetic
acgctcgggttcggtcct

SEQ ID NO: 35188 - DNA, 20 bp, Artificial Sequence
  Synthetic
cgtgtccgttcgccgaaacc

SEQ ID NO: 35189 - DNA, 22 bp, Artificial Sequence
  Synthetic
ttcctcctcctcttctcccgtc

SEQ ID NO: 35190 - DNA, 19 bp, Artificial Sequence
  Synthetic
accacacgcccgaccagaa

SEQ ID NO: 35191 - DNA, 21 bp, Artificial Sequence
  Synthetic
tgcacaagcccaccttcatca

SEQ ID NO: 35192 - DNA, 20 bp, Artificial Sequence
  Synthetic
tgtcgttgacgcactccacc

SEQ ID NO: 35193 - DNA, 19 bp, Artificial Sequence
  Synthetic
cagtgcggcctcctcgatg

SEQ ID NO: 35194 - DNA, 20 bp, Artificial Sequence
  Synthetic
gcaacgaggccttcctgccg

SEQ ID NO: 35195 - DNA, 18 bp, Artificial Sequence
  Synthetic
gccgccatcatgttgcgc

SEQ ID NO: 35196 - DNA, 19 bp, Artificial Sequence
  Synthetic
cgccgaggaagacgacacc

SEQ ID NO: 35197 - DNA, 19 bp, Artificial Sequence
  Synthetic
tccgaagccgcgtcctctt

SEQ ID NO: 35198 - DNA, 19 bp, Artificial Sequence
  Synthetic
cggcatgggtcggaaagca

SEQ ID NO: 35199 - DNA, 20 bp, Artificial Sequence
  Synthetic
cgccggcgtgcttaaagagc

SEQ ID NO: 35200 - DNA, 19 bp, Artificial Sequence
  Synthetic
cgcgttcgacagcgctgtg

SEQ ID NO: 35201 - DNA, 19 bp, Artificial Sequence
  Synthetic
tgtgagtgccgacgcgaaa

SEQ ID NO: 35202 - DNA, 20 bp, Artificial Sequence
  Synthetic
ggcatcgtcaaggccgacaa

SEQ ID NO: 35203 - DNA, 19 bp, Artificial Sequence
  Synthetic
ctgtggctgcacacggagc

SEQ ID NO: 35204 - DNA, 22 bp, Artificial Sequence
  Synthetic
acgaagaggacctggagcagta

SEQ ID NO: 35205 - DNA, 22 bp, Artificial Sequence
  Synthetic
ccagtaggcgagcagatcgttg

SEQ ID NO: 35206 - DNA, 22 bp, Artificial Sequence
  Synthetic
ggccatgttccatccgttgaga

SEQ ID NO: 35207 - DNA, 22 bp, Artificial Sequence
  Synthetic
agtgtacatgtgcaccgtctcc

SEQ ID NO: 35208 - DNA, 20 bp, Artificial Sequence
  Synthetic
gccggcgacacatgcgaaag

SEQ ID NO: 35209 - DNA, 20 bp, Artificial Sequence
  Synthetic
cgactcgacgaagcgcgaga

SEQ ID NO: 35210 - DNA, 19 bp, Artificial Sequence
  Synthetic
aggctggcagacgctgagt

SEQ ID NO: 35211 - DNA, 19 bp, Artificial Sequence
  Synthetic
acagcgagtgcggcgatgg

SEQ ID NO: 35212 - DNA, 21 bp, Artificial Sequence
  Synthetic
gcccattgtttcctcagccgc

SEQ ID NO: 35213 - DNA, 22 bp, Artificial Sequence
  Synthetic
gcgctctacttcgtaccacgag

SEQ ID NO: 35214 - DNA, 22 bp, Artificial Sequence
  Synthetic
cgtagttgcgctcttgggcgac

SEQ ID NO: 35215 - DNA, 22 bp, Artificial Sequence
  Synthetic
tggcggtagggtatgtgtctga

SEQ ID NO: 35216 - DNA, 19 bp, Artificial Sequence
  Synthetic
gcgtcgacccttcaccgag

SEQ ID NO: 35217 - DNA, 22 bp, Artificial Sequence
  Synthetic
aatcggcaaaattttctaccgc

SEQ ID NO: 35218 - DNA, 21 bp, Artificial Sequence
  Synthetic
ccaacatcacaagcaacgaca

SEQ ID NO: 35219 - DNA, 19 bp, Artificial Sequence
  Synthetic
cagatctggtcgccgacgc

SEQ ID NO: 35220 - DNA, 21 bp, Artificial Sequence
  Synthetic
gtcatgacacactcctggccc

SEQ ID NO: 35221 - DNA, 21 bp, Artificial Sequence
  Synthetic
gctggcggggtaacatcatcc

SEQ ID NO: 35222 - DNA, 19 bp, Artificial Sequence
  Synthetic
atccgagactgccgcgcac

SEQ ID NO: 35223 - DNA, 20 bp, Artificial Sequence
  Synthetic
atgagagggaggatggccgt

SEQ ID NO: 35224 - DNA, 20 bp, Artificial Sequence
  Synthetic
gccgacttccaccatcaggc

SEQ ID NO: 35225 - DNA, 19 bp, Artificial Sequence
  Synthetic
acgacgtcgcgatcggcag

SEQ ID NO: 35226 - DNA, 19 bp, Artificial Sequence
  Synthetic
ggacgcgaaacccggactg

SEQ ID NO: 35227 - DNA, 22 bp, Artificial Sequence
  Synthetic
acatcccagagggcttccttga

SEQ ID NO: 35228 - DNA, 22 bp, Artificial Sequence
  Synthetic
gccaaccacagacgttcaagga

SEQ ID NO: 35229 - DNA, 19 bp, Artificial Sequence
  Synthetic
tgctcacaacacggcgctt

SEQ ID NO: 35230 - DNA, 22 bp, Artificial Sequence
  Synthetic
ccgaggacccaatgtgattcgt

SEQ ID NO: 35231 - DNA, 22 bp, Artificial Sequence
  Synthetic
ccttagtgacggcgatcagcag

SEQ ID NO: 35232 - DNA, 22 bp, Artificial Sequence
  Synthetic
tcgatatcgctccttcttcact

SEQ ID NO: 35233 - DNA, 20 bp, Artificial Sequence
  Synthetic
tgtgcgtggcaacttctccg

SEQ ID NO: 35234 - DNA, 22 bp, Artificial Sequence
  Synthetic
ctgctaccctaacactcgcctc

SEQ ID NO: 35235 - DNA, 22 bp, Artificial Sequence
  Synthetic
cagcctcatcctaacgtggacg

SEQ ID NO: 35236 - DNA, 21 bp, Artificial Sequence
  Synthetic
cgacgatccctcgccgctatt

SEQ ID NO: 35237 - DNA, 19 bp, Artificial Sequence
  Synthetic
aagagacccggctggcgac

SEQ ID NO: 35238 - DNA, 19 bp, Artificial Sequence
  Synthetic
cgtccgttccgacagctgg

SEQ ID NO: 35239 - DNA, 19 bp, Artificial Sequence
  Synthetic
tttcccaccgcgacccagc

SEQ ID NO: 35240 - DNA, 19 bp, Artificial Sequence
  Synthetic
ccgggcctgctcaccattt

SEQ ID NO: 35241 - DNA, 20 bp, Artificial Sequence
  Synthetic
cgtcccgctagaatggaccg

SEQ ID NO: 35242 - DNA, 20 bp, Artificial Sequence
  Synthetic
cgttcctcacgctcgctctg

SEQ ID NO: 35243 - DNA, 18 bp, Artificial Sequence
  Synthetic
aaagccatgcacgcccgc

SEQ ID NO: 35244 - DNA, 19 bp, Artificial Sequence
  Synthetic
agtgatgcgcgaacaggcc

SEQ ID NO: 35245 - DNA, 18 bp, Artificial Sequence
  Synthetic
acgcgcggcagtttcgct

SEQ ID NO: 35246 - DNA, 19 bp, Artificial Sequence
  Synthetic
ctgcgttggcgaacaccac

SEQ ID NO: 35247 - DNA, 19 bp, Artificial Sequence
  Synthetic
tggttcctgcaggtgcggc

SEQ ID NO: 35248 - DNA, 20 bp, Artificial Sequence
  Synthetic
gacgcgattcggggtccttc

SEQ ID NO: 35249 - DNA, 19 bp, Artificial Sequence
  Synthetic
tgagcgattccccgccacc

SEQ ID NO: 35250 - DNA, 23 bp, Artificial Sequence
  Synthetic
gcaagctcgacaatcattggatt

SEQ ID NO: 35251 - DNA, 21 bp, Artificial Sequence
  Synthetic
cgactcctgttgtgttgcaga

SEQ ID NO: 35252 - DNA, 22 bp, Artificial Sequence
  Synthetic
gaaaggaatcccatagacccct

SEQ ID NO: 35253 - DNA, 20 bp, Artificial Sequence
  Synthetic
tgccatattctccccgagtg

SEQ ID NO: 35254 - DNA, 21 bp, Artificial Sequence
  Synthetic
agtggatagctgtcctcttgg

SEQ ID NO: 35255 - DNA, 21 bp, Artificial Sequence
  Synthetic
gacaggaccaagggagtcatt

SEQ ID NO: 35256 - DNA, 24 bp, Artificial Sequence
  Synthetic
gctgaggcacaggttttattactc

SEQ ID NO: 35257 - DNA, 22 bp, Artificial Sequence
  Synthetic
gctctgaaaactttgcagcaca

SEQ ID NO: 35258 - DNA, 21 bp, Artificial Sequence
  Synthetic
cctcctcttcagccatgccct

SEQ ID NO: 35259 - DNA, 23 bp, Artificial Sequence
  Synthetic
tctgtagctacaatcaggacgta

SEQ ID NO: 35260 - DNA, 22 bp, Artificial Sequence
  Synthetic
gaatttgcaggtgccacaggtc

SEQ ID NO: 35261 - DNA, 24 bp, Artificial Sequence
  Synthetic
caccgtgttcttaatgatagggaa

SEQ ID NO: 35262 - DNA, 20 bp, Artificial Sequence
  Synthetic
tgctttctgcccagctggtt

SEQ ID NO: 35263 - DNA, 22 bp, Artificial Sequence
  Synthetic
aggaaaaatacgggctaaaggc

SEQ ID NO: 35264 - DNA, 21 bp, Artificial Sequence
  Synthetic
cgcggaataccactgaaggat

SEQ ID NO: 35265 - DNA, 20 bp, Artificial Sequence
  Synthetic
tgcctggcacgcgaatatgt

SEQ ID NO: 35266 - DNA, 21 bp, Artificial Sequence
  Synthetic
gtttcccctggaggagtactg

SEQ ID NO: 35267 - DNA, 21 bp, Artificial Sequence
  Synthetic
tgaaggtcggtcaacagtttc

SEQ ID NO: 35268 - DNA, 22 bp, Artificial Sequence
  Synthetic
ccctctccgttctcgctttcga

SEQ ID NO: 35269 - DNA, 22 bp, Artificial Sequence
  Synthetic
gccgattttaagcaggcgcatt

SEQ ID NO: 35270 - DNA, 25 bp, Artificial Sequence
  Synthetic
ctccaggaggaagaaattgatcaat

SEQ ID NO: 35271 - DNA, 20 bp, Artificial Sequence
  Synthetic
gtagacaggctgcccgttcg

SEQ ID NO: 35272 - DNA, 20 bp, Artificial Sequence
  Synthetic
tgcaaccacccttacccaaa

SEQ ID NO: 35273 - DNA, 22 bp, Artificial Sequence
  Synthetic
ggggttcctcgctatggtaccc

SEQ ID NO: 35274 - DNA, 19 bp, Artificial Sequence
  Synthetic
atgccacgcgactgtcccg

SEQ ID NO: 35275 - DNA, 24 bp, Artificial Sequence
  Synthetic
acactttctcgtgagtagggttag

SEQ ID NO: 35276 - DNA, 22 bp, Artificial Sequence
  Synthetic
cttcactttgaggcacttcagt

SEQ ID NO: 35277 - DNA, 22 bp, Artificial Sequence
  Synthetic
cgcggtgaaggtaatccatcaa

SEQ ID NO: 35278 - DNA, 22 bp, Artificial Sequence
  Synthetic
cctaggagggcgaactggtctt

SEQ ID NO: 35279 - DNA, 23 bp, Artificial Sequence
  Synthetic
accccatctagacctttcatcaa

SEQ ID NO: 35280 - DNA, 23 bp, Artificial Sequence
  Synthetic
acgaaagtttctggtgtcaaact

SEQ ID NO: 35281 - DNA, 20 bp, Artificial Sequence
  Synthetic
ctcctccatacatgcgggcg

SEQ ID NO: 35282 - DNA, 20 bp, Artificial Sequence
  Synthetic
cgcggcgacttcttcctctt

SEQ ID NO: 35283 - DNA, 22 bp, Artificial Sequence
  Synthetic
agttgcattgtaggctgcaatt

SEQ ID NO: 35284 - DNA, 18 bp, Artificial Sequence
  Synthetic
tgtggctcggcgctgaaa

SEQ ID NO: 35285 - DNA, 22 bp, Artificial Sequence
  Synthetic
gccatgtctaacacgcggttgt

SEQ ID NO: 35286 - DNA, 20 bp, Artificial Sequence
  Synthetic
agtaccgtgttctgtctccc

SEQ ID NO: 35287 - DNA, 21 bp, Artificial Sequence
  Synthetic
tcgtctggtaggtataagccc

SEQ ID NO: 35288 - DNA, 22 bp, Artificial Sequence
  Synthetic
gctcctgttcgcttgaacccat

SEQ ID NO: 35289 - DNA, 23 bp, Artificial Sequence
  Synthetic
agaaaacggtccttgtacagttt

SEQ ID NO: 35290 - DNA, 22 bp, Artificial Sequence
  Synthetic
ggcatcagcgtttgcagtacag

SEQ ID NO: 35291 - DNA, 20 bp, Artificial Sequence
  Synthetic
tcacatgcgacatgggcaaa

SEQ ID NO: 35292 - DNA, 21 bp, Artificial Sequence
  Synthetic
gcgaaggggagcttagatgcc

SEQ ID NO: 35293 - DNA, 20 bp, Artificial Sequence
  Synthetic
cagcccctagtttcagcttg

SEQ ID NO: 35294 - DNA, 21 bp, Artificial Sequence
  Synthetic
gcccaagttctgctcaaccgg

SEQ ID NO: 35295 - DNA, 25 bp, Artificial Sequence
  Synthetic
gaaaatatggtatgttgccagtgct

SEQ ID NO: 35296 - DNA, 22 bp, Artificial Sequence
  Synthetic
tcaatgggttgggctcgcttaa

SEQ ID NO: 35297 - DNA, 21 bp, Artificial Sequence
  Synthetic
catcccagtttgccaggtatg

SEQ ID NO: 35298 - DNA, 23 bp, Artificial Sequence
  Synthetic
gcatttcgaaggtaccaatgact

SEQ ID NO: 35299 - DNA, 22 bp, Artificial Sequence
  Synthetic
gcctgcttgcgattcttaccca

SEQ ID NO: 35300 - DNA, 20 bp, Artificial Sequence
  Synthetic
ccgggctcgtaccccattca

SEQ ID NO: 35301 - DNA, 25 bp, Artificial Sequence
  Synthetic
caaccttattggggtaatcagagtt

SEQ ID NO: 35302 - DNA, 23 bp, Artificial Sequence
  Synthetic
aactaaaattaaggcgcgcatac

SEQ ID NO: 35303 - DNA, 22 bp, Artificial Sequence
  Synthetic
tggggtctgcagtagcaacaga

SEQ ID NO: 35304 - DNA, 20 bp, Artificial Sequence
  Synthetic
agaagttctcattcccccgg

SEQ ID NO: 35305 - DNA, 24 bp, Artificial Sequence
  Synthetic
aaacactaaatgcactcctacagt

SEQ ID NO: 35306 - DNA, 25 bp, Artificial Sequence
  Synthetic
ggtaatgtaagaaaaggagcaggat

SEQ ID NO: 35307 - DNA, 20 bp, Artificial Sequence
  Synthetic
tggacctggttttggatggg

SEQ ID NO: 35308 - DNA, 21 bp, Artificial Sequence
  Synthetic
aaatccttgctgaccgtcttg

SEQ ID NO: 35309 - DNA, 20 bp, Artificial Sequence
  Synthetic
atgtcagctgcgagaccaag

SEQ ID NO: 35310 - DNA, 24 bp, Artificial Sequence
  Synthetic
gcttatgtgttattttctcctgcg

SEQ ID NO: 35311 - DNA, 21 bp, Artificial Sequence
  Synthetic
ctcacttttcgcctcgggtga

SEQ ID NO: 35312 - DNA, 22 bp, Artificial Sequence
  Synthetic
catcagccacgggttgagtgaa

SEQ ID NO: 35313 - DNA, 22 bp, Artificial Sequence
  Synthetic
gtggcgttgcattgagtgtgaa

SEQ ID NO: 35314 - DNA, 21 bp, Artificial Sequence
  Synthetic
gctaatccaggggacaacaag

SEQ ID NO: 35315 - DNA, 22 bp, Artificial Sequence
  Synthetic
gaaagttctccactgtagcctc

SEQ ID NO: 35316 - DNA, 20 bp, Artificial Sequence
  Synthetic
ggtggtcgaggaatccaagc

SEQ ID NO: 35317 - DNA, 20 bp, Artificial Sequence
  Synthetic
tttgccaccacaatctcccg

SEQ ID NO: 35318 - DNA, 23 bp, Artificial Sequence
  Synthetic
caacatcatccatgatcaccact

SEQ ID NO: 35319 - DNA, 21 bp, Artificial Sequence
  Synthetic
cagaccctggaatatggcagt

SEQ ID NO: 35320 - DNA, 24 bp, Artificial Sequence
  Synthetic
agaactttggtttcaacaccatca

SEQ ID NO: 35321 - DNA, 21 bp, Artificial Sequence
  Synthetic
ggggtacagcttagagtgctc

SEQ ID NO: 35322 - DNA, 20 bp, Artificial Sequence
  Synthetic
gtgctgggtcaagttcctct

SEQ ID NO: 35323 - DNA, 20 bp, Artificial Sequence
  Synthetic
cctcctcactcagcaggttt

SEQ ID NO: 35324 - DNA, 25 bp, Artificial Sequence
  Synthetic
tcccttctaagtcaaaattgtctgt

SEQ ID NO: 35325 - DNA, 20 bp, Artificial Sequence
  Synthetic
tcaattcagcgactgcctgc

SEQ ID NO: 35326 - DNA, 22 bp, Artificial Sequence
  Synthetic
tgctgtgggtacacttcgtaat

SEQ ID NO: 35327 - DNA, 20 bp, Artificial Sequence
  Synthetic
gaaacgtgcgactagggact

SEQ ID NO: 35328 - DNA, 22 bp, Artificial Sequence
  Synthetic
cgtcgtagtcgtactccctcgg

SEQ ID NO: 35329 - DNA, 23 bp, Artificial Sequence
  Synthetic
gggattatttctgagggtcccaa

SEQ ID NO: 35330 - DNA, 23 bp, Artificial Sequence
  Synthetic
gaggttctataggggacacatct

SEQ ID NO: 35331 - DNA, 20 bp, Artificial Sequence
  Synthetic
cgtgctcttcctattgcacg

SEQ ID NO: 35332 - DNA, 24 bp, Artificial Sequence
  Synthetic
tccaagcctgctaactctaatttg

SEQ ID NO: 35333 - DNA, 20 bp, Artificial Sequence
  Synthetic
gtctgacacagtccggccac

SEQ ID NO: 35334 - DNA, 23 bp, Artificial Sequence
  Synthetic
ggttactcagaacaacaattggc

SEQ ID NO: 35335 - DNA, 21 bp, Artificial Sequence
  Synthetic
tgaggaggacgcgtaacgagt

SEQ ID NO: 35336 - DNA, 20 bp, Artificial Sequence
  Synthetic
agcgatgtgacgtcgttgtt

SEQ ID NO: 35337 - DNA, 21 bp, Artificial Sequence
  Synthetic
tctccatcatctctgcaaggc

SEQ ID NO: 35338 - DNA, 23 bp, Artificial Sequence
  Synthetic
ctcattaccaccaacaggtagac

SEQ ID NO: 35339 - DNA, 20 bp, Artificial Sequence
  Synthetic
gcagtagtgaaagctggcaa

SEQ ID NO: 35340 - DNA, 23 bp, Artificial Sequence
  Synthetic
cttttctcttctgccatcattgc

SEQ ID NO: 35341 - DNA, 24 bp, Artificial Sequence
  Synthetic
gcatttgcactttccataatgcct

SEQ ID NO: 35342 - DNA, 20 bp, Artificial Sequence
  Synthetic
tgtacacccagacccctcat

SEQ ID NO: 35343 - DNA, 21 bp, Artificial Sequence
  Synthetic
gcttccgcctctgtatgttcc

SEQ ID NO: 35344 - DNA, 20 bp, Artificial Sequence
  Synthetic
cccactgcaccatttctgtt

SEQ ID NO: 35345 - DNA, 24 bp, Artificial Sequence
  Synthetic
tgcatttgcatttcaatggcatta

SEQ ID NO: 35346 - DNA, 25 bp, Artificial Sequence
  Synthetic
gcctttgttcctcactatcatatgt

SEQ ID NO: 35347 - DNA, 25 bp, Artificial Sequence
  Synthetic
gcagtgttagtactagcacagatgt

SEQ ID NO: 35348 - DNA, 22 bp, Artificial Sequence
  Synthetic
agtaccaggaacaggggtactg

SEQ ID NO: 35349 - DNA, 24 bp, Artificial Sequence
  Synthetic
acaggtcattaggaagtgacaatg

SEQ ID NO: 35350 - DNA, 21 bp, Artificial Sequence
  Synthetic
acataagcatccgtggcaaca

SEQ ID NO: 35351 - DNA, 20 bp, Artificial Sequence
  Synthetic
tagcaccaaagcctgtgtca

SEQ ID NO: 35352 - DNA, 25 bp, Artificial Sequence
  Synthetic
atggcttattaaacaattgtgcctc

SEQ ID NO: 35353 - DNA, 21 bp, Artificial Sequence
  Synthetic
gtggttggcaggatatgatgc

SEQ ID NO: 35354 - DNA, 20 bp, Artificial Sequence
  Synthetic
gccaacgatctggccaccac

SEQ ID NO: 35355 - DNA, 22 bp, Artificial Sequence
  Synthetic
gcgtgactgattcccctctctc

SEQ ID NO: 35356 - DNA, 18 bp, Artificial Sequence
  Synthetic
ttgcagcacgcgagccgt

SEQ ID NO: 35357 - DNA, 21 bp, Artificial Sequence
  Synthetic
gctccaagccacagacttccc

SEQ ID NO: 35358 - DNA, 18 bp, Artificial Sequence
  Synthetic
agcagcagctgggaaccg

SEQ ID NO: 35359 - DNA, 22 bp, Artificial Sequence
  Synthetic
cgcgcacgttgaaggatggaat

SEQ ID NO: 35360 - DNA, 21 bp, Artificial Sequence
  Synthetic
gcgccccagacgatgactttc

SEQ ID NO: 35361 - DNA, 18 bp, Artificial Sequence
  Synthetic
cgagtacacaccgccgca

SEQ ID NO: 35362 - DNA, 20 bp, Artificial Sequence
  Synthetic
tcgccttgccgtaaaagggt

SEQ ID NO: 35363 - DNA, 21 bp, Artificial Sequence
  Synthetic
cgacaccgtcgcttggtaagc

SEQ ID NO: 35364 - DNA, 20 bp, Artificial Sequence
  Synthetic
atgacagcaggttggcccga

SEQ ID NO: 35365 - DNA, 22 bp, Artificial Sequence
  Synthetic
gcataccacctccaccaccaat

SEQ ID NO: 35366 - DNA, 20 bp, Artificial Sequence
  Synthetic
gagctctggggccggaactt

SEQ ID NO: 35367 - DNA, 21 bp, Artificial Sequence
  Synthetic
cgaaagctgactcgccgagga

SEQ ID NO: 35368 - DNA, 18 bp, Artificial Sequence
  Synthetic
agagcgcaaccgtggacg

SEQ ID NO: 35369 - DNA, 20 bp, Artificial Sequence
  Synthetic
cgacgtcctccgatccgcta

SEQ ID NO: 35370 - DNA, 21 bp, Artificial Sequence
  Synthetic
ccccattgggtcgttcttcga

SEQ ID NO: 35371 - DNA, 20 bp, Artificial Sequence
  Synthetic
ccaaagtagtcggtcccgtc

SEQ ID NO: 35372 - DNA, 21 bp, Artificial Sequence
  Synthetic
gcaccagcctttagaacctgt

SEQ ID NO: 35373 - DNA, 21 bp, Artificial Sequence
  Synthetic
acctgctcattttgcctgttt

SEQ ID NO: 35374 - DNA, 22 bp, Artificial Sequence
  Synthetic
tgcagaccaatatcccagacaa

SEQ ID NO: 35375 - DNA, 20 bp, Artificial Sequence
  Synthetic
tcttttggatttcggggcac

SEQ ID NO: 35376 - DNA, 22 bp, Artificial Sequence
  Synthetic
tcttggaatccatgcttcaacg

SEQ ID NO: 35377 - DNA, 22 bp, Artificial Sequence
  Synthetic
gtgtggtattgtttctgcacca

SEQ ID NO: 35378 - DNA, 24 bp, Artificial Sequence
  Synthetic
actaccttcagctgttaacaatcc

SEQ ID NO: 35379 - DNA, 20 bp, Artificial Sequence
  Synthetic
gctagagtggccgtaacagt

SEQ ID NO: 35380 - DNA, 21 bp, Artificial Sequence
  Synthetic
tgatttaccagaaccgggtgt

SEQ ID NO: 35381 - DNA, 20 bp, Artificial Sequence
  Synthetic
ctgccattgttacagggcca

SEQ ID NO: 35382 - DNA, 25 bp, Artificial Sequence
  Synthetic
tgtaattttgacttagttgccgtgt

SEQ ID NO: 35383 - DNA, 23 bp, Artificial Sequence
  Synthetic
tcattcaaactggaggcttcaat

SEQ ID NO: 35384 - DNA, 21 bp, Artificial Sequence
  Synthetic
cgtctccgtccttgatcgcat

SEQ ID NO: 35385 - DNA, 21 bp, Artificial Sequence
  Synthetic
acattccgccaatggcatccg

SEQ ID NO: 35386 - DNA, 22 bp, Artificial Sequence
  Synthetic
acaaagtggtggatccaaccgg

SEQ ID NO: 35387 - DNA, 25 bp, Artificial Sequence
  Synthetic
tccaaatgaatatgctttctcggta

SEQ ID NO: 35388 - DNA, 21 bp, Artificial Sequence
  Synthetic
tgtctgtgtccccgagggttt

SEQ ID NO: 35389 - DNA, 22 bp, Artificial Sequence
  Synthetic
tggctacttccaacctcttcag

SEQ ID NO: 35390 - DNA, 22 bp, Artificial Sequence
  Synthetic
gaacagtgtcaataaaccggct

SEQ ID NO: 35391 - DNA, 22 bp, Artificial Sequence
  Synthetic
acattttgataggccgttggat

SEQ ID NO: 35392 - DNA, 20 bp, Artificial Sequence
  Synthetic
ctctagaggggcatcagcac

SEQ ID NO: 35393 - DNA, 22 bp, Artificial Sequence
  Synthetic
agcgatcctgcaaatcaatgtc

SEQ ID NO: 35394 - DNA, 22 bp, Artificial Sequence
  Synthetic
tctaacccaccgaaaacggtta

SEQ ID NO: 35395 - DNA, 20 bp, Artificial Sequence
  Synthetic
cacagcattcgcaagggcag

SEQ ID NO: 35396 - DNA, 18 bp, Artificial Sequence
  Synthetic
aacatcacgcccggcagg

SEQ ID NO: 35397 - DNA, 21 bp, Artificial Sequence
  Synthetic
gcgtaaagccgcgtcatacca

SEQ ID NO: 35398 - DNA, 21 bp, Artificial Sequence
  Synthetic
ggctgccgtgagtaagaggac

SEQ ID NO: 35399 - DNA, 20 bp, Artificial Sequence
  Synthetic
gatgaaagccggccgagagc

SEQ ID NO: 35400 - DNA, 19 bp, Artificial Sequence
  Synthetic
aagagcaggcggcgatgcc

SEQ ID NO: 35401 - DNA, 21 bp, Artificial Sequence
  Synthetic
caggagcgacggcgtgaatta

SEQ ID NO: 35402 - DNA, 19 bp, Artificial Sequence
  Synthetic
actctggcggcagtgtgcg

SEQ ID NO: 35403 - DNA, 21 bp, Artificial Sequence
  Synthetic
catagggtatgcgccacggat

SEQ ID NO: 35404 - DNA, 22 bp, Artificial Sequence
  Synthetic
ggcctggtgcgtcaatgatgac

SEQ ID NO: 35405 - DNA, 20 bp, Artificial Sequence
  Synthetic
cctggcccttctcgaccatg

SEQ ID NO: 35406 - DNA, 19 bp, Artificial Sequence
  Synthetic
taccgggggtgaggttgcg

SEQ ID NO: 35407 - DNA, 20 bp, Artificial Sequence
  Synthetic
ctggtcatactcggcagcgg

SEQ ID NO: 35408 - DNA, 20 bp, Artificial Sequence
  Synthetic
atagcaacccgatgcccagc

SEQ ID NO: 35409 - DNA, 21 bp, Artificial Sequence
  Synthetic
tctactgggggtatggatgct

SEQ ID NO: 35410 - DNA, 22 bp, Artificial Sequence
  Synthetic
cgttcctgttgctttttttgga

SEQ ID NO: 35411 - DNA, 21 bp, Artificial Sequence
  Synthetic
cgagatacgagacgcgcttaa

SEQ ID NO: 35412 - DNA, 20 bp, Artificial Sequence
  Synthetic
agttggaatgatccccgctg

SEQ ID NO: 35413 - DNA, 20 bp, Artificial Sequence
  Synthetic
tgaacacatttcgcgcgttt

SEQ ID NO: 35414 - DNA, 23 bp, Artificial Sequence
  Synthetic
cccgtttaaaatgccaactggat

SEQ ID NO: 35415 - DNA, 21 bp, Artificial Sequence
  Synthetic
ggagacggtgttggaggggag

SEQ ID NO: 35416 - DNA, 18 bp, Artificial Sequence
  Synthetic
ttgcaaggacctcgcgcg

SEQ ID NO: 35417 - DNA, 19 bp, Artificial Sequence
  Synthetic
acacctcgcgtccctggac

SEQ ID NO: 35418 - DNA, 20 bp, Artificial Sequence
  Synthetic
tttctttccccctggcctta

SEQ ID NO: 35419 - DNA, 22 bp, Artificial Sequence
  Synthetic
tggatgcactctatcccattct

SEQ ID NO: 35420 - DNA, 20 bp, Artificial Sequence
  Synthetic
tccctgtggaagcacattgt

SEQ ID NO: 35421 - DNA, 20 bp, Artificial Sequence
  Synthetic
ctggcagcactataggctgt

SEQ ID NO: 35422 - DNA, 23 bp, Artificial Sequence
  Synthetic
tctcatgttcatcttgggcctta

SEQ ID NO: 35423 - DNA, 21 bp, Artificial Sequence
  Synthetic
gctgtttcctgccctgtttct

SEQ ID NO: 35424 - DNA, 23 bp, Artificial Sequence
  Synthetic
tgagggctttcatagtgatgtct

SEQ ID NO: 35425 - DNA, 24 bp, Artificial Sequence
  Synthetic
tgtcctgcttgatattcacaccta

SEQ ID NO: 35426 - DNA, 20 bp, Artificial Sequence
  Synthetic
cctgcccaagtatccccata

SEQ ID NO: 35427 - DNA, 24 bp, Artificial Sequence
  Synthetic
gtgtacattgtactgtgctgacat

SEQ ID NO: 35428 - DNA, 21 bp, Artificial Sequence
  Synthetic
gtactccggatgcagctctcg

SEQ ID NO: 35429 - DNA, 19 bp, Artificial Sequence
  Synthetic
tcctccgagtcgctgctgg

SEQ ID NO: 35430 - DNA, 21 bp, Artificial Sequence
  Synthetic
ggtcgccatatgcttcacgcc

SEQ ID NO: 35431 - DNA, 20 bp, Artificial Sequence
  Synthetic
tgtcattttccggggctgcg

SEQ ID NO: 35432 - DNA, 22 bp, Artificial Sequence
  Synthetic
cagcagctggacgtgttctact

SEQ ID NO: 35433 - DNA, 20 bp, Artificial Sequence
  Synthetic
tcgtgaagacccagggggag

SEQ ID NO: 35434 - DNA, 19 bp, Artificial Sequence
  Synthetic
acaggcgctcgaggtcctg

SEQ ID NO: 35435 - DNA, 20 bp, Artificial Sequence
  Synthetic
acatcagcaggcagacgagc

SEQ ID NO: 35436 - DNA, 19 bp, Artificial Sequence
  Synthetic
gcgtcgtggcatggaagcc

SEQ ID NO: 35437 - DNA, 19 bp, Artificial Sequence
  Synthetic
acgtgaccgacggcccctt

SEQ ID NO: 35438 - DNA, 19 bp, Artificial Sequence
  Synthetic
cctaaacgtcgcccccgtc

SEQ ID NO: 35439 - DNA, 22 bp, Artificial Sequence
  Synthetic
cgggtggtcatctacacaacgg

SEQ ID NO: 35440 - DNA, 18 bp, Artificial Sequence
  Synthetic
gctcgggttctcgctgca

SEQ ID NO: 35441 - DNA, 19 bp, Artificial Sequence
  Synthetic
aggcgcggctaaagtcccg

SEQ ID NO: 35442 - DNA, 18 bp, Artificial Sequence
  Synthetic
agcggtgcagggcctgaa

SEQ ID NO: 35443 - DNA, 20 bp, Artificial Sequence
  Synthetic
gggttcaatcgccgcctctg

SEQ ID NO: 35444 - DNA, 19 bp, Artificial Sequence
  Synthetic
tgggcgccatggacctgac

SEQ ID NO: 35445 - DNA, 19 bp, Artificial Sequence
  Synthetic
tccgttctcacgcgctggg

SEQ ID NO: 35446 - DNA, 19 bp, Artificial Sequence
  Synthetic
gtacacgttgccgttcgcg

SEQ ID NO: 35447 - DNA, 21 bp, Artificial Sequence
  Synthetic
gctggaggaccacgagtttgt

SEQ ID NO: 35448 - DNA, 19 bp, Artificial Sequence
  Synthetic
gcttcatcatgggcgcggg

SEQ ID NO: 35449 - DNA, 19 bp, Artificial Sequence
  Synthetic
gccgcgagcatcttcgtgg

SEQ ID NO: 35450 - DNA, 20 bp, Artificial Sequence
  Synthetic
gtaggggttgcagggcacat

SEQ ID NO: 35451 - DNA, 19 bp, Artificial Sequence
  Synthetic
gtggcgaccgtcaagtccc

SEQ ID NO: 35452 - DNA, 19 bp, Artificial Sequence
  Synthetic
atgatgctggcggtgccgg

SEQ ID NO: 35453 - DNA, 18 bp, Artificial Sequence
  Synthetic
ttgtcgttgccgcgggtg

SEQ ID NO: 35454 - DNA, 19 bp, Artificial Sequence
  Synthetic
accgagagcgacgcctgac

SEQ ID NO: 35455 - DNA, 20 bp, Artificial Sequence
  Synthetic
ccagcggttcaggatgctga

SEQ ID NO: 35456 - DNA, 18 bp, Artificial Sequence
  Synthetic
actggctgcccgatccga

SEQ ID NO: 35457 - DNA, 19 bp, Artificial Sequence
  Synthetic
tacactaccgcggtcccgg

SEQ ID NO: 35458 - DNA, 19 bp, Artificial Sequence
  Synthetic
ccccatcggcattccggtt

SEQ ID NO: 35459 - DNA, 21 bp, Artificial Sequence
  Synthetic
taacctccacgggagccgcaa

SEQ ID NO: 35460 - DNA, 19 bp, Artificial Sequence
  Synthetic
tggaggacgcggatctccc

SEQ ID NO: 35461 - DNA, 19 bp, Artificial Sequence
  Synthetic
agaaaggtccgggccgtcg

SEQ ID NO: 35462 - DNA, 21 bp, Artificial Sequence
  Synthetic
agaaaccaaccgacgaccacc

SEQ ID NO: 35463 - DNA, 19 bp, Artificial Sequence
  Synthetic
gacgtgggtgatgtccggg

SEQ ID NO: 35464 - DNA, 19 bp, Artificial Sequence
  Synthetic
gcgaatccccaccatggcg

SEQ ID NO: 35465 - DNA, 21 bp, Artificial Sequence
  Synthetic
tacctttccctagcggccccg

SEQ ID NO: 35466 - DNA, 19 bp, Artificial Sequence
  Synthetic
gcgcaacacgtgtcccctg

SEQ ID NO: 35467 - DNA, 17 bp, Artificial Sequence
  Synthetic
acgcagcgcccgtgttt

SEQ ID NO: 35468 - DNA, 22 bp, Artificial Sequence
  Synthetic
tgctaaggcgtatttggcgcag

SEQ ID NO: 35469 - DNA, 20 bp, Artificial Sequence
  Synthetic
gcaggcacgttccagcactg

SEQ ID NO: 35470 - DNA, 19 bp, Artificial Sequence
  Synthetic
tcgcgctgccgacccatac

SEQ ID NO: 35471 - DNA, 23 bp, Artificial Sequence
  Synthetic
acagtcctaccatacatcgaaca

SEQ ID NO: 35472 - DNA, 20 bp, Artificial Sequence
  Synthetic
aatagtaggcggccacaacc

SEQ ID NO: 35473 - DNA, 24 bp, Artificial Sequence
  Synthetic
tgttttataccccctgtacccata

SEQ ID NO: 35474 - DNA, 24 bp, Artificial Sequence
  Synthetic
ggttttcgggatcattgtcaaaca

SEQ ID NO: 35475 - DNA, 20 bp, Artificial Sequence
  Synthetic
cacagcttttctgcgtgtgc

SEQ ID NO: 35476 - DNA, 19 bp, Artificial Sequence
  Synthetic
actgtgccaccgccaccac

SEQ ID NO: 35477 - DNA, 20 bp, Artificial Sequence
  Synthetic
ctactgaggcgacgcacgtc

SEQ ID NO: 35478 - DNA, 20 bp, Artificial Sequence
  Synthetic
tagtcccctcaccggattgc

SEQ ID NO: 35479 - DNA, 20 bp, Artificial Sequence
  Synthetic
tgcgtctcacgtattcctct

SEQ ID NO: 35480 - DNA, 23 bp, Artificial Sequence
  Synthetic
tgttacaccaatacctaagggct

SEQ ID NO: 35481 - DNA, 20 bp, Artificial Sequence
  Synthetic
atgaagaagcatccccctca

SEQ ID NO: 35482 - DNA, 22 bp, Artificial Sequence
  Synthetic
tgggtcagtggaggtatcatct

SEQ ID NO: 35483 - DNA, 23 bp, Artificial Sequence
  Synthetic
actcagatctgctacagaatgct

SEQ ID NO: 35484 - DNA, 20 bp, Artificial Sequence
  Synthetic
gtgcatcgaaacgctctgtc

SEQ ID NO: 35485 - DNA, 20 bp, Artificial Sequence
  Synthetic
ttcgggcctatttccacacc

SEQ ID NO: 35486 - DNA, 20 bp, Artificial Sequence
  Synthetic
cgctgtaggtctgcttggag

SEQ ID NO: 35487 - DNA, 22 bp, Artificial Sequence
  Synthetic
tcgtttctgcaaacagtgtcat

SEQ ID NO: 35488 - DNA, 22 bp, Artificial Sequence
  Synthetic
aggttgtagaggagtcgtcccg

SEQ ID NO: 35489 - DNA, 22 bp, Artificial Sequence
  Synthetic
tcgtgctccaacttgtgaagca

SEQ ID NO: 35490 - DNA, 23 bp, Artificial Sequence
  Synthetic
tcgaaggagcctaaagaaaaagc

SEQ ID NO: 35491 - DNA, 22 bp, Artificial Sequence
  Synthetic
ggacgaataccagtggtaaccc

SEQ ID NO: 35492 - DNA, 23 bp, Artificial Sequence
  Synthetic
cctgtaccagcattaacatccac

SEQ ID NO: 35493 - DNA, 24 bp, Artificial Sequence
  Synthetic
ggttgttccactatatctggtgtc

SEQ ID NO: 35494 - DNA, 22 bp, Artificial Sequence
  Synthetic
cccaatgtttccaacgcaatga

SEQ ID NO: 35495 - DNA, 20 bp, Artificial Sequence
  Synthetic
caaaggtcctccccttccaa

SEQ ID NO: 35496 - DNA, 23 bp, Artificial Sequence
  Synthetic
tgtcatcatttgagctgccttag

SEQ ID NO: 35497 - DNA, 25 bp, Artificial Sequence
  Synthetic
ttaacttttactccggaaccagaaa

SEQ ID NO: 35498 - DNA, 24 bp, Artificial Sequence
  Synthetic
tgttgcaacaattcttcctgatga

SEQ ID NO: 35499 - DNA, 20 bp, Artificial Sequence
  Synthetic
cggtaaaagcgttcagcctc

SEQ ID NO: 35500 - DNA, 22 bp, Artificial Sequence
  Synthetic
agctgcggacttttgattaact

SEQ ID NO: 35501 - DNA, 25 bp, Artificial Sequence
  Synthetic
ccaacaaacaccagacaattcttct

SEQ ID NO: 35502 - DNA, 20 bp, Artificial Sequence
  Synthetic
cttgcagtgcaacgaaacgt

SEQ ID NO: 35503 - DNA, 20 bp, Artificial Sequence
  Synthetic
ctggaggacagttgccagta

SEQ ID NO: 35504 - DNA, 21 bp, Artificial Sequence
  Synthetic
ggcaagtgcaaaacgttttgg

SEQ ID NO: 35505 - DNA, 24 bp, Artificial Sequence
  Synthetic
ccgggttaaaaagtcaacattgtc

SEQ ID NO: 35506 - DNA, 20 bp, Artificial Sequence
  Synthetic
gtagtgcacacgaggaccta

SEQ ID NO: 35507 - DNA, 23 bp, Artificial Sequence
  Synthetic
ccagtttgttgttgccataatgc

SEQ ID NO: 35508 - DNA, 25 bp, Artificial Sequence
  Synthetic
ggcaaatttatttggatcaggcaat

SEQ ID NO: 35509 - DNA, 20 bp, Artificial Sequence
  Synthetic
ttcgcctgatctccaacaca

SEQ ID NO: 35510 - DNA, 24 bp, Artificial Sequence
  Synthetic
ctctatactctgaggaggaggagg

SEQ ID NO: 35511 - DNA, 21 bp, Artificial Sequence
  Synthetic
gacagctggattacttcgctg

SEQ ID NO: 35512 - DNA, 20 bp, Artificial Sequence
  Synthetic
ctagcacatgcgtcagcttt

SEQ ID NO: 35513 - DNA, 20 bp, Artificial Sequence
  Synthetic
ccacacgaggtgtcaactct

SEQ ID NO: 35514 - DNA, 21 bp, Artificial Sequence
  Synthetic
acccgtttgtgctttcttcaa

SEQ ID NO: 35515 - DNA, 22 bp, Artificial Sequence
  Synthetic
gcctctacctgcaaaagttcat

SEQ ID NO: 35516 - DNA, 20 bp, Artificial Sequence
  Synthetic
aaagccaccagttcccttcc

SEQ ID NO: 35517 - DNA, 23 bp, Artificial Sequence
  Synthetic
cctcctcaattgcaaattcagca

SEQ ID NO: 35518 - DNA, 25 bp, Artificial Sequence
  Synthetic
tctgcagaattgtgaataggaaagt

SEQ ID NO: 35519 - DNA, 20 bp, Artificial Sequence
  Synthetic
tgtgccgctggatattcaac

SEQ ID NO: 35520 - DNA, 25 bp, Artificial Sequence
  Synthetic
aacatttttgtggctacaaatgcca

SEQ ID NO: 35521 - DNA, 20 bp, Artificial Sequence
  Synthetic
attccggccacttgtctagc

SEQ ID NO: 35522 - DNA, 22 bp, Artificial Sequence
  Synthetic
ccgtggggaattcctagcctca

SEQ ID NO: 35523 - DNA, 20 bp, Artificial Sequence
  Synthetic
atcgggcaacttccaacacc

SEQ ID NO: 35524 - DNA, 24 bp, Artificial Sequence
  Synthetic
gcaacttcaacagtgtctagatca

SEQ ID NO: 35525 - DNA, 24 bp, Artificial Sequence
  Synthetic
tctgctcattttgtctatctgcat

SEQ ID NO: 35526 - DNA, 22 bp, Artificial Sequence
  Synthetic
acatgtgttcccaacattgctt

SEQ ID NO: 35527 - DNA, 20 bp, Artificial Sequence
  Synthetic
catgcacacaagctgctctg

SEQ ID NO: 35528 - DNA, 20 bp, Artificial Sequence
  Synthetic
cttagggttaggtgcaccgg

SEQ ID NO: 35529 - DNA, 21 bp, Artificial Sequence
  Synthetic
tgcagtgggggatagtttctg

SEQ ID NO: 35530 - DNA, 21 bp, Artificial Sequence
  Synthetic
caccagctgttaacaatccga

SEQ ID NO: 35531 - DNA, 25 bp, Artificial Sequence
  Synthetic
tgtctagttgctttagtttgctaca

SEQ ID NO: 35532 - DNA, 20 bp, Artificial Sequence
  Synthetic
acctggtgtgccgtgtatta

SEQ ID NO: 35533 - DNA, 22 bp, Artificial Sequence
  Synthetic
caagctcgacaatcatcggatt

SEQ ID NO: 35534 - DNA, 21 bp, Artificial Sequence
  Synthetic
ggagccacatcttctccaatc

SEQ ID NO: 35535 - DNA, 21 bp, Artificial Sequence
  Synthetic
tcacaaagtttaccacgtcgg

SEQ ID NO: 35536 - DNA, 21 bp, Artificial Sequence
  Synthetic
gccatatggtccacagttgtt

SEQ ID NO: 35537 - DNA, 24 bp, Artificial Sequence
  Synthetic
gctccttcttcttttccttggtaa

SEQ ID NO: 35538 - DNA, 20 bp, Artificial Sequence
  Synthetic
gggtctgctgatactgttgc

SEQ ID NO: 35539 - DNA, 20 bp, Artificial Sequence
  Synthetic
gcctcaggagttgatgcatg

SEQ ID NO: 35540 - DNA, 23 bp, Artificial Sequence
  Synthetic
tcactaacctcttcaggagacag

SEQ ID NO: 35541 - DNA, 25 bp, Artificial Sequence
  Synthetic
gctgctgcaaatggtaatagcttta

SEQ ID NO: 35542 - DNA, 24 bp, Artificial Sequence
  Synthetic
acccacttaaacaatggttacacc

SEQ ID NO: 35543 - DNA, 21 bp, Artificial Sequence
  Synthetic
agttggggtcccagacgaaga

SEQ ID NO: 35544 - DNA, 21 bp, Artificial Sequence
  Synthetic
cgtgcaactgatcgatggcta

SEQ ID NO: 35545 - DNA, 25 bp, Artificial Sequence
  Synthetic
aactcagttgtcacatctatggttt

SEQ ID NO: 35546 - DNA, 21 bp, Artificial Sequence
  Synthetic
gccaacagtcaacagtctgtc

SEQ ID NO: 35547 - DNA, 23 bp, Artificial Sequence
  Synthetic
ctgtcaaataacggatgaccagt

SEQ ID NO: 35548 - DNA, 22 bp, Artificial Sequence
  Synthetic
gccatggctagacgctttctgc

SEQ ID NO: 35549 - DNA, 22 bp, Artificial Sequence
  Synthetic
ccgggaacttgacgtccattgg

SEQ ID NO: 35550 - DNA, 20 bp, Artificial Sequence
  Synthetic
aagccgttctgagcaacccg

SEQ ID NO: 35551 - DNA, 21 bp, Artificial Sequence
  Synthetic
aggcaagatagcaagctgcgt

SEQ ID NO: 35552 - DNA, 19 bp, Artificial Sequence
  Synthetic
acgacgagccgctccaatg

SEQ ID NO: 35553 - DNA, 21 bp, Artificial Sequence
  Synthetic
caccgttgatagtggtcgcca

SEQ ID NO: 35554 - DNA, 19 bp, Artificial Sequence
  Synthetic
acacggccgccctgaagag

SEQ ID NO: 35555 - DNA, 22 bp, Artificial Sequence
  Synthetic
gctcctcctgaacatcccccat

SEQ ID NO: 35556 - DNA, 22 bp, Artificial Sequence
  Synthetic
gtctttccccctgcgagacaaa

SEQ ID NO: 35557 - DNA, 22 bp, Artificial Sequence
  Synthetic
gggtcggcttaagtctggtgag

SEQ ID NO: 35558 - DNA, 21 bp, Artificial Sequence
  Synthetic
cagcaatttgagccccgcatg

SEQ ID NO: 35559 - DNA, 21 bp, Artificial Sequence
  Synthetic
ctaagcaggggtttgcagggt

SEQ ID NO: 35560 - DNA, 22 bp, Artificial Sequence
  Synthetic
tgaggtgctagtgtcctccaca

SEQ ID NO: 35561 - DNA, 20 bp, Artificial Sequence
  Synthetic
acaattaaccgcgcgggctt

SEQ ID NO: 35562 - DNA, 22 bp, Artificial Sequence
  Synthetic
agttaaacatcgggccaccaca

SEQ ID NO: 35563 - DNA, 20 bp, Artificial Sequence
  Synthetic
gccatcgtgggctacggaga

SEQ ID NO: 35564 - DNA, 20 bp, Artificial Sequence
  Synthetic
tggctttgcgttgctcatct

SEQ ID NO: 35565 - DNA, 22 bp, Artificial Sequence
  Synthetic
gcctgaaccagctcttttaact

SEQ ID NO: 35566 - DNA, 20 bp, Artificial Sequence
  Synthetic
cgattccagccccttgagtg

SEQ ID NO: 35567 - DNA, 20 bp, Artificial Sequence
  Synthetic
tggggttgtagtctgggtcg

SEQ ID NO: 35568 - DNA, 25 bp, Artificial Sequence
  Synthetic
agtaataaaagtaggtggcagcttt

SEQ ID NO: 35569 - DNA, 21 bp, Artificial Sequence
  Synthetic
gaacaggttgcagtcccaatt

SEQ ID NO: 35570 - DNA, 23 bp, Artificial Sequence
  Synthetic
acatttcagcatcctgagcaaat

SEQ ID NO: 35571 - DNA, 22 bp, Artificial Sequence
  Synthetic
tggatccctagcttcttcttgt

SEQ ID NO: 35572 - DNA, 22 bp, Artificial Sequence
  Synthetic
ctagttttccttcccgcctcta

SEQ ID NO: 35573 - DNA, 25 bp, Artificial Sequence
  Synthetic
actgagctatagggtctacaaaagt

SEQ ID NO: 35574 - DNA, 24 bp, Artificial Sequence
  Synthetic
aaagtaaggatgaccaacggtaag

SEQ ID NO: 35575 - DNA, 22 bp, Artificial Sequence
  Synthetic
gctctgccagcaatgaaatgtt

SEQ ID NO: 35576 - DNA, 24 bp, Artificial Sequence
  Synthetic
aactgctttgtccatgttatttgg

SEQ ID NO: 35577 - DNA, 24 bp, Artificial Sequence
  Synthetic
tccacaatatcaagtgcaagatcc

SEQ ID NO: 35578 - DNA, 24 bp, Artificial Sequence
  Synthetic
ccactacagcctctacataaaacc

SEQ ID NO: 35579 - DNA, 21 bp, Artificial Sequence
  Synthetic
tggcaaagagtctccatcgtt

SEQ ID NO: 35580 - DNA, 25 bp, Artificial Sequence
  Synthetic
tgttggtgcagttaaatacacttca

SEQ ID NO: 35581 - DNA, 21 bp, Artificial Sequence
  Synthetic
gcaagtagacagtggcctcac

SEQ ID NO: 35582 - DNA, 23 bp, Artificial Sequence
  Synthetic
atcacctggatttactgcaacat

SEQ ID NO: 35583 - DNA, 25 bp, Artificial Sequence
  Synthetic
gtctggtacattttcaccaacagta

SEQ ID NO: 35584 - DNA, 20 bp, Artificial Sequence
  Synthetic
tcatcctcctcctctgagct

SEQ ID NO: 35585 - DNA, 20 bp, Artificial Sequence
  Synthetic
attgccttttccgcaagctc

SEQ ID NO: 35586 - DNA, 20 bp, Artificial Sequence
  Synthetic
tgggtttttcggctcctgtg

SEQ ID NO: 35587 - DNA, 20 bp, Artificial Sequence
  Synthetic
gttcgattggggcaacatct

SEQ ID NO: 35588 - DNA, 21 bp, Artificial Sequence
  Synthetic
gttgtccctcactctcctctt

SEQ ID NO: 35589 - DNA, 21 bp, Artificial Sequence
  Synthetic
ggaggccagattgctcaagtt

SEQ ID NO: 35590 - DNA, 25 bp, Artificial Sequence
  Synthetic
ttcgaacatgtacccttttcctaat

SEQ ID NO: 35591 - DNA, 20 bp, Artificial Sequence
  Synthetic
accaacgctcatgtcagctg

SEQ ID NO: 35592 - DNA, 21 bp, Artificial Sequence
  Synthetic
ggaatgtggaggttccggata

SEQ ID NO: 35593 - DNA, 20 bp, Artificial Sequence
  Synthetic
aggaaaaagctggcaacgac

SEQ ID NO: 35594 - DNA, 21 bp, Artificial Sequence
  Synthetic
gcagactaacatgcctagcac

SEQ ID NO: 35595 - DNA, 24 bp, Artificial Sequence
  Synthetic
ttggttcttcttgactcaccaaat

SEQ ID NO: 35596 - DNA, 22 bp, Artificial Sequence
  Synthetic
gtcggtcatcttagtgtcgttg

SEQ ID NO: 35597 - DNA, 25 bp, Artificial Sequence
  Synthetic
tgcggaggactgtttaagtactttc

SEQ ID NO: 35598 - DNA, 20 bp, Artificial Sequence
  Synthetic
tcctatacagtcacgcaccc

SEQ ID NO: 35599 - DNA, 20 bp, Artificial Sequence
  Synthetic
gctttatcctgggaagctgc

SEQ ID NO: 35600 - DNA, 20 bp, Artificial Sequence
  Synthetic
acccacccttaggaaccgtc

SEQ ID NO: 35601 - DNA, 22 bp, Artificial Sequence
  Synthetic
cagcaggactttcttgtggaat

SEQ ID NO: 35602 - DNA, 23 bp, Artificial Sequence
  Synthetic
ggagaaactttaggcacagtcat

SEQ ID NO: 35603 - DNA, 25 bp, Artificial Sequence
  Synthetic
gccaattagaaacatttgggtttgt

SEQ ID NO: 35604 - DNA, 24 bp, Artificial Sequence
  Synthetic
tgactcgaagacaggtaaatgaca

SEQ ID NO: 35605 - DNA, 21 bp, Artificial Sequence
  Synthetic
acaagcaggcaggcaggattt

SEQ ID NO: 35606 - DNA, 22 bp, Artificial Sequence
  Synthetic
tgacaaaaacgtctcctttgga

SEQ ID NO: 35607 - DNA, 24 bp, Artificial Sequence
  Synthetic
tccattatctggacctgaaattcc

SEQ ID NO: 35608 - DNA, 22 bp, Artificial Sequence
  Synthetic
gtctggaactgtgacttttggt

SEQ ID NO: 35609 - DNA, 25 bp, Artificial Sequence
  Synthetic
gctcaagtttctcacagatactcct

SEQ ID NO: 35610 - DNA, 21 bp, Artificial Sequence
  Synthetic
gtgtacctcttctgcccaaga

SEQ ID NO: 35611 - DNA, 21 bp, Artificial Sequence
  Synthetic
cagacactccaaagctgggca

SEQ ID NO: 35612 - DNA, 20 bp, Artificial Sequence
  Synthetic
gcctgtgctgtctctagctc

SEQ ID NO: 35613 - DNA, 21 bp, Artificial Sequence
  Synthetic
tcgtttttgggctcgcctata

SEQ ID NO: 35614 - DNA, 23 bp, Artificial Sequence
  Synthetic
ttcccaacgtattagttgccaat

SEQ ID NO: 35615 - DNA, 22 bp, Artificial Sequence
  Synthetic
acactgtcccatgctacatagg

SEQ ID NO: 35616 - DNA, 22 bp, Artificial Sequence
  Synthetic
tggtcgctatgttttcgcaatc

SEQ ID NO: 35617 - DNA, 20 bp, Artificial Sequence
  Synthetic
cagacagatggcaaaagcgg

SEQ ID NO: 35618 - DNA, 20 bp, Artificial Sequence
  Synthetic
agtgtccacaggctcaaagg

SEQ ID NO: 35619 - DNA, 23 bp, Artificial Sequence
  Synthetic
caaacaagtcattgtcctccgtg

SEQ ID NO: 35620 - DNA, 20 bp, Artificial Sequence
  Synthetic
aaaagctgctcacgccgtaa

SEQ ID NO: 35621 - DNA, 22 bp, Artificial Sequence
  Synthetic
ggtactgggagtggtatctacc

SEQ ID NO: 35622 - DNA, 25 bp, Artificial Sequence
  Synthetic
acaatatatagcccaacaagcaaca

SEQ ID NO: 35623 - DNA, 25 bp, Artificial Sequence
  Synthetic
ccctgattgttcaagtttctcacat

SEQ ID NO: 35624 - DNA, 20 bp, Artificial Sequence
  Synthetic
accaaaactgggaagctcca

SEQ ID NO: 35625 - DNA, 25 bp, Artificial Sequence
  Synthetic
gcacctttggtacatttgttcatct

SEQ ID NO: 35626 - DNA, 22 bp, Artificial Sequence
  Synthetic
ccggaccgatagacgtaccctt

SEQ ID NO: 35627 - DNA, 21 bp, Artificial Sequence
  Synthetic
cccccactggcattgtcaacc

SEQ ID NO: 35628 - DNA, 19 bp, Artificial Sequence
  Synthetic
aagctctccgggctgggag

SEQ ID NO: 35629 - DNA, 21 bp, Artificial Sequence
  Synthetic
gggggcagactctaggcagag

SEQ ID NO: 35630 - DNA, 21 bp, Artificial Sequence
  Synthetic
aaaaggtgccctgaccatgct

SEQ ID NO: 35631 - DNA, 22 bp, Artificial Sequence
  Synthetic
tcccgggaagtcaaaagcgaat

SEQ ID NO: 35632 - DNA, 19 bp, Artificial Sequence
  Synthetic
tggtcgagttcgggcaggg

SEQ ID NO: 35633 - DNA, 22 bp, Artificial Sequence
  Synthetic
cccaaggtaagcgaccacacaa

SEQ ID NO: 35634 - DNA, 22 bp, Artificial Sequence
  Synthetic
gacccattggaccagccattgt

SEQ ID NO: 35635 - DNA, 20 bp, Artificial Sequence
  Synthetic
aactagcatgcccacagcgt

SEQ ID NO: 35636 - DNA, 22 bp, Artificial Sequence
  Synthetic
agtggcagaaaagcaggtgtct

SEQ ID NO: 35637 - DNA, 19 bp, Artificial Sequence
  Synthetic
ctaccacgtccacaccgcc

SEQ ID NO: 35638 - DNA, 22 bp, Artificial Sequence
  Synthetic
cggcccctttcctttgatacca

SEQ ID NO: 35639 - DNA, 21 bp, Artificial Sequence
  Synthetic
ccaccaacgcctcaatccagt

SEQ ID NO: 35640 - DNA, 22 bp, Artificial Sequence
  Synthetic
gcctcttggctagggagatgca

SEQ ID NO: 35641 - DNA, 22 bp, Artificial Sequence
  Synthetic
aggggggtggtaacctggattt

SEQ ID NO: 35642 - DNA, 22 bp, Artificial Sequence
  Synthetic
catgcttgacagggtcacacct

SEQ ID NO: 35643 - DNA, 22 bp, Artificial Sequence
  Synthetic
gatcaacacgtgcggaatcagc

SEQ ID NO: 35644 - DNA, 20 bp, Artificial Sequence
  Synthetic
cagggatgcctaaggcttca

SEQ ID NO: 35645 - DNA, 22 bp, Artificial Sequence
  Synthetic
cttatgaaagggaaggcctctg

SEQ ID NO: 35646 - DNA, 20 bp, Artificial Sequence
  Synthetic
tgaacctccctcgtcatccg

SEQ ID NO: 35647 - DNA, 22 bp, Artificial Sequence
  Synthetic
tgaaatgcccattggaccattg

SEQ ID NO: 35648 - DNA, 25 bp, Artificial Sequence
  Synthetic
cattgcaaatgatgactttccagaa

SEQ ID NO: 35649 - DNA, 20 bp, Artificial Sequence
  Synthetic
gcttgtcctcctggcgaccc

SEQ ID NO: 35650 - DNA, 22 bp, Artificial Sequence
  Synthetic
gaccttcctctggatcgcgatc

SEQ ID NO: 35651 - DNA, 20 bp, Artificial Sequence
  Synthetic
actcctttggggtatcgcac

SEQ ID NO: 35652 - DNA, 20 bp, Artificial Sequence
  Synthetic
ttttgagcttggccatcagc

SEQ ID NO: 35653 - DNA, 22 bp, Artificial Sequence
  Synthetic
cactgcttttgtaccgttaacg

SEQ ID NO: 35654 - DNA, 23 bp, Artificial Sequence
  Synthetic
catagtcgttgctaagatggcaa

SEQ ID NO: 35655 - DNA, 20 bp, Artificial Sequence
  Synthetic
ccgcctgcagaaagcctaat

SEQ ID NO: 35656 - DNA, 20 bp, Artificial Sequence
  Synthetic
atgccttcccatcatggcag

SEQ ID NO: 35657 - DNA, 20 bp, Artificial Sequence
  Synthetic
tccacatgctgagcacttcc

SEQ ID NO: 35658 - DNA, 23 bp, Artificial Sequence
  Synthetic
ttcacccagttttaccaccattt

SEQ ID NO: 35659 - DNA, 22 bp, Artificial Sequence
  Synthetic
tcccaatgaaagcatttccact

SEQ ID NO: 35660 - DNA, 21 bp, Artificial Sequence
  Synthetic
agggtgtaacgttttcggttg

SEQ ID NO: 35661 - DNA, 23 bp, Artificial Sequence
  Synthetic
tcttgatgctacaacacacagtc

SEQ ID NO: 35662 - DNA, 20 bp, Artificial Sequence
  Synthetic
ggctgcagtcaacctcatct

SEQ ID NO: 35663 - DNA, 23 bp, Artificial Sequence
  Synthetic
actcaaatcaaacgagtctgcat

SEQ ID NO: 35664 - DNA, 25 bp, Artificial Sequence
  Synthetic
cccatttttccatccaataatggtt

SEQ ID NO: 35665 - DNA, 22 bp, Artificial Sequence
  Synthetic
cgtccttggaggagctgacaga

SEQ ID NO: 35666 - DNA, 24 bp, Artificial Sequence
  Synthetic
tcatgcactggatttattggttct

SEQ ID NO: 35667 - DNA, 24 bp, Artificial Sequence
  Synthetic
tgattggcagaaacctttggaatt

SEQ ID NO: 35668 - DNA, 24 bp, Artificial Sequence
  Synthetic
ggtacactggctctgtcttgatta

SEQ ID NO: 35669 - DNA, 24 bp, Artificial Sequence
  Synthetic
gcgattgaatattccagagtcact

SEQ ID NO: 35670 - DNA, 24 bp, Artificial Sequence
  Synthetic
acccaatggtgtctgagataattc

SEQ ID NO: 35671 - DNA, 20 bp, Artificial Sequence
  Synthetic
tttgcgctggaacctttagg

SEQ ID NO: 35672 - DNA, 25 bp, Artificial Sequence
  Synthetic
tgtgttgttatctccatttcctctt

SEQ ID NO: 35673 - DNA, 23 bp, Artificial Sequence
  Synthetic
gactgttcaagcttttcgcaaat

SEQ ID NO: 35674 - DNA, 25 bp, Artificial Sequence
  Synthetic
tttcctagtcttgccattttgtttg

SEQ ID NO: 35675 - DNA, 25 bp, Artificial Sequence
  Synthetic
actccaatactcatatcagctgact

SEQ ID NO: 35676 - DNA, 20 bp, Artificial Sequence
  Synthetic
ggtcccccatctgataccaa

SEQ ID NO: 35677 - DNA, 23 bp, Artificial Sequence
  Synthetic
cactaagcaaattcacaggcaaa

SEQ ID NO: 35678 - DNA, 21 bp, Artificial Sequence
  Synthetic
ctcaaatcagaggcgagcttt

SEQ ID NO: 35679 - DNA, 23 bp, Artificial Sequence
  Synthetic
gtccattgtccagatttgccata

SEQ ID NO: 35680 - DNA, 20 bp, Artificial Sequence
  Synthetic
tgattttgggcccaaccact

SEQ ID NO: 35681 - DNA, 20 bp, Artificial Sequence
  Synthetic
gcaaatccaacatcaggggc

SEQ ID NO: 35682 - DNA, 21 bp, Artificial Sequence
  Synthetic
ctacagtgtctcctgcaaagc

SEQ ID NO: 35683 - DNA, 25 bp, Artificial Sequence
  Synthetic
tctttcacatattcatcggtgctta

SEQ ID NO: 35684 - DNA, 23 bp, Artificial Sequence
  Synthetic
tctcccatatcaccatcctgaat

SEQ ID NO: 35685 - DNA, 22 bp, Artificial Sequence
  Synthetic
gaaaggcttacacactgcaact

SEQ ID NO: 35686 - DNA, 20 bp, Artificial Sequence
  Synthetic
atgccgctggggactctctg

SEQ ID NO: 35687 - DNA, 24 bp, Artificial Sequence
  Synthetic
cttttaagcaaataagggggggac

SEQ ID NO: 35688 - DNA, 20 bp, Artificial Sequence
  Synthetic
attgcagctgtatcgtctgc

SEQ ID NO: 35689 - DNA, 25 bp, Artificial Sequence
  Synthetic
gatatgcacgttttcttttacgtct

SEQ ID NO: 35690 - DNA, 25 bp, Artificial Sequence
  Synthetic
gtcaaagaatttgttcttgcagcta

SEQ ID NO: 35691 - DNA, 20 bp, Artificial Sequence
  Synthetic
attggccaaagaccctgtga

SEQ ID NO: 35692 - DNA, 25 bp, Artificial Sequence
  Synthetic
cctttaaagaaaagccaaaggtgtt

SEQ ID NO: 35693 - DNA, 20 bp, Artificial Sequence
  Synthetic
aactcctcctcctcgtcctc

SEQ ID NO: 35694 - DNA, 22 bp, Artificial Sequence
  Synthetic
caaagacactgtttgcagacga

SEQ ID NO: 35695 - DNA, 20 bp, Artificial Sequence
  Synthetic
aaagcagtagccacgcttct

SEQ ID NO: 35696 - DNA, 25 bp, Artificial Sequence
  Synthetic
attcatgtaagacactactttgcct

SEQ ID NO: 35697 - DNA, 21 bp, Artificial Sequence
  Synthetic
cgctctctcagcttctccatc

SEQ ID NO: 35698 - DNA, 22 bp, Artificial Sequence
  Synthetic
tcccattctccagtaactgaca

SEQ ID NO: 35699 - DNA, 25 bp, Artificial Sequence
  Synthetic
ctgctggatcaacagtatctatagg

SEQ ID NO: 35700 - DNA, 22 bp, Artificial Sequence
  Synthetic
acaccttcaaagctactcctgg

SEQ ID NO: 35701 - DNA, 20 bp, Artificial Sequence
  Synthetic
tcgggccacttacaggtaga

SEQ ID NO: 35702 - DNA, 20 bp, Artificial Sequence
  Synthetic
cacagccagtaacgaaagcg

SEQ ID NO: 35703 - DNA, 20 bp, Artificial Sequence
  Synthetic
cgtaaggcgacagggcgacc

SEQ ID NO: 35704 - DNA, 20 bp, Artificial Sequence
  Synthetic
cgactcgtggtttggcgtgt

SEQ ID NO: 35705 - DNA, 19 bp, Artificial Sequence
  Synthetic
ttacgcccggcaacctgcg

SEQ ID NO: 35706 - DNA, 21 bp, Artificial Sequence
  Synthetic
gggaccaacacggcttcatgt

SEQ ID NO: 35707 - DNA, 20 bp, Artificial Sequence
  Synthetic
ctgcgaggtgcacagcaaac

SEQ ID NO: 35708 - DNA, 21 bp, Artificial Sequence
  Synthetic
gagggggagttcgtcgtgttc

SEQ ID NO: 35709 - DNA, 20 bp, Artificial Sequence
  Synthetic
tcgagcaccagaaactgcgg

SEQ ID NO: 35710 - DNA, 21 bp, Artificial Sequence
  Synthetic
gctcaaagtccaggaggtccc

SEQ ID NO: 35711 - DNA, 19 bp, Artificial Sequence
  Synthetic
tggggcgaactgtttggcg

SEQ ID NO: 35712 - DNA, 19 bp, Artificial Sequence
  Synthetic
ccccccactacgaccgcta

SEQ ID NO: 35713 - DNA, 21 bp, Artificial Sequence
  Synthetic
tgttgcttcactcgctcaccc

SEQ ID NO: 35714 - DNA, 18 bp, Artificial Sequence
  Synthetic
gctgcgggaagcgatcca

SEQ ID NO: 35715 - DNA, 19 bp, Artificial Sequence
  Synthetic
ggctgatgcgatgggccag

SEQ ID NO: 35716 - DNA, 19 bp, Artificial Sequence
  Synthetic
tcagcacgccaccgacacc

SEQ ID NO: 35717 - DNA, 22 bp, Artificial Sequence
  Synthetic
agcttaagcctctcctggtgct

SEQ ID NO: 35718 - DNA, 18 bp, Artificial Sequence
  Synthetic
tgcggaccaggaggagca

SEQ ID NO: 35719 - DNA, 21 bp, Artificial Sequence
  Synthetic
ccacttggaattggaggcgcg

SEQ ID NO: 35720 - DNA, 20 bp, Artificial Sequence
  Synthetic
cgcgccctcttctgcgagat

SEQ ID NO: 35721 - DNA, 20 bp, Artificial Sequence
  Synthetic
cttggccaacgaggtccagt

SEQ ID NO: 35722 - DNA, 20 bp, Artificial Sequence
  Synthetic
cctggcccccgatgatctcc

SEQ ID NO: 35723 - DNA, 19 bp, Artificial Sequence
  Synthetic
tcgtcgcctggctgaccca

SEQ ID NO: 35724 - DNA, 19 bp, Artificial Sequence
  Synthetic
gcatccgggacctgaaccc

SEQ ID NO: 35725 - DNA, 19 bp, Artificial Sequence
  Synthetic
tgttctcggagcgcgcgtc

SEQ ID NO: 35726 - DNA, 22 bp, Artificial Sequence
  Synthetic
gctactggaacaacacgcggtg

SEQ ID NO: 35727 - DNA, 18 bp, Artificial Sequence
  Synthetic
ttgtcggtggcgtgcgtg

SEQ ID NO: 35728 - DNA, 20 bp, Artificial Sequence
  Synthetic
gacgtaacacggcccagagg

SEQ ID NO: 35729 - DNA, 19 bp, Artificial Sequence
  Synthetic
gcctcgaccctgacgcgtt

SEQ ID NO: 35730 - DNA, 19 bp, Artificial Sequence
  Synthetic
ttcgtgaacgccgcccacg

SEQ ID NO: 35731 - DNA, 20 bp, Artificial Sequence
  Synthetic
cgagcggcttgacctggcta

SEQ ID NO: 35732 - DNA, 19 bp, Artificial Sequence
  Synthetic
tcttcggccagcgccttgt

SEQ ID NO: 35733 - DNA, 20 bp, Artificial Sequence
  Synthetic
ggggtttggtcttggtggcc

SEQ ID NO: 35734 - DNA, 22 bp, Artificial Sequence
  Synthetic
cgggaatcggcgactatgaagc

SEQ ID NO: 35735 - DNA, 19 bp, Artificial Sequence
  Synthetic
aagtcggcactgcgggtgg

SEQ ID NO: 35736 - DNA, 22 bp, Artificial Sequence
  Synthetic
gatacggtacatggccctggtg

SEQ ID NO: 35737 - DNA, 19 bp, Artificial Sequence
  Synthetic
gccgcagtactacctggcc

SEQ ID NO: 35738 - DNA, 19 bp, Artificial Sequence
  Synthetic
cggcggctccttccgattc

SEQ ID NO: 35739 - DNA, 19 bp, Artificial Sequence
  Synthetic
gtccaaccagccgaacccg

SEQ ID NO: 35740 - DNA, 20 bp, Artificial Sequence
  Synthetic
cggcgcgtgatggacatgtt

SEQ ID NO: 35741 - DNA, 19 bp, Artificial Sequence
  Synthetic
gggcggctggagaccatca

SEQ ID NO: 35742 - DNA, 20 bp, Artificial Sequence
  Synthetic
gtgcaccgcatacccgtgta

SEQ ID NO: 35743 - DNA, 21 bp, Artificial Sequence
  Synthetic
cctgggatacgtgtacgctcg

SEQ ID NO: 35744 - DNA, 18 bp, Artificial Sequence
  Synthetic
acacgtcggtgcgctcca

SEQ ID NO: 35745 - DNA, 22 bp, Artificial Sequence
  Synthetic
tgtacgtcatctttcccggcac

SEQ ID NO: 35746 - DNA, 20 bp, Artificial Sequence
  Synthetic
gctcctgacggccagtcacg

SEQ ID NO: 35747 - DNA, 19 bp, Artificial Sequence
  Synthetic
agccactggacgagctggc

SEQ ID NO: 35748 - DNA, 21 bp, Artificial Sequence
  Synthetic
cccctgtcgtacacgctccta

SEQ ID NO: 35749 - DNA, 19 bp, Artificial Sequence
  Synthetic
agttcgcgcccgacctgga

SEQ ID NO: 35750 - DNA, 19 bp, Artificial Sequence
  Synthetic
tgcgtgtgttggcctgggc

SEQ ID NO: 35751 - DNA, 19 bp, Artificial Sequence
  Synthetic
gggtgacgctgttctcggc

SEQ ID NO: 35752 - DNA, 20 bp, Artificial Sequence
  Synthetic
gggttgtgttggccgactgg

SEQ ID NO: 35753 - DNA, 22 bp, Artificial Sequence
  Synthetic
cgggccagtttcagtgaaaccc

SEQ ID NO: 35754 - DNA, 20 bp, Artificial Sequence
  Synthetic
tgacgttgctggtgatggcc

SEQ ID NO: 35755 - DNA, 22 bp, Artificial Sequence
  Synthetic
ggtgtcgtagatgtagtggcgg

SEQ ID NO: 35756 - DNA, 19 bp, Artificial Sequence
  Synthetic
accgccttcccccatcacc

SEQ ID NO: 35757 - DNA, 22 bp, Artificial Sequence
  Synthetic
cctgctccccaaagatcgtgtt

SEQ ID NO: 35758 - DNA, 22 bp, Artificial Sequence
  Synthetic
ggtcgcgttaaggaccttggtg

SEQ ID NO: 35759 - DNA, 20 bp, Artificial Sequence
  Synthetic
ccatccggggtttgggtgtt

SEQ ID NO: 35760 - DNA, 19 bp, Artificial Sequence
  Synthetic
tacgcgtgcgtcctccgag

SEQ ID NO: 35761 - DNA, 20 bp, Artificial Sequence
  Synthetic
cgatgtcagcctgggggacg

SEQ ID NO: 35762 - DNA, 19 bp, Artificial Sequence
  Synthetic
gctgcccacttccccccat

SEQ ID NO: 35763 - DNA, 20 bp, Artificial Sequence
  Synthetic
tcgaggcccccacgatcgac

SEQ ID NO: 35764 - DNA, 19 bp, Artificial Sequence
  Synthetic
acgaatgtccgcgccgtgg

SEQ ID NO: 35765 - DNA, 22 bp, Artificial Sequence
  Synthetic
cgccgttatcaagacgacggtt

SEQ ID NO: 35766 - DNA, 22 bp, Artificial Sequence
  Synthetic
cgccagatacaggaaccaccct

SEQ ID NO: 35767 - DNA, 20 bp, Artificial Sequence
  Synthetic
ggggggtcctcgtccagatc

SEQ ID NO: 35768 - DNA, 20 bp, Artificial Sequence
  Synthetic
agtaagggggggccacgtgg

SEQ ID NO: 35769 - DNA, 20 bp, Artificial Sequence
  Synthetic
cccgacgaccagcgacgaac

SEQ ID NO: 35770 - DNA, 19 bp, Artificial Sequence
  Synthetic
caccgtactctgctgggcc

SEQ ID NO: 35771 - DNA, 19 bp, Artificial Sequence
  Synthetic
aaggacctagcgcgcggga

SEQ ID NO: 35772 - DNA, 20 bp, Artificial Sequence
  Synthetic
ggcagtttgacgacccaccc

SEQ ID NO: 35773 - DNA, 22 bp, Artificial Sequence
  Synthetic
gctggggtataaaaggggccat

SEQ ID NO: 35774 - DNA, 20 bp, Artificial Sequence
  Synthetic
ccaatctcatcccggctgcg

SEQ ID NO: 35775 - DNA, 22 bp, Artificial Sequence
  Synthetic
gggtaatctggatggctgctgt

SEQ ID NO: 35776 - DNA, 19 bp, Artificial Sequence
  Synthetic
gggggccgagaacaaggac

SEQ ID NO: 35777 - DNA, 20 bp, Artificial Sequence
  Synthetic
ccggtctgggtcatgttggg

SEQ ID NO: 35778 - DNA, 22 bp, Artificial Sequence
  Synthetic
ccccacgaggcttcccaaaagc

SEQ ID NO: 35779 - DNA, 21 bp, Artificial Sequence
  Synthetic
taccagactgaccgtggggcc

SEQ ID NO: 35780 - DNA, 20 bp, Artificial Sequence
  Synthetic
cgcgtaacacgtacaccccg

SEQ ID NO: 35781 - DNA, 22 bp, Artificial Sequence
  Synthetic
cggaccccgtgaataaccagac

SEQ ID NO: 35782 - DNA, 20 bp, Artificial Sequence
  Synthetic
gccgtgggataaagcggcac

SEQ ID NO: 35783 - DNA, 19 bp, Artificial Sequence
  Synthetic
atccgcccgacagaacggc

SEQ ID NO: 35784 - DNA, 25 bp, Artificial Sequence
  Synthetic
gtgataattaggggcattcaattcg

SEQ ID NO: 35785 - DNA, 22 bp, Artificial Sequence
  Synthetic
acaggtgcaatttccgtccgaa

SEQ ID NO: 35786 - DNA, 23 bp, Artificial Sequence
  Synthetic
agagagtaaccccatctctttgt

SEQ ID NO: 35787 - DNA, 20 bp, Artificial Sequence
  Synthetic
aagcgaagtgcacacggtcc

SEQ ID NO: 35788 - DNA, 21 bp, Artificial Sequence
  Synthetic
agtgcagtatggtgaggtgaa

SEQ ID NO: 35789 - DNA, 22 bp, Artificial Sequence
  Synthetic
ccatgttacagccaaaggtgat

SEQ ID NO: 35790 - DNA, 23 bp, Artificial Sequence
  Synthetic
gcctgtaagcacttcttcctctt

SEQ ID NO: 35791 - DNA, 21 bp, Artificial Sequence
  Synthetic
gggttcaaccgttgatttgct

SEQ ID NO: 35792 - DNA, 20 bp, Artificial Sequence
  Synthetic
tacattcccgcgttggtctc

SEQ ID NO: 35793 - DNA, 23 bp, Artificial Sequence
  Synthetic
agagttctgacaaacccactgta

SEQ ID NO: 35794 - DNA, 23 bp, Artificial Sequence
  Synthetic
gtgctttcatctgggtcttcaat

SEQ ID NO: 35795 - DNA, 20 bp, Artificial Sequence
  Synthetic
caacagttgtcgcaacagct

SEQ ID NO: 35796 - DNA, 25 bp, Artificial Sequence
  Synthetic
gattctgtactgtcatcaaacagct

SEQ ID NO: 35797 - DNA, 22 bp, Artificial Sequence
  Synthetic
ttttcagcttcatcctgctcaa

SEQ ID NO: 35798 - DNA, 22 bp, Artificial Sequence
  Synthetic
gcgtagttcttcccggagtgag

SEQ ID NO: 35799 - DNA, 21 bp, Artificial Sequence
  Synthetic
tgagccagcatcaattacagc

SEQ ID NO: 35800 - DNA, 22 bp, Artificial Sequence
  Synthetic
gcacgtcttgatcaaactgcaa

SEQ ID NO: 35801 - DNA, 21 bp, Artificial Sequence
  Synthetic
cgtattcgtccgtgctgagaa

SEQ ID NO: 35802 - DNA, 20 bp, Artificial Sequence
  Synthetic
ctacccctaacggtcctcca

SEQ ID NO: 35803 - DNA, 21 bp, Artificial Sequence
  Synthetic
tcattgttgtcttctgcagca

SEQ ID NO: 35804 - DNA, 20 bp, Artificial Sequence
  Synthetic
aacggttgctggctttaggt

SEQ ID NO: 35805 - DNA, 20 bp, Artificial Sequence
  Synthetic
tatgcactgccgataaccgc

SEQ ID NO: 35806 - DNA, 21 bp, Artificial Sequence
  Synthetic
cgtcttctgggtgtggtgtcg

SEQ ID NO: 35807 - DNA, 20 bp, Artificial Sequence
  Synthetic
tacctggacctgcatctggt

SEQ ID NO: 35808 - DNA, 24 bp, Artificial Sequence
  Synthetic
aagctttgtatggatctgtgtctt

SEQ ID NO: 35809 - DNA, 22 bp, Artificial Sequence
  Synthetic
ccttggttacagccccttctgg

SEQ ID NO: 35810 - DNA, 23 bp, Artificial Sequence
  Synthetic
aattcgtctgcttttttccctct

SEQ ID NO: 35811 - DNA, 22 bp, Artificial Sequence
  Synthetic
ctttctttgttgggctgctgca

SEQ ID NO: 35812 - DNA, 24 bp, Artificial Sequence
  Synthetic
atttctgccaaagatgttgattgg

SEQ ID NO: 35813 - DNA, 23 bp, Artificial Sequence
  Synthetic
gggtgtggaattcctagctgaat

SEQ ID NO: 35814 - DNA, 21 bp, Artificial Sequence
  Synthetic
gctgcaggaccactttgtcat

SEQ ID NO: 35815 - DNA, 21 bp, Artificial Sequence
  Synthetic
gctctgcttctgctagttctg

SEQ ID NO: 35816 - DNA, 22 bp, Artificial Sequence
  Synthetic
atgttaacctgaccagtggtgg

SEQ ID NO: 35817 - DNA, 22 bp, Artificial Sequence
  Synthetic
ctcctatgcctttatgggctgg

SEQ ID NO: 35818 - DNA, 22 bp, Artificial Sequence
  Synthetic
tgctgtctgccttcctgattcc

SEQ ID NO: 35819 - DNA, 20 bp, Artificial Sequence
  Synthetic
agtctttctgctggggtcat

SEQ ID NO: 35820 - DNA, 20 bp, Artificial Sequence
  Synthetic
ctgcatgagaggagagccat

SEQ ID NO: 35821 - DNA, 21 bp, Artificial Sequence
  Synthetic
gcaattagcaagcggggatca

SEQ ID NO: 35822 - DNA, 23 bp, Artificial Sequence
  Synthetic
ggcgaaggagtcttagttttcct

SEQ ID NO: 35823 - DNA, 22 bp, Artificial Sequence
  Synthetic
tgccagacatcttctactgctt

SEQ ID NO: 35824 - DNA, 20 bp, Artificial Sequence
  Synthetic
aatagttgcgccgtgtttgg

SEQ ID NO: 35825 - DNA, 20 bp, Artificial Sequence
  Synthetic
tctgggagatcagtcggcgg

SEQ ID NO: 35826 - DNA, 21 bp, Artificial Sequence
  Synthetic
tctgttgctgggtttctccat

SEQ ID NO: 35827 - DNA, 20 bp, Artificial Sequence
  Synthetic
ttttgcggagggtgtgttcc

SEQ ID NO: 35828 - DNA, 21 bp, Artificial Sequence
  Synthetic
ggataacccaagccattgtgt

SEQ ID NO: 35829 - DNA, 20 bp, Artificial Sequence
  Synthetic
tgccgctttgttttagccct

SEQ ID NO: 35830 - DNA, 20 bp, Artificial Sequence
  Synthetic
ttccattggccagcttcaag

SEQ ID NO: 35831 - DNA, 21 bp, Artificial Sequence
  Synthetic
agctcgagtatttcgtcgtga

SEQ ID NO: 35832 - DNA, 21 bp, Artificial Sequence
  Synthetic
tgtctaggcaagtctggttgc

SEQ ID NO: 35833 - DNA, 24 bp, Artificial Sequence
  Synthetic
cttcttgtatagcttaactgccct

SEQ ID NO: 35834 - DNA, 20 bp, Artificial Sequence
  Synthetic
acttgcggcaacaacaagag

SEQ ID NO: 35835 - DNA, 21 bp, Artificial Sequence
  Synthetic
ctgatagctggtaacgaggct

SEQ ID NO: 35836 - DNA, 20 bp, Artificial Sequence
  Synthetic
ggtcctcagcatccacttca

SEQ ID NO: 35837 - DNA, 20 bp, Artificial Sequence
  Synthetic
atgccacacatcatgctggt

SEQ ID NO: 35838 - DNA, 20 bp, Artificial Sequence
  Synthetic
aaatcctcagctgaagcgcg

SEQ ID NO: 35839 - DNA, 22 bp, Artificial Sequence
  Synthetic
tctaacaggtatggtgtcaggg

SEQ ID NO: 35840 - DNA, 20 bp, Artificial Sequence
  Synthetic
tagggggtggtattggctga

SEQ ID NO: 35841 - DNA, 25 bp, Artificial Sequence
  Synthetic
actctaaattgatgtgctgaaacct

SEQ ID NO: 35842 - DNA, 20 bp, Artificial Sequence
  Synthetic
gatgtgtgcaaggacgtcag

SEQ ID NO: 35843 - DNA, 22 bp, Artificial Sequence
  Synthetic
acgttttctacctaaaacgcca

SEQ ID NO: 35844 - DNA, 23 bp, Artificial Sequence
  Synthetic
gcatggcaaacattttccttcca

SEQ ID NO: 35845 - DNA, 22 bp, Artificial Sequence
  Synthetic
cgtccgatgacagtgactcttc

SEQ ID NO: 35846 - DNA, 20 bp, Artificial Sequence
  Synthetic
tgctgctgctggatctttga

SEQ ID NO: 35847 - DNA, 25 bp, Artificial Sequence
  Synthetic
tgttagtttagcaatccaatcaggt

SEQ ID NO: 35848 - DNA, 22 bp, Artificial Sequence
  Synthetic
tctaaacgttctctcaggtcgt

SEQ ID NO: 35849 - DNA, 20 bp, Artificial Sequence
  Synthetic
tactggcccccctgttgacc

SEQ ID NO: 35850 - DNA, 25 bp, Artificial Sequence
  Synthetic
acaagatctgtaaatgtcttgcaca

SEQ ID NO: 35851 - DNA, 23 bp, Artificial Sequence
  Synthetic
tgaggaccaataacgtctactgt

SEQ ID NO: 35852 - DNA, 25 bp, Artificial Sequence
  Synthetic
gagatggcacgattagataaaggag

SEQ ID NO: 35853 - DNA, 22 bp, Artificial Sequence
  Synthetic
gctattgagggcatttccacat

SEQ ID NO: 35854 - DNA, 25 bp, Artificial Sequence
  Synthetic
gttcccatacacctctttagtcatt

SEQ ID NO: 35855 - DNA, 25 bp, Artificial Sequence
  Synthetic
gggtccattgcattaatatgagcta

SEQ ID NO: 35856 - DNA, 22 bp, Artificial Sequence
  Synthetic
gccatatgatccacagtggttt

SEQ ID NO: 35857 - DNA, 22 bp, Artificial Sequence
  Synthetic
gttacagccagaggtgatacca

SEQ ID NO: 35858 - DNA, 22 bp, Artificial Sequence
  Synthetic
tgatgtcaatatcctggctcca

SEQ ID NO: 35859 - DNA, 22 bp, Artificial Sequence
  Synthetic
cttcaatgtttggaggttgcct

SEQ ID NO: 35860 - DNA, 22 bp, Artificial Sequence
  Synthetic
ggagtacatttcctcgctgatc

SEQ ID NO: 35861 - DNA, 20 bp, Artificial Sequence
  Synthetic
gtcctctgtaagcgcacctg

SEQ ID NO: 35862 - DNA, 21 bp, Artificial Sequence
  Synthetic
tgtccgaggcagattttgtct

SEQ ID NO: 35863 - DNA, 21 bp, Artificial Sequence
  Synthetic
gcttggtttgctctgcagttg

SEQ ID NO: 35864 - DNA, 21 bp, Artificial Sequence
  Synthetic
ccccttcacaattggcatcaa

SEQ ID NO: 35865 - DNA, 23 bp, Artificial Sequence
  Synthetic
gccttcccatccattttcaatga

SEQ ID NO: 35866 - DNA, 24 bp, Artificial Sequence
  Synthetic
tttgttcttccaacagtagtcctg

SEQ ID NO: 35867 - DNA, 22 bp, Artificial Sequence
  Synthetic
aggttggtcatcgtcttcatca

SEQ ID NO: 35868 - DNA, 25 bp, Artificial Sequence
  Synthetic
ttagcattaacaataccattcccca

SEQ ID NO: 35869 - DNA, 23 bp, Artificial Sequence
  Synthetic
cgcatgccacatttcataacttg

SEQ ID NO: 35870 - DNA, 22 bp, Artificial Sequence
  Synthetic
cgtctgggtcgcagttactcct

SEQ ID NO: 35871 - DNA, 25 bp, Artificial Sequence
  Synthetic
cacatcgccattttctaaagtacaa

SEQ ID NO: 35872 - DNA, 20 bp, Artificial Sequence
  Synthetic
attccaaaggtgggcagtcg

SEQ ID NO: 35873 - DNA, 24 bp, Artificial Sequence
  Synthetic
tgattaacctgggtttgtttagcc

SEQ ID NO: 35874 - DNA, 25 bp, Artificial Sequence
  Synthetic
aagtataaccttaccatctgacagc

SEQ ID NO: 35875 - DNA, 22 bp, Artificial Sequence
  Synthetic
ggtgttgaagggggattgggtc

SEQ ID NO: 35876 - DNA, 20 bp, Artificial Sequence
  Synthetic
tcgatggctttgcccaactt

SEQ ID NO: 35877 - DNA, 22 bp, Artificial Sequence
  Synthetic
gcagttgtaacttcaatggggt

SEQ ID NO: 35878 - DNA, 20 bp, Artificial Sequence
  Synthetic
gtcgaaggggctaagccttt

SEQ ID NO: 35879 - DNA, 23 bp, Artificial Sequence
  Synthetic
cctaatggtgtctgatcaagctc

SEQ ID NO: 35880 - DNA, 20 bp, Artificial Sequence
  Synthetic
gctgcaacaacgagaggatc

SEQ ID NO: 35881 - DNA, 23 bp, Artificial Sequence
  Synthetic
taataaggacaccaggaaccctg

SEQ ID NO: 35882 - DNA, 24 bp, Artificial Sequence
  Synthetic
acatgatggatacccaaatgtgtg

SEQ ID NO: 35883 - DNA, 20 bp, Artificial Sequence
  Synthetic
ctgccactcccattgcatag

SEQ ID NO: 35884 - DNA, 22 bp, Artificial Sequence
  Synthetic
catcgctttccatcaactctct

SEQ ID NO: 35885 - DNA, 20 bp, Artificial Sequence
  Synthetic
ctgagctgcttcttctccca

SEQ ID NO: 35886 - DNA, 20 bp, Artificial Sequence
  Synthetic
cccctttgtgtcggtgttga

SEQ ID NO: 35887 - DNA, 22 bp, Artificial Sequence
  Synthetic
ccttgtgtctccataagtgggt

SEQ ID NO: 35888 - DNA, 23 bp, Artificial Sequence
  Synthetic
gaattcgccaggtaaagaaggtt

SEQ ID NO: 35889 - DNA, 23 bp, Artificial Sequence
  Synthetic
tgtattgcttgatctgttggtca

SEQ ID NO: 35890 - DNA, 21 bp, Artificial Sequence
  Synthetic
ccgattccgttgcatgtacaa

SEQ ID NO: 35891 - DNA, 25 bp, Artificial Sequence
  Synthetic
gcctttgtaatatatccctggtcca

SEQ ID NO: 35892 - DNA, 21 bp, Artificial Sequence
  Synthetic
atgaattcgtgtgcatggtca

SEQ ID NO: 35893 - DNA, 23 bp, Artificial Sequence
  Synthetic
gctttcagagcttgaggaagaat

SEQ ID NO: 35894 - DNA, 21 bp, Artificial Sequence
  Synthetic
cttttgtcgcaatgctatggc

SEQ ID NO: 35895 - DNA, 20 bp, Artificial Sequence
  Synthetic
tgtgaggcttccatccaaga

SEQ ID NO: 35896 - DNA, 24 bp, Artificial Sequence
  Synthetic
cggccatagcaaaaatttcgttta

SEQ ID NO: 35897 - DNA, 25 bp, Artificial Sequence
  Synthetic
tgataatttcttcgttctcaccgaa

SEQ ID NO: 35898 - DNA, 21 bp, Artificial Sequence
  Synthetic
aaaggcctctaggatgttgga

SEQ ID NO: 35899 - DNA, 22 bp, Artificial Sequence
  Synthetic
gctgtgacaaacacgtcaaacg

SEQ ID NO: 35900 - DNA, 24 bp, Artificial Sequence
  Synthetic
ttaacttcttcagtggaaccaaca

SEQ ID NO: 35901 - DNA, 25 bp, Artificial Sequence
  Synthetic
attgtctgcaaaaatcatcccattt

SEQ ID NO: 35902 - DNA, 22 bp, Artificial Sequence
  Synthetic
caaaatgccaagccaacgttta

SEQ ID NO: 35903 - DNA, 24 bp, Artificial Sequence
  Synthetic
ccaattgccttttcacaaacatct

SEQ ID NO: 35904 - DNA, 20 bp, Artificial Sequence
  Synthetic
gctcccgattcttcaagcct

SEQ ID NO: 35905 - DNA, 25 bp, Artificial Sequence
  Synthetic
cttccttaggtgttgtatcaactgt

SEQ ID NO: 35906 - DNA, 20 bp, Artificial Sequence
  Synthetic
ccttttcggatggcacaaca

SEQ ID NO: 35907 - DNA, 24 bp, Artificial Sequence
  Synthetic
tgtgttaagatcacttggtactgc

SEQ ID NO: 35908 - DNA, 24 bp, Artificial Sequence
  Synthetic
acaataaccaacttgcacaccatc

SEQ ID NO: 35909 - DNA, 20 bp, Artificial Sequence
  Synthetic
aacaacacccgtcctttgtg

SEQ ID NO: 35910 - DNA, 20 bp, Artificial Sequence
  Synthetic
cacatcttgcagcccaatga

SEQ ID NO: 35911 - DNA, 22 bp, Artificial Sequence
  Synthetic
aacacgcaatacaatctgggtt

SEQ ID NO: 35912 - DNA, 21 bp, Artificial Sequence
  Synthetic
agacaggcctaaagctctctt

SEQ ID NO: 35913 - DNA, 25 bp, Artificial Sequence
  Synthetic
acaagaaagtcaaacccttagcttt

SEQ ID NO: 35914 - DNA, 24 bp, Artificial Sequence
  Synthetic
tccaactacaataggacagctttg

SEQ ID NO: 35915 - DNA, 20 bp, Artificial Sequence
  Synthetic
ttggtggcaatagtacgcac

SEQ ID NO: 35916 - DNA, 21 bp, Artificial Sequence
  Synthetic
cagtcggaggtgtgtacaaga

SEQ ID NO: 35917 - DNA, 21 bp, Artificial Sequence
  Synthetic
cagcccagaacatgacaaaga

SEQ ID NO: 35918 - DNA, 20 bp, Artificial Sequence
  Synthetic
gcaaagcgccaagtatgcaa

SEQ ID NO: 35919 - DNA, 25 bp, Artificial Sequence
  Synthetic
cacttacagaacctgttaatccagt

SEQ ID NO: 35920 - DNA, 23 bp, Artificial Sequence
  Synthetic
gattccctgtcaaactcagcttt

SEQ ID NO: 35921 - DNA, 21 bp, Artificial Sequence
  Synthetic
ccaaacaacaccagcgtagtg

SEQ ID NO: 35922 - DNA, 23 bp, Artificial Sequence
  Synthetic
ggcttcgtagtcacatatgcata

SEQ ID NO: 35923 - DNA, 20 bp, Artificial Sequence
  Synthetic
tgcgccttgtttaacagcat

SEQ ID NO: 35924 - DNA, 23 bp, Artificial Sequence
  Synthetic
tcaaaactttggatagcagtccg

SEQ ID NO: 35925 - DNA, 23 bp, Artificial Sequence
  Synthetic
aagcacaaatccatcatggtgta

SEQ ID NO: 35926 - DNA, 23 bp, Artificial Sequence
  Synthetic
ggaggacacaatacaaagtcacc

SEQ ID NO: 35927 - DNA, 20 bp, Artificial Sequence
  Synthetic
gaggtccaaaagccgtgttt

SEQ ID NO: 35928 - DNA, 21 bp, Artificial Sequence
  Synthetic
tggccaggttttactgtttgg

SEQ ID NO: 35929 - DNA, 20 bp, Artificial Sequence
  Synthetic
gtgcgcgttccttaccagat

SEQ ID NO: 35930 - DNA, 24 bp, Artificial Sequence
  Synthetic
agcacacaacactatcatcagaaa

SEQ ID NO: 35931 - DNA, 20 bp, Artificial Sequence
  Synthetic
ccagctgaacacagtgggaa

SEQ ID NO: 35932 - DNA, 23 bp, Artificial Sequence
  Synthetic
aactcaccaacttgaaacttgga

SEQ ID NO: 35933 - DNA, 25 bp, Artificial Sequence
  Synthetic
tgatatacgctggttaatcacagac

SEQ ID NO: 35934 - DNA, 24 bp, Artificial Sequence
  Synthetic
gagataaacacagccttgctccat

SEQ ID NO: 35935 - DNA, 25 bp, Artificial Sequence
  Synthetic
gacttggtggtaaatcaatagggtt

SEQ ID NO: 35936 - DNA, 21 bp, Artificial Sequence
  Synthetic
gtgcaccttccacatccattc

SEQ ID NO: 35937 - DNA, 20 bp, Artificial Sequence
  Synthetic
tggtcaactctaaaccgcca

SEQ ID NO: 35938 - DNA, 25 bp, Artificial Sequence
  Synthetic
catagggtaggtaattgaccaatcc

SEQ ID NO: 35939 - DNA, 23 bp, Artificial Sequence
  Synthetic
gtagatcgtgtacgtgtgtcaaa

SEQ ID NO: 35940 - DNA, 22 bp, Artificial Sequence
  Synthetic
caaacgtggtaggaacccaaat

SEQ ID NO: 35941 - DNA, 23 bp, Artificial Sequence
  Synthetic
gatcaacaggtttgccatctttg

SEQ ID NO: 35942 - DNA, 25 bp, Artificial Sequence
  Synthetic
acaaaatcatccaacaacaaatcca

SEQ ID NO: 35943 - DNA, 25 bp, Artificial Sequence
  Synthetic
catctataaaaggtccttgtgcgaa

SEQ ID NO: 35944 - DNA, 23 bp, Artificial Sequence
  Synthetic
agcccatttgtagtttgacaacc

SEQ ID NO: 35945 - DNA, 21 bp, Artificial Sequence
  Synthetic
ggtgtcattgctaacgcgaat

SEQ ID NO: 35946 - DNA, 24 bp, Artificial Sequence
  Synthetic
aaacgctttcttgtcaaaagtgag

SEQ ID NO: 35947 - DNA, 21 bp, Artificial Sequence
  Synthetic
cggctgatgttagacctccta

SEQ ID NO: 35948 - DNA, 21 bp, Artificial Sequence
  Synthetic
gtcgcaacacataaccgtttg

SEQ ID NO: 35949 - DNA, 22 bp, Artificial Sequence
  Synthetic
tgttcgacaactaggtctggaa

SEQ ID NO: 35950 - DNA, 23 bp, Artificial Sequence
  Synthetic
tgcttgagaccaatacagcaatg

SEQ ID NO: 35951 - DNA, 20 bp, Artificial Sequence
  Synthetic
gtacgagtggccaaagaagc

SEQ ID NO: 35952 - DNA, 24 bp, Artificial Sequence
  Synthetic
gatgtcatcctgactgttatggtt

SEQ ID NO: 35953 - DNA, 25 bp, Artificial Sequence
  Synthetic
acatcatcattaggctgtcttttcc

SEQ ID NO: 35954 - DNA, 20 bp, Artificial Sequence
  Synthetic
gtcaagccaaagcaagggat

SEQ ID NO: 35955 - DNA, 24 bp, Artificial Sequence
  Synthetic
ccatttttgcacagtccgatacat

SEQ ID NO: 35956 - DNA, 24 bp, Artificial Sequence
  Synthetic
gtacatcatctggacatgtacctg

SEQ ID NO: 35957 - DNA, 20 bp, Artificial Sequence
  Synthetic
caggggggccaatgggatca

SEQ ID NO: 35958 - DNA, 20 bp, Artificial Sequence
  Synthetic
taacttgctgcacccgcctg

SEQ ID NO: 35959 - DNA, 22 bp, Artificial Sequence
  Synthetic
acaattaaacaaggtcccgtcg

SEQ ID NO: 35960 - DNA, 21 bp, Artificial Sequence
  Synthetic
ggcataaacctgttcacgctt

SEQ ID NO: 35961 - DNA, 20 bp, Artificial Sequence
  Synthetic
gcccaggagtcgcaggaatt

SEQ ID NO: 35962 - DNA, 22 bp, Artificial Sequence
  Synthetic
cgagagccagggcaactcgtaa

SEQ ID NO: 35963 - DNA, 20 bp, Artificial Sequence
  Synthetic
cattgccagcctggttccct

SEQ ID NO: 35964 - DNA, 19 bp, Artificial Sequence
  Synthetic
tgctcgcccactcgaccga

SEQ ID NO: 35965 - DNA, 21 bp, Artificial Sequence
  Synthetic
cagcatgacagagctggtggt

SEQ ID NO: 35966 - DNA, 21 bp, Artificial Sequence
  Synthetic
ccaggaaaccctgtcacagaa

SEQ ID NO: 35967 - DNA, 21 bp, Artificial Sequence
  Synthetic
tatggggagccaggcccaagg

SEQ ID NO: 35968 - DNA, 20 bp, Artificial Sequence
  Synthetic
cggtctcccctaggcttgga

SEQ ID NO: 35969 - DNA, 22 bp, Artificial Sequence
  Synthetic
cctctggtaggactgggcgacc

SEQ ID NO: 35970 - DNA, 21 bp, Artificial Sequence
  Synthetic
cttaggagctgtccgagggga

SEQ ID NO: 35971 - DNA, 20 bp, Artificial Sequence
  Synthetic
gtggcctagcaacgcgaacc

SEQ ID NO: 35972 - DNA, 20 bp, Artificial Sequence
  Synthetic
tgagacgggtgggtgtgtgt

SEQ ID NO: 35973 - DNA, 20 bp, Artificial Sequence
  Synthetic
gaagctccccaaggccatgg

SEQ ID NO: 35974 - DNA, 19 bp, Artificial Sequence
  Synthetic
ggctggctcccagtatgcc

SEQ ID NO: 35975 - DNA, 20 bp, Artificial Sequence
  Synthetic
ggcaaggagaccgtcgcaga

SEQ ID NO: 35976 - DNA, 20 bp, Artificial Sequence
  Synthetic
acccggctggttcacggata

SEQ ID NO: 35977 - DNA, 20 bp, Artificial Sequence
  Synthetic
gtgtacggcggacatcaggg

SEQ ID NO: 35978 - DNA, 19 bp, Artificial Sequence
  Synthetic
tgggggttctggcctcgtc

SEQ ID NO: 35979 - DNA, 18 bp, Artificial Sequence
  Synthetic
cgcatcctccccgccaaa

SEQ ID NO: 35980 - DNA, 22 bp, Artificial Sequence
  Synthetic
ggacctccagacgctaaagagc

SEQ ID NO: 35981 - DNA, 21 bp, Artificial Sequence
  Synthetic
cctctcggaggacatctcgcg

SEQ ID NO: 35982 - DNA, 19 bp, Artificial Sequence
  Synthetic
aatctggcccgcccttcgc

SEQ ID NO: 35983 - DNA, 20 bp, Artificial Sequence
  Synthetic
gagccccgtaaagatgcccg

SEQ ID NO: 35984 - DNA, 20 bp, Artificial Sequence
  Synthetic
ggacttgatggagacccgcc

SEQ ID NO: 35985 - DNA, 20 bp, Artificial Sequence
  Synthetic
gcaggtggccacagacttcc

SEQ ID NO: 35986 - DNA, 19 bp, Artificial Sequence
  Synthetic
cacgtcctgagccttggcc

SEQ ID NO: 35987 - DNA, 20 bp, Artificial Sequence
  Synthetic
tacacgtgggaccccgaccc

SEQ ID NO: 35988 - DNA, 21 bp, Artificial Sequence
  Synthetic
cgtggaactgcagcttcacct

SEQ ID NO: 35989 - DNA, 19 bp, Artificial Sequence
  Synthetic
tgtgggactggaagcgccg

SEQ ID NO: 35990 - DNA, 22 bp, Artificial Sequence
  Synthetic
ggccatgccgtgttgttcatgt

SEQ ID NO: 35991 - DNA, 19 bp, Artificial Sequence
  Synthetic
aaggtgcgggcctccaacg

SEQ ID NO: 35992 - DNA, 21 bp, Artificial Sequence
  Synthetic
ccgactgcggtgacagcagtt

SEQ ID NO: 35993 - DNA, 20 bp, Artificial Sequence
  Synthetic
ataaccgagcctctctgctg

SEQ ID NO: 35994 - DNA, 22 bp, Artificial Sequence
  Synthetic
aatctgaaggatgccacgaggg

SEQ ID NO: 35995 - DNA, 20 bp, Artificial Sequence
  Synthetic
cggaggtgactgctgggatg

SEQ ID NO: 35996 - DNA, 22 bp, Artificial Sequence
  Synthetic
ggaccaccaatgtgatcgtggt

SEQ ID NO: 35997 - DNA, 19 bp, Artificial Sequence
  Synthetic
tctacggacgccgccctag

SEQ ID NO: 35998 - DNA, 20 bp, Artificial Sequence
  Synthetic
gcggcggccacagtagtagg

SEQ ID NO: 35999 - DNA, 19 bp, Artificial Sequence
  Synthetic
atgatctcccccggtcgcg

SEQ ID NO: 36000 - DNA, 22 bp, Artificial Sequence
  Synthetic
tctatgcctcctgctacgccaa

SEQ ID NO: 36001 - DNA, 19 bp, Artificial Sequence
  Synthetic
ggcttcgggtccgagatgg

SEQ ID NO: 36002 - DNA, 20 bp, Artificial Sequence
  Synthetic
aatttgcaaagggcgtgacc

SEQ ID NO: 36003 - DNA, 19 bp, Artificial Sequence
  Synthetic
accttgagcaccgcggctg

SEQ ID NO: 36004 - DNA, 20 bp, Artificial Sequence
  Synthetic
tttgcagccccaaaggtggt

SEQ ID NO: 36005 - DNA, 20 bp, Artificial Sequence
  Synthetic
tggctcagcgaggaggtgtc

SEQ ID NO: 36006 - DNA, 22 bp, Artificial Sequence
  Synthetic
agctcttgaccttcctgggtga

SEQ ID NO: 36007 - DNA, 19 bp, Artificial Sequence
  Synthetic
cccgtgaatgaagcgggcc

SEQ ID NO: 36008 - DNA, 22 bp, Artificial Sequence
  Synthetic
aggatggacttggtgggagaca

SEQ ID NO: 36009 - DNA, 19 bp, Artificial Sequence
  Synthetic
gggcggctctctttggagc

SEQ ID NO: 36010 - DNA, 21 bp, Artificial Sequence
  Synthetic
ggccctagagattggggaggt

SEQ ID NO: 36011 - DNA, 22 bp, Artificial Sequence
  Synthetic
tctgtgcttctctcggcctaca

SEQ ID NO: 36012 - DNA, 19 bp, Artificial Sequence
  Synthetic
ggggacacgcgcagtgagt

SEQ ID NO: 36013 - DNA, 19 bp, Artificial Sequence
  Synthetic
ccctaaccgcctggtggtg

SEQ ID NO: 36014 - DNA, 22 bp, Artificial Sequence
  Synthetic
cctcacctggccgtctaccaga

SEQ ID NO: 36015 - DNA, 19 bp, Artificial Sequence
  Synthetic
tcctgctgacgctgggcac

SEQ ID NO: 36016 - DNA, 19 bp, Artificial Sequence
  Synthetic
cccgcatgcgcaaccactt

SEQ ID NO: 36017 - DNA, 19 bp, Artificial Sequence
  Synthetic
tgcccaaccacggcaaccc

SEQ ID NO: 36018 - DNA, 19 bp, Artificial Sequence
  Synthetic
aggtggccacactggggac

SEQ ID NO: 36019 - DNA, 19 bp, Artificial Sequence
  Synthetic
gcctcacctgaacccccct

SEQ ID NO: 36020 - DNA, 20 bp, Artificial Sequence
  Synthetic
tcgttttagggctgcaacag

SEQ ID NO: 36021 - DNA, 21 bp, Artificial Sequence
  Synthetic
acgagttctaggaggattgca

SEQ ID NO: 36022 - DNA, 24 bp, Artificial Sequence
  Synthetic
gtgctaggtctaactgtagtaggt

SEQ ID NO: 36023 - DNA, 23 bp, Artificial Sequence
  Synthetic
ccgtattcagcactttagcaact

SEQ ID NO: 36024 - DNA, 25 bp, Artificial Sequence
  Synthetic
tcaccatcttgaatgtaagtgtgaa

SEQ ID NO: 36025 - DNA, 23 bp, Artificial Sequence
  Synthetic
cttctattccctgaggtggtgga

SEQ ID NO: 36026 - DNA, 24 bp, Artificial Sequence
  Synthetic
tggtgtttctacaatgtaggacca

SEQ ID NO: 36027 - DNA, 20 bp, Artificial Sequence
  Synthetic
tgggtatgagccctccttct

SEQ ID NO: 36028 - DNA, 21 bp, Artificial Sequence
  Synthetic
gacctctggattgaatggacg

SEQ ID NO: 36029 - DNA, 23 bp, Artificial Sequence
  Synthetic
accttttccctgttcaactttga

SEQ ID NO: 36030 - DNA, 20 bp, Artificial Sequence
  Synthetic
gtcgttttgaagccaggacg

SEQ ID NO: 36031 - DNA, 25 bp, Artificial Sequence
  Synthetic
actgctcaaacttatagcatgtagc

SEQ ID NO: 36032 - DNA, 20 bp, Artificial Sequence
  Synthetic
gttcctgttgcgctcgaatt

SEQ ID NO: 36033 - DNA, 22 bp, Artificial Sequence
  Synthetic
ggtacctcttccacctgtgttt

SEQ ID NO: 36034 - DNA, 24 bp, Artificial Sequence
  Synthetic
gcacaatgctgcaataacaattgt

SEQ ID NO: 36035 - DNA, 22 bp, Artificial Sequence
  Synthetic
gcttggaggtctctcccccgtc

SEQ ID NO: 36036 - DNA, 22 bp, Artificial Sequence
  Synthetic
acagcattaatggggggtcttt

SEQ ID NO: 36037 - DNA, 22 bp, Artificial Sequence
  Synthetic
ttagtagcaatgccagcgttag

SEQ ID NO: 36038 - DNA, 21 bp, Artificial Sequence
  Synthetic
acatagccagtggcaccacca

SEQ ID NO: 36039 - DNA, 20 bp, Artificial Sequence
  Synthetic
gcattgtccactggtactgg

SEQ ID NO: 36040 - DNA, 20 bp, Artificial Sequence
  Synthetic
tggaggctcctcaacagtac

SEQ ID NO: 36041 - DNA, 21 bp, Artificial Sequence
  Synthetic
atggtactgtcacctgagtgt

SEQ ID NO: 36042 - DNA, 25 bp, Artificial Sequence
  Synthetic
tgttctttccacatattcatcggtg

SEQ ID NO: 36043 - DNA, 23 bp, Artificial Sequence
  Synthetic
ggttgtcctctgcctatttcaat

SEQ ID NO: 36044 - DNA, 20 bp, Artificial Sequence
  Synthetic
ccatcaggaacagcgtcacc

SEQ ID NO: 36045 - DNA, 23 bp, Artificial Sequence
  Synthetic
tgaaacaagagtccaaggagttg

SEQ ID NO: 36046 - DNA, 23 bp, Artificial Sequence
  Synthetic
gaacttatcaactcgaccctcag

SEQ ID NO: 36047 - DNA, 23 bp, Artificial Sequence
  Synthetic
tctagagatccacaaggagtccc

SEQ ID NO: 36048 - DNA, 20 bp, Artificial Sequence
  Synthetic
atatcagcgctggacgagaa

SEQ ID NO: 36049 - DNA, 20 bp, Artificial Sequence
  Synthetic
ctgcagaagcgcaaaccttt

SEQ ID NO: 36050 - DNA, 22 bp, Artificial Sequence
  Synthetic
gagaatgtatcccctgtctgga

SEQ ID NO: 36051 - DNA, 20 bp, Artificial Sequence
  Synthetic
aaggtttttgcccatcacgg

SEQ ID NO: 36052 - DNA, 21 bp, Artificial Sequence
  Synthetic
agaaaaagctaagcggcacaa

SEQ ID NO: 36053 - DNA, 20 bp, Artificial Sequence
  Synthetic
tcaggcgattgttggaggac

SEQ ID NO: 36054 - DNA, 20 bp, Artificial Sequence
  Synthetic
gcgcatttaggaaccacgac

SEQ ID NO: 36055 - DNA, 22 bp, Artificial Sequence
  Synthetic
gctgtacaaaatgaacgcaacg

SEQ ID NO: 36056 - DNA, 21 bp, Artificial Sequence
  Synthetic
tgcacatgtcccattccttct

SEQ ID NO: 36057 - DNA, 20 bp, Artificial Sequence
  Synthetic
gcactcaaccgctctcgaat

SEQ ID NO: 36058 - DNA, 21 bp, Artificial Sequence
  Synthetic
actgttgtcgccttacctaca

SEQ ID NO: 36059 - DNA, 20 bp, Artificial Sequence
  Synthetic
ggatttgggaaacgttcgct

SEQ ID NO: 36060 - DNA, 22 bp, Artificial Sequence
  Synthetic
cctttggctttgataccgtcat

SEQ ID NO: 36061 - DNA, 22 bp, Artificial Sequence
  Synthetic
aagtgcagcaagaagaaaagga

SEQ ID NO: 36062 - DNA, 20 bp, Artificial Sequence
  Synthetic
cgctgacaggaatgccttgt

SEQ ID NO: 36063 - DNA, 22 bp, Artificial Sequence
  Synthetic
gcatcgttgtgtaggatagcgt

SEQ ID NO: 36064 - DNA, 20 bp, Artificial Sequence
  Synthetic
gtctctgattcccctcgtgc

SEQ ID NO: 36065 - DNA, 21 bp, Artificial Sequence
  Synthetic
actgtcgataccgttgttgct

SEQ ID NO: 36066 - DNA, 21 bp, Artificial Sequence
  Synthetic
gtgtttacggacgtacggttt

SEQ ID NO: 36067 - DNA, 25 bp, Artificial Sequence
  Synthetic
agttagaaattgggattgcttcaga

SEQ ID NO: 36068 - DNA, 20 bp, Artificial Sequence
  Synthetic
agcggactttgttggtagcg

SEQ ID NO: 36069 - DNA, 21 bp, Artificial Sequence
  Synthetic
ctgcctgagggaattgagatg

SEQ ID NO: 36070 - DNA, 23 bp, Artificial Sequence
  Synthetic
agaacgatgtggaaagaggaatg

SEQ ID NO: 36071 - DNA, 21 bp, Artificial Sequence
  Synthetic
gttccatttcttcgggcagag

SEQ ID NO: 36072 - DNA, 24 bp, Artificial Sequence
  Synthetic
tcgttgttatagatcctaggcctc

SEQ ID NO: 36073 - DNA, 20 bp, Artificial Sequence
  Synthetic
gtgtttcttcggaagagcgt

SEQ ID NO: 36074 - DNA, 23 bp, Artificial Sequence
  Synthetic
gttagcctctgtttaggagcttt

SEQ ID NO: 36075 - DNA, 20 bp, Artificial Sequence
  Synthetic
ctgcttggtagtgtcgaacg

SEQ ID NO: 36076 - DNA, 21 bp, Artificial Sequence
  Synthetic
gcagagcagtcagtaaaaccg

SEQ ID NO: 36077 - DNA, 21 bp, Artificial Sequence
  Synthetic
caggtgggatggagtttctgt

SEQ ID NO: 36078 - DNA, 23 bp, Artificial Sequence
  Synthetic
ctctttgggaggagaaagtcatc

SEQ ID NO: 36079 - DNA, 22 bp, Artificial Sequence
  Synthetic
ccctaaggaagagaagcgtaca

SEQ ID NO: 36080 - DNA, 22 bp, Artificial Sequence
  Synthetic
gggatgacttttccagggaagt

SEQ ID NO: 36081 - DNA, 20 bp, Artificial Sequence
  Synthetic
agtctccagcgctatctcca

SEQ ID NO: 36082 - DNA, 21 bp, Artificial Sequence
  Synthetic
aagtttaacgcgcagtcatca

SEQ ID NO: 36083 - DNA, 20 bp, Artificial Sequence
  Synthetic
tgttttgggctgtagcgttc

SEQ ID NO: 36084 - DNA, 23 bp, Artificial Sequence
  Synthetic
gtgtcgctattctacagggaatc

SEQ ID NO: 36085 - DNA, 24 bp, Artificial Sequence
  Synthetic
cgcaagtgattgaaattcacactc

SEQ ID NO: 36086 - DNA, 23 bp, Artificial Sequence
  Synthetic
ttcgtattatggtgcgtgattgt

SEQ ID NO: 36087 - DNA, 21 bp, Artificial Sequence
  Synthetic
gttacgaagcagcagcgttat

SEQ ID NO: 36088 - DNA, 21 bp, Artificial Sequence
  Synthetic
taaagctgtggcgaggactct

SEQ ID NO: 36089 - DNA, 22 bp, Artificial Sequence
  Synthetic
tcttcatacgctcagagcagat

SEQ ID NO: 36090 - DNA, 23 bp, Artificial Sequence
  Synthetic
gtctcgtcgttctatgattaccc

SEQ ID NO: 36091 - DNA, 22 bp, Artificial Sequence
  Synthetic
ggagggattgttttcggtccta

SEQ ID NO: 36092 - DNA, 20 bp, Artificial Sequence
  Synthetic
tgtgtcctagaagctcgggt

SEQ ID NO: 36093 - DNA, 21 bp, Artificial Sequence
  Synthetic
gtagcagcaatcccatccaag

SEQ ID NO: 36094 - DNA, 20 bp, Artificial Sequence
  Synthetic
atgctttggtatgcggggtt

SEQ ID NO: 36095 - DNA, 20 bp, Artificial Sequence
  Synthetic
aaggagggatggggttttcg

SEQ ID NO: 36096 - DNA, 20 bp, Artificial Sequence
  Synthetic
gggaaaacctgacgcgagat

SEQ ID NO: 36097 - DNA, 20 bp, Artificial Sequence
  Synthetic
ttgcgagcgtaactcttgga

SEQ ID NO: 36098 - DNA, 22 bp, Artificial Sequence
  Synthetic
tctggatcgtcccaatcctatg

SEQ ID NO: 36099 - DNA, 21 bp, Artificial Sequence
  Synthetic
gcgttacgaccatatggagga

SEQ ID NO: 36100 - DNA, 22 bp, Artificial Sequence
  Synthetic
agtcaaagatgctgcaaagcaa

SEQ ID NO: 36101 - DNA, 20 bp, Artificial Sequence
  Synthetic
acagtgttgctacctgcgat

SEQ ID NO: 36102 - DNA, 24 bp, Artificial Sequence
  Synthetic
ccggtcatcgaaaacaaagagttt

SEQ ID NO: 36103 - DNA, 22 bp, Artificial Sequence
  Synthetic
gaaattctccaacagacgggaa

SEQ ID NO: 36104 - DNA, 23 bp, Artificial Sequence
  Synthetic
tccttcacttaggtgcataagca

SEQ ID NO: 36105 - DNA, 25 bp, Artificial Sequence
  Synthetic
aacaaagcaaaagagaaaactcctt

SEQ ID NO: 36106 - DNA, 20 bp, Artificial Sequence
  Synthetic
cccatggcctactgcaaaga

SEQ ID NO: 36107 - DNA, 20 bp, Artificial Sequence
  Synthetic
atatcggcccgcattgatgt

SEQ ID NO: 36108 - DNA, 24 bp, Artificial Sequence
  Synthetic
cgtttctgatatgcgttctatcga

SEQ ID NO: 36109 - DNA, 20 bp, Artificial Sequence
  Synthetic
actaggttcttcgggtgcat

SEQ ID NO: 36110 - DNA, 21 bp, Artificial Sequence
  Synthetic
agagcttcctcttccaacagg

SEQ ID NO: 36111 - DNA, 23 bp, Artificial Sequence
  Synthetic
tcaggataattgtggattgcctc

SEQ ID NO: 36112 - DNA, 22 bp, Artificial Sequence
  Synthetic
tgatacaaaaagcggtctcagg

SEQ ID NO: 36113 - DNA, 22 bp, Artificial Sequence
  Synthetic
tccgtctacagcaaataaagcc

SEQ ID NO: 36114 - DNA, 23 bp, Artificial Sequence
  Synthetic
aatcgatcttcgtaattcccacc

SEQ ID NO: 36115 - DNA, 20 bp, Artificial Sequence
  Synthetic
ctcttaggacgccccatcga

SEQ ID NO: 36116 - DNA, 20 bp, Artificial Sequence
  Synthetic
atactggcaaagcgttctcg

SEQ ID NO: 36117 - DNA, 21 bp, Artificial Sequence
  Synthetic
gcctcttaacgttgcctgaat

SEQ ID NO: 36118 - DNA, 20 bp, Artificial Sequence
  Synthetic
agcagtcgtcctctcatcct

SEQ ID NO: 36119 - DNA, 20 bp, Artificial Sequence
  Synthetic
aaatcattatgcgggcagcc

SEQ ID NO: 36120 - DNA, 23 bp, Artificial Sequence
  Synthetic
caaaaacagagactgactcacct

SEQ ID NO: 36121 - DNA, 22 bp, Artificial Sequence
  Synthetic
gcggaaaagcttatgttctccc

SEQ ID NO: 36122 - DNA, 21 bp, Artificial Sequence
  Synthetic
tggaactgcttccctcctaga

SEQ ID NO: 36123 - DNA, 22 bp, Artificial Sequence
  Synthetic
gcgatgatgaaagcactcgaaa

SEQ ID NO: 36124 - DNA, 24 bp, Artificial Sequence
  Synthetic
caaaaagacacatcaatcaccctc

SEQ ID NO: 36125 - DNA, 22 bp, Artificial Sequence
  Synthetic
ccgaatcgcaaaatacctgagg

SEQ ID NO: 36126 - DNA, 20 bp, Artificial Sequence
  Synthetic
gtatacgcggcacacccaat

SEQ ID NO: 36127 - DNA, 23 bp, Artificial Sequence
  Synthetic
tccattttttcctcttcctccag

SEQ ID NO: 36128 - DNA, 20 bp, Artificial Sequence
  Synthetic
gcagtctgctagctgaggat

SEQ ID NO: 36129 - DNA, 24 bp, Artificial Sequence
  Synthetic
gaattccttggagcaatacctgat

SEQ ID NO: 36130 - DNA, 20 bp, Artificial Sequence
  Synthetic
cttttgctaacaagcgcgca

SEQ ID NO: 36131 - DNA, 22 bp, Artificial Sequence
  Synthetic
agcattaacgaaaaaggccagt

SEQ ID NO: 36132 - DNA, 22 bp, Artificial Sequence
  Synthetic
caaaaatcgcaacggtcattgg

SEQ ID NO: 36133 - DNA, 21 bp, Artificial Sequence
  Synthetic
tgattgtccgcgttttcctag

SEQ ID NO: 36134 - DNA, 22 bp, Artificial Sequence
  Synthetic
accatgaggagagtgaatccaa

SEQ ID NO: 36135 - DNA, 22 bp, Artificial Sequence
  Synthetic
agccaaatctcctacaccttca

SEQ ID NO: 36136 - DNA, 20 bp, Artificial Sequence
  Synthetic
acccgtagctagcacggata

SEQ ID NO: 36137 - DNA, 21 bp, Artificial Sequence
  Synthetic
cccgactttgtctcgaaacct

SEQ ID NO: 36138 - DNA, 20 bp, Artificial Sequence
  Synthetic
tctcagttgcattctggcgt

SEQ ID NO: 36139 - DNA, 22 bp, Artificial Sequence
  Synthetic
ttccctcatccactttccatct

SEQ ID NO: 36140 - DNA, 22 bp, Artificial Sequence
  Synthetic
tcccacgtttgatcatcctgat

SEQ ID NO: 36141 - DNA, 25 bp, Artificial Sequence
  Synthetic
ccagaaattccaattgttagccaat

SEQ ID NO: 36142 - DNA, 25 bp, Artificial Sequence
  Synthetic
tgataattaggggcattcatttcga

SEQ ID NO: 36143 - DNA, 21 bp, Artificial Sequence
  Synthetic
tccaaacaccattgccgtatt

SEQ ID NO: 36144 - DNA, 24 bp, Artificial Sequence
  Synthetic
gtggtccaaacatactcaacatca

SEQ ID NO: 36145 - DNA, 22 bp, Artificial Sequence
  Synthetic
ctgcagtcgcttgtaaaggaat

SEQ ID NO: 36146 - DNA, 21 bp, Artificial Sequence
  Synthetic
tggtgggaattagaaggccat

SEQ ID NO: 36147 - DNA, 23 bp, Artificial Sequence
  Synthetic
aagttagatctctgatggcttgc

SEQ ID NO: 36148 - DNA, 22 bp, Artificial Sequence
  Synthetic
cctgttcactcgatccagccat

SEQ ID NO: 36149 - DNA, 23 bp, Artificial Sequence
  Synthetic
gctgtttgtattataacgcaggc

SEQ ID NO: 36150 - DNA, 25 bp, Artificial Sequence
  Synthetic
agtactacagccttctttaggatct

SEQ ID NO: 36151 - DNA, 22 bp, Artificial Sequence
  Synthetic
gaatctggggtggatcagctat

SEQ ID NO: 36152 - DNA, 20 bp, Artificial Sequence
  Synthetic
catcctcaccctcgtcttct

SEQ ID NO: 36153 - DNA, 19 bp, Artificial Sequence
  Synthetic
tgctcctgcccctgctcct

SEQ ID NO: 36154 - DNA, 25 bp, Artificial Sequence
  Synthetic
agcctttatacttttctttagccct

SEQ ID NO: 36155 - DNA, 23 bp, Artificial Sequence
  Synthetic
actgtgggtgtatttccaactct

SEQ ID NO: 36156 - DNA, 21 bp, Artificial Sequence
  Synthetic
ctgcaggtgtttcagcatagg

SEQ ID NO: 36157 - DNA, 22 bp, Artificial Sequence
  Synthetic
tgtggatcaactgagcttctca

SEQ ID NO: 36158 - DNA, 25 bp, Artificial Sequence
  Synthetic
ttgctttggatcaaaagatgtgttt

SEQ ID NO: 36159 - DNA, 25 bp, Artificial Sequence
  Synthetic
gataccaaagacccactaacagtag

SEQ ID NO: 36160 - DNA, 20 bp, Artificial Sequence
  Synthetic
gacccaacccacgaattgac

SEQ ID NO: 36161 - DNA, 25 bp, Artificial Sequence
  Synthetic
atgccacaattacatcaaaaaggag

SEQ ID NO: 36162 - DNA, 25 bp, Artificial Sequence
  Synthetic
gctttgcaaatgagatttgtttcct

SEQ ID NO: 36163 - DNA, 25 bp, Artificial Sequence
  Synthetic
aaagagtccagtacaactttagcaa

SEQ ID NO: 36164 - DNA, 23 bp, Artificial Sequence
  Synthetic
caacattaaaagaaagacgcgct

SEQ ID NO: 36165 - DNA, 24 bp, Artificial Sequence
  Synthetic
accatcaacagttagcaagatgtc

SEQ ID NO: 36166 - DNA, 20 bp, Artificial Sequence
  Synthetic
ccagaccagtacgctgttcc

SEQ ID NO: 36167 - DNA, 24 bp, Artificial Sequence
  Synthetic
ttgggctttaataatacgctgagt

SEQ ID NO: 36168 - DNA, 21 bp, Artificial Sequence
  Synthetic
agcataaaaagctcaggcagc

SEQ ID NO: 36169 - DNA, 25 bp, Artificial Sequence
  Synthetic
aagaatcacaatcaatgcaattcca

SEQ ID NO: 36170 - DNA, 24 bp, Artificial Sequence
  Synthetic
acaggaaacaccagctattttagc

SEQ ID NO: 36171 - DNA, 21 bp, Artificial Sequence
  Synthetic
cttctcgcaacacttctggaa

SEQ ID NO: 36172 - DNA, 23 bp, Artificial Sequence
  Synthetic
cagcaatggaactagcagtcaat

SEQ ID NO: 36173 - DNA, 21 bp, Artificial Sequence
  Synthetic
gctttagccaactgagagcaa

SEQ ID NO: 36174 - DNA, 21 bp, Artificial Sequence
  Synthetic
catgaaaggctccttgtggtt

SEQ ID NO: 36175 - DNA, 25 bp, Artificial Sequence
  Synthetic
aagatgcttatgcttaaccaacaac

SEQ ID NO: 36176 - DNA, 23 bp, Artificial Sequence
  Synthetic
tctgtaaagcctgcaaaacagta

SEQ ID NO: 36177 - DNA, 25 bp, Artificial Sequence
  Synthetic
tcaactacctggtcataaacacttt

SEQ ID NO: 36178 - DNA, 20 bp, Artificial Sequence
  Synthetic
accaacaacccagcctcttg

SEQ ID NO: 36179 - DNA, 20 bp, Artificial Sequence
  Synthetic
tctgggtgttcaactcgtgc

SEQ ID NO: 36180 - DNA, 20 bp, Artificial Sequence
  Synthetic
accaatgccagcaacactag

SEQ ID NO: 36181 - DNA, 21 bp, Artificial Sequence
  Synthetic
ccaccaatttgtccgcaaact

SEQ ID NO: 36182 - DNA, 24 bp, Artificial Sequence
  Synthetic
aaagacaagcgataacgatgtgta

SEQ ID NO: 36183 - DNA, 22 bp, Artificial Sequence
  Synthetic
gacttgtgatgccggtatacac

SEQ ID NO: 36184 - DNA, 21 bp, Artificial Sequence
  Synthetic
actacaggaacaccacgtgta

SEQ ID NO: 36185 - DNA, 25 bp, Artificial Sequence
  Synthetic
ttcaatcttattgccattgcatgac

SEQ ID NO: 36186 - DNA, 25 bp, Artificial Sequence
  Synthetic
ctactataattctcctgcggaacaa

SEQ ID NO: 36187 - DNA, 23 bp, Artificial Sequence
  Synthetic
acttatcatagcactccaccctg

SEQ ID NO: 36188 - DNA, 25 bp, Artificial Sequence
  Synthetic
ggctaataaaaacagctttatgcca

SEQ ID NO: 36189 - DNA, 25 bp, Artificial Sequence
  Synthetic
ctacattgaactttagtttcgacgg

SEQ ID NO: 36190 - DNA, 21 bp, Artificial Sequence
  Synthetic
cggagacaagtgagctcaaag

SEQ ID NO: 36191 - DNA, 20 bp, Artificial Sequence
  Synthetic
cacaggcaatcgcttttggg

SEQ ID NO: 36192 - DNA, 20 bp, Artificial Sequence
  Synthetic
aaggcatttcaccagcctgt

SEQ ID NO: 36193 - DNA, 23 bp, Artificial Sequence
  Synthetic
cttcaagagcaccattatcacga

SEQ ID NO: 36194 - DNA, 25 bp, Artificial Sequence
  Synthetic
ccataaacaatgtgttcaaaggcat

SEQ ID NO: 36195 - DNA, 20 bp, Artificial Sequence
  Synthetic
gccacccagagctaacttgt

SEQ ID NO: 36196 - DNA, 20 bp, Artificial Sequence
  Synthetic
tgttgaccttcgcctgtgta

SEQ ID NO: 36197 - DNA, 25 bp, Artificial Sequence
  Synthetic
cgacttatcattaagccaagcttct

SEQ ID NO: 36198 - DNA, 20 bp, Artificial Sequence
  Synthetic
acacgaccgctatagcaact

SEQ ID NO: 36199 - DNA, 25 bp, Artificial Sequence
  Synthetic
agcttgtttgaataaactccaccat

SEQ ID NO: 36200 - DNA, 21 bp, Artificial Sequence
  Synthetic
tctgagcttccgcttcaagag

SEQ ID NO: 36201 - DNA, 20 bp, Artificial Sequence
  Synthetic
gcaatgcacagaccaggact

SEQ ID NO: 36202 - DNA, 25 bp, Artificial Sequence
  Synthetic
gacttttattgcctcctgtaaccta

SEQ ID NO: 36203 - DNA, 24 bp, Artificial Sequence
  Synthetic
agttgtttgtttctgggttgaaac

SEQ ID NO: 36204 - DNA, 20 bp, Artificial Sequence
  Synthetic
ttctcaacaatgcggtgtcc

SEQ ID NO: 36205 - DNA, 21 bp, Artificial Sequence
  Synthetic
aggtaggggttctattgccag

SEQ ID NO: 36206 - DNA, 22 bp, Artificial Sequence
  Synthetic
ttcataaacatccttctggggc

SEQ ID NO: 36207 - DNA, 23 bp, Artificial Sequence
  Synthetic
gaccccaattgcatttttgacat

SEQ ID NO: 36208 - DNA, 23 bp, Artificial Sequence
  Synthetic
cccaattgcatttttgacatcct

SEQ ID NO: 36209 - DNA, 20 bp, Artificial Sequence
  Synthetic
ccatggctaggcgctttccg

SEQ ID NO: 36210 - DNA, 21 bp, Artificial Sequence
  Synthetic
cgggaacttgacgtcctgtgg

SEQ ID NO: 36211 - DNA, 22 bp, Artificial Sequence
  Synthetic
ccgtcctggacacaaggtacac

SEQ ID NO: 36212 - DNA, 20 bp, Artificial Sequence
  Synthetic
gccccatccctgcctgaaga

SEQ ID NO: 36213 - DNA, 20 bp, Artificial Sequence
  Synthetic
ccccctggtccagttgcaag

SEQ ID NO: 36214 - DNA, 20 bp, Artificial Sequence
  Synthetic
agcggcccagtgttgcattg

SEQ ID NO: 36215 - DNA, 22 bp, Artificial Sequence
  Synthetic
cagaggaacccttgagacaggc

SEQ ID NO: 36216 - DNA, 21 bp, Artificial Sequence
  Synthetic
cccataggcacgcgacatgaa

SEQ ID NO: 36217 - DNA, 20 bp, Artificial Sequence
  Synthetic
ccgcatcttggggagcagtg

SEQ ID NO: 36218 - DNA, 22 bp, Artificial Sequence
  Synthetic
gccctccagctcaatatgaccc

SEQ ID NO: 36219 - DNA, 22 bp, Artificial Sequence
  Synthetic
gaacgccataagagacgccaca

SEQ ID NO: 36220 - DNA, 19 bp, Artificial Sequence
  Synthetic
caccgacgacgagagcacc

SEQ ID NO: 36221 - DNA, 20 bp, Artificial Sequence
  Synthetic
ttctgtggcccccgtgatgt

SEQ ID NO: 36222 - DNA, 20 bp, Artificial Sequence
  Synthetic
gtggccttcaacgacggagc

SEQ ID NO: 36223 - DNA, 21 bp, Artificial Sequence
  Synthetic
cccgtggtggtaaggcacatc

SEQ ID NO: 36224 - DNA, 20 bp, Artificial Sequence
  Synthetic
gagcagcagaccacgctctg

SEQ ID NO: 36225 - DNA, 22 bp, Artificial Sequence
  Synthetic
cgcagacaagaaagtccgggtt

SEQ ID NO: 36226 - DNA, 20 bp, Artificial Sequence
  Synthetic
atgtcacagccagaggtgat

SEQ ID NO: 36227 - DNA, 22 bp, Artificial Sequence
  Synthetic
gatgttagtatcctggctccca

SEQ ID NO: 36228 - DNA, 25 bp, Artificial Sequence
  Synthetic
tctcactatgttcctagcagcaata

SEQ ID NO: 36229 - DNA, 23 bp, Artificial Sequence
  Synthetic
gtaagcacctcttcctctctctt

SEQ ID NO: 36230 - DNA, 23 bp, Artificial Sequence
  Synthetic
cataggattcagtcgctgattcg

SEQ ID NO: 36231 - DNA, 20 bp, Artificial Sequence
  Synthetic
atttcctcgttggtcccgga

SEQ ID NO: 36232 - DNA, 22 bp, Artificial Sequence
  Synthetic
cactccagctgtgccttcatct

SEQ ID NO: 36233 - DNA, 22 bp, Artificial Sequence
  Synthetic
tgtgctgatagaagagccctgc

SEQ ID NO: 36234 - DNA, 20 bp, Artificial Sequence
  Synthetic
accgaaccaattgcccagcg

SEQ ID NO: 36235 - DNA, 20 bp, Artificial Sequence
  Synthetic
ccagatcacagcgttcgccc

SEQ ID NO: 36236 - DNA, 19 bp, Artificial Sequence
  Synthetic
acaagaccgtgcgtcccgg

SEQ ID NO: 36237 - DNA, 21 bp, Artificial Sequence
  Synthetic
aagacgactggttccacagcc

SEQ ID NO: 36238 - DNA, 22 bp, Artificial Sequence
  Synthetic
cccgtggtagacagtccagcat

SEQ ID NO: 36239 - DNA, 20 bp, Artificial Sequence
  Synthetic
aagtccaccgccttagccac

SEQ ID NO: 36240 - DNA, 20 bp, Artificial Sequence
  Synthetic
ctgaacagcgcccagtctgt

SEQ ID NO: 36241 - DNA, 21 bp, Artificial Sequence
  Synthetic
agggccttctgcttgaactgc

SEQ ID NO: 36242 - DNA, 19 bp, Artificial Sequence
  Synthetic
tccaacgctgccgatggcg

SEQ ID NO: 36243 - DNA, 18 bp, Artificial Sequence
  Synthetic
tgcatcgctctccggcac

SEQ ID NO: 36244 - DNA, 20 bp, Artificial Sequence
  Synthetic
acctcccgctcatcctcctc

SEQ ID NO: 36245 - DNA, 22 bp, Artificial Sequence
  Synthetic
cgggctcagaggatgttgtcgt

SEQ ID NO: 36246 - DNA, 20 bp, Artificial Sequence
  Synthetic
gacgccgctgctttgacctc

SEQ ID NO: 36247 - DNA, 21 bp, Artificial Sequence
  Synthetic
cacgatgagacgagctggctt

SEQ ID NO: 36248 - DNA, 21 bp, Artificial Sequence
  Synthetic
ccgcagttttccccccttgaa

SEQ ID NO: 36249 - DNA, 22 bp, Artificial Sequence
  Synthetic
ggggttgtagggtcacgggtaa

SEQ ID NO: 36250 - DNA, 22 bp, Artificial Sequence
  Synthetic
ggaccccaagttttctgaggca

SEQ ID NO: 36251 - DNA, 23 bp, Artificial Sequence
  Synthetic
gtctgctggtccataaaacacta

SEQ ID NO: 36252 - DNA, 19 bp, Artificial Sequence
  Synthetic
tggtgctgtccgtcgaccg

SEQ ID NO: 36253 - DNA, 22 bp, Artificial Sequence
  Synthetic
cacaaaaaaagcccagcaatgt

SEQ ID NO: 36254 - DNA, 20 bp, Artificial Sequence
  Synthetic
aacatctggggggcatgtgc

SEQ ID NO: 36255 - DNA, 20 bp, Artificial Sequence
  Synthetic
ggggctatagggctaaggtc

SEQ ID NO: 36256 - DNA, 20 bp, Artificial Sequence
  Synthetic
aaagtccatggccccatagc

SEQ ID NO: 36257 - DNA, 25 bp, Artificial Sequence
  Synthetic
acaactcgtttcaactctaaatggt

SEQ ID NO: 36258 - DNA, 25 bp, Artificial Sequence
  Synthetic
gcaggattttcatcaaagtaaacct

SEQ ID NO: 36259 - DNA, 20 bp, Artificial Sequence
  Synthetic
tttcggctggctcgtcaaca

SEQ ID NO: 36260 - DNA, 21 bp, Artificial Sequence
  Synthetic
acagactccaaccgggctgaa

SEQ ID NO: 36261 - DNA, 20 bp, Artificial Sequence
  Synthetic
agtgcctttacccgttccaa

SEQ ID NO: 36262 - DNA, 24 bp, Artificial Sequence
  Synthetic
ttgtttcacctacttcttcttgca

SEQ ID NO: 36263 - DNA, 20 bp, Artificial Sequence
  Synthetic
attcaaattgaaccgcgcga

SEQ ID NO: 36264 - DNA, 20 bp, Artificial Sequence
  Synthetic
gggagttggttttgcaggtg

SEQ ID NO: 36265 - DNA, 20 bp, Artificial Sequence
  Synthetic
gaccgcctcttccaatttgc

SEQ ID NO: 36266 - DNA, 22 bp, Artificial Sequence
  Synthetic
ggacaagagcctttatcaggac

SEQ ID NO: 36267 - DNA, 22 bp, Artificial Sequence
  Synthetic
cgccatcaacacctcctctaac

SEQ ID NO: 36268 - DNA, 21 bp, Artificial Sequence
  Synthetic
acaccgttttggcttcattgt

SEQ ID NO: 36269 - DNA, 21 bp, Artificial Sequence
  Synthetic
tgggcccatatgtattccacc

SEQ ID NO: 36270 - DNA, 23 bp, Artificial Sequence
  Synthetic
ttcgccacatcttacatggaatt

SEQ ID NO: 36271 - DNA, 24 bp, Artificial Sequence
  Synthetic
gaaagtatcgttggagttggtaca

SEQ ID NO: 36272 - DNA, 22 bp, Artificial Sequence
  Synthetic
tctcatttgtttgagcactgct

SEQ ID NO: 36273 - DNA, 21 bp, Artificial Sequence
  Synthetic
gccactaacaagaaagcctgc

SEQ ID NO: 36274 - DNA, 21 bp, Artificial Sequence
  Synthetic
ccaacactttccatcgcttga

SEQ ID NO: 36275 - DNA, 24 bp, Artificial Sequence
  Synthetic
tttacgtacacatcccacaaaagt

SEQ ID NO: 36276 - DNA, 25 bp, Artificial Sequence
  Synthetic
acaataaggatgtggtgtaccatca

SEQ ID NO: 36277 - DNA, 25 bp, Artificial Sequence
  Synthetic
ccttaactggcaactgtacaacttg

SEQ ID NO: 36278 - DNA, 24 bp, Artificial Sequence
  Synthetic
agcctcaggtttaatagtaatggc

SEQ ID NO: 36279 - DNA, 25 bp, Artificial Sequence
  Synthetic
aacaccaactaaacctacttcaact

SEQ ID NO: 36280 - DNA, 23 bp, Artificial Sequence
  Synthetic
ggcatagcacgatcacatttagg

SEQ ID NO: 36281 - DNA, 24 bp, Artificial Sequence
  Synthetic
aaatcatcaacaaaacaaccagct

SEQ ID NO: 36282 - DNA, 20 bp, Artificial Sequence
  Synthetic
atgagcgccctcaacatcaa

SEQ ID NO: 36283 - DNA, 22 bp, Artificial Sequence
  Synthetic
catagcatggcagctttaagca

SEQ ID NO: 36284 - DNA, 25 bp, Artificial Sequence
  Synthetic
tctaaaccatctacgtacacacaag

SEQ ID NO: 36285 - DNA, 20 bp, Artificial Sequence
  Synthetic
accactacccatgcgaagag

SEQ ID NO: 36286 - DNA, 22 bp, Artificial Sequence
  Synthetic
tgaacctgagcctctaaagcat

SEQ ID NO: 36287 - DNA, 25 bp, Artificial Sequence
  Synthetic
gatagtcctcaataactggcctaac

SEQ ID NO: 36288 - DNA, 21 bp, Artificial Sequence
  Synthetic
acgatttccagaggagcttct

SEQ ID NO: 36289 - DNA, 23 bp, Artificial Sequence
  Synthetic
ccttggcattttgcttagtgact

SEQ ID NO: 36290 - DNA, 24 bp, Artificial Sequence
  Synthetic
tttacgctgaggtttagaactcaa

SEQ ID NO: 36291 - DNA, 22 bp, Artificial Sequence
  Synthetic
gttcgacaatcatcgggttgaa

SEQ ID NO: 36292 - DNA, 24 bp, Artificial Sequence
  Synthetic
tcctcattttcaatgtcctgcaat

SEQ ID NO: 36293 - DNA, 20 bp, Artificial Sequence
  Synthetic
caattggggctacgtcctct

SEQ ID NO: 36294 - DNA, 23 bp, Artificial Sequence
  Synthetic
cagtgagagaaaactccatgctc

SEQ ID NO: 36295 - DNA, 25 bp, Artificial Sequence
  Synthetic
tgtctttctctttaatcgaggactc

SEQ ID NO: 36296 - DNA, 21 bp, Artificial Sequence
  Synthetic
ccctgatctcagtggcattct

SEQ ID NO: 36297 - DNA, 22 bp, Artificial Sequence
  Synthetic
gcctcgctttatcatccgaatt

SEQ ID NO: 36298 - DNA, 22 bp, Artificial Sequence
  Synthetic
cttgagactctcaggtcctcaa

SEQ ID NO: 36299 - DNA, 20 bp, Artificial Sequence
  Synthetic
tcgggactctctggcggagg

SEQ ID NO: 36300 - DNA, 20 bp, Artificial Sequence
  Synthetic
cgacagaccgtgttttggaa

SEQ ID NO: 36301 - DNA, 24 bp, Artificial Sequence
  Synthetic
tgtaggctgttcgtctatatccat

SEQ ID NO: 36302 - DNA, 25 bp, Artificial Sequence
  Synthetic
tgaacttgtttaggatccatggaaa

SEQ ID NO: 36303 - DNA, 25 bp, Artificial Sequence
  Synthetic
aaaatttcctacctaaagcatgctg

SEQ ID NO: 36304 - DNA, 25 bp, Artificial Sequence
  Synthetic
gcagcaaacttgttagtttcgattt

SEQ ID NO: 36305 - DNA, 25 bp, Artificial Sequence
  Synthetic
gaaatttaggcttctctacccctgt

SEQ ID NO: 36306 - DNA, 24 bp, Artificial Sequence
  Synthetic
acttcaattggcttgttctcttca

SEQ ID NO: 36307 - DNA, 24 bp, Artificial Sequence
  Synthetic
tctttctctttgacagaagactcg

SEQ ID NO: 36308 - DNA, 22 bp, Artificial Sequence
  Synthetic
tccaccgatgaggattccaatt

SEQ ID NO: 36309 - DNA, 20 bp, Artificial Sequence
  Synthetic
tgctccttgctagtgcttcg

SEQ ID NO: 36310 - DNA, 22 bp, Artificial Sequence
  Synthetic
gttttggtgtacctcttctgcc

SEQ ID NO: 36311 - DNA, 20 bp, Artificial Sequence
  Synthetic
gaaactccaaagctgggcag

SEQ ID NO: 36312 - DNA, 23 bp, Artificial Sequence
  Synthetic
cctttggctagtgttgagaatgg

SEQ ID NO: 36313 - DNA, 20 bp, Artificial Sequence
  Synthetic
tccatgcatagcgaccctta

SEQ ID NO: 36314 - DNA, 20 bp, Artificial Sequence
  Synthetic
taagaccatgctcccttgct

SEQ ID NO: 36315 - DNA, 21 bp, Artificial Sequence
  Synthetic
cttgcaggagacacatcaaca

SEQ ID NO: 36316 - DNA, 20 bp, Artificial Sequence
  Synthetic
cccctgtttgaggaacctca

SEQ ID NO: 36317 - DNA, 21 bp, Artificial Sequence
  Synthetic
gatcaggcacaacatcctgtg

SEQ ID NO: 36318 - DNA, 22 bp, Artificial Sequence
  Synthetic
tgacatcctggatttgccatca

SEQ ID NO: 36319 - DNA, 22 bp, Artificial Sequence
  Synthetic
cccgtaacatgagcattcttca

SEQ ID NO: 36320 - DNA, 20 bp, Artificial Sequence
  Synthetic
ccaagtgttagccccatcca

SEQ ID NO: 36321 - DNA, 20 bp, Artificial Sequence
  Synthetic
agtgagtatctcgcgagtgc

SEQ ID NO: 36322 - DNA, 22 bp, Artificial Sequence
  Synthetic
ggccattcctattccaccatgt

SEQ ID NO: 36323 - DNA, 25 bp, Artificial Sequence
  Synthetic
actcttattttcagtgtttggaggt

SEQ ID NO: 36324 - DNA, 21 bp, Artificial Sequence
  Synthetic
ccttgcgtttcactgacttct

SEQ ID NO: 36325 - DNA, 20 bp, Artificial Sequence
  Synthetic
aatgtcccaagcacatcccg

SEQ ID NO: 36326 - DNA, 20 bp, Artificial Sequence
  Synthetic
ctcaggacagcagactccac

SEQ ID NO: 36327 - DNA, 20 bp, Artificial Sequence
  Synthetic
cactgaggctcacagcaatt

SEQ ID NO: 36328 - DNA, 21 bp, Artificial Sequence
  Synthetic
cctcctccggttcatcttctg

SEQ ID NO: 36329 - DNA, 20 bp, Artificial Sequence
  Synthetic
cttccagcctcggactcaaa

SEQ ID NO: 36330 - DNA, 21 bp, Artificial Sequence
  Synthetic
tcttcttcgtcttctggaggg

SEQ ID NO: 36331 - DNA, 20 bp, Artificial Sequence
  Synthetic
aatctgcccccagtacctct

SEQ ID NO: 36332 - DNA, 20 bp, Artificial Sequence
  Synthetic
cttccaccccaactcctgga

SEQ ID NO: 36333 - DNA, 22 bp, Artificial Sequence
  Synthetic
tcaaattcgatgctgacgtcag

SEQ ID NO: 36334 - DNA, 22 bp, Artificial Sequence
  Synthetic
tgctgttgctgtgttactttgt

SEQ ID NO: 36335 - DNA, 24 bp, Artificial Sequence
  Synthetic
agtacctattcctaaaggtccacc

SEQ ID NO: 36336 - DNA, 25 bp, Artificial Sequence
  Synthetic
catgtccaaatcctatatcacccat

SEQ ID NO: 36337 - DNA, 25 bp, Artificial Sequence
  Synthetic
accacatacatacacaatgacttct

SEQ ID NO: 36338 - DNA, 22 bp, Artificial Sequence
  Synthetic
cctgaattagtcaatgcctccg

SEQ ID NO: 36339 - DNA, 20 bp, Artificial Sequence
  Synthetic
ctgcacgtttagcacattgc

SEQ ID NO: 36340 - DNA, 25 bp, Artificial Sequence
  Synthetic
ggaaatgtagcatcgtctataagcc

SEQ ID NO: 36341 - DNA, 21 bp, Artificial Sequence
  Synthetic
cagtacatgctcctgccttac

SEQ ID NO: 36342 - DNA, 22 bp, Artificial Sequence
  Synthetic
tgtccatgtgttttatgccaca

SEQ ID NO: 36343 - DNA, 22 bp, Artificial Sequence
  Synthetic
accagtacccttacctgtgcct

SEQ ID NO: 36344 - DNA, 21 bp, Artificial Sequence
  Synthetic
atggcgtaacatgtctgctac

SEQ ID NO: 36345 - DNA, 21 bp, Artificial Sequence
  Synthetic
aaacatatgcgaacgtttgcg

SEQ ID NO: 36346 - DNA, 25 bp, Artificial Sequence
  Synthetic
cagataactaattcggttgctggaa

SEQ ID NO: 36347 - DNA, 20 bp, Artificial Sequence
  Synthetic
cgggtgacaactcctcatca

SEQ ID NO: 36348 - DNA, 21 bp, Artificial Sequence
  Synthetic
ctgccatgtcgaaaaagggat

SEQ ID NO: 36349 - DNA, 20 bp, Artificial Sequence
  Synthetic
tcagcaaccgttctgtcctg

SEQ ID NO: 36350 - DNA, 21 bp, Artificial Sequence
  Synthetic
acggtcgcgttaaatctccat

SEQ ID NO: 36351 - DNA, 25 bp, Artificial Sequence
  Synthetic
tggaggtatatactgttggttgagt

SEQ ID NO: 36352 - DNA, 22 bp, Artificial Sequence
  Synthetic
tcgtcctaattccctgacatct

SEQ ID NO: 36353 - DNA, 24 bp, Artificial Sequence
  Synthetic
tggatctggaaatagtagtcgcat

SEQ ID NO: 36354 - DNA, 23 bp, Artificial Sequence
  Synthetic
gccaagataattatgaaggcgcg

SEQ ID NO: 36355 - DNA, 19 bp, Artificial Sequence
  Synthetic
tgctcgcccactcgaccga

SEQ ID NO: 36356 - DNA, 21 bp, Artificial Sequence
  Synthetic
accccgtcacagaattgattg

SEQ ID NO: 36357 - DNA, 18 bp, Artificial Sequence
  Synthetic
atggggagccaggcccaa

SEQ ID NO: 36358 - DNA, 20 bp, Artificial Sequence
  Synthetic
cggtctcccctaggcttgga

SEQ ID NO: 36359 - DNA, 22 bp, Artificial Sequence
  Synthetic
ccacagaaactacacggcctca

SEQ ID NO: 36360 - DNA, 22 bp, Artificial Sequence
  Synthetic
ttccgaccacgagtctttgtcc

SEQ ID NO: 36361 - DNA, 19 bp, Artificial Sequence
  Synthetic
actgggcccagcgggagaa

SEQ ID NO: 36362 - DNA, 22 bp, Artificial Sequence
  Synthetic
cacgttcagcagacacgagaga

SEQ ID NO: 36363 - DNA, 22 bp, Artificial Sequence
  Synthetic
ccgattgatggcaaggccctat

SEQ ID NO: 36364 - DNA, 21 bp, Artificial Sequence
  Synthetic
cctacgtctccgcagacaccc

SEQ ID NO: 36365 - DNA, 20 bp, Artificial Sequence
  Synthetic
ggctctggaggccgtcctct

SEQ ID NO: 36366 - DNA, 19 bp, Artificial Sequence
  Synthetic
agagcccgctcccacttcg

SEQ ID NO: 36367 - DNA, 19 bp, Artificial Sequence
  Synthetic
cggtccgtgtagatgccgg

SEQ ID NO: 36368 - DNA, 19 bp, Artificial Sequence
  Synthetic
cgctttgccggcatccagt

SEQ ID NO: 36369 - DNA, 20 bp, Artificial Sequence
  Synthetic
accgacgattccccctcacc

SEQ ID NO: 36370 - DNA, 19 bp, Artificial Sequence
  Synthetic
ggcgcattcaccaggcagc

SEQ ID NO: 36371 - DNA, 19 bp, Artificial Sequence
  Synthetic
tccatgggacgaggcggca

SEQ ID NO: 36372 - DNA, 19 bp, Artificial Sequence
  Synthetic
gagtccgctgctaccgagc

SEQ ID NO: 36373 - DNA, 19 bp, Artificial Sequence
  Synthetic
tggctgggaatggcaggcg

SEQ ID NO: 36374 - DNA, 19 bp, Artificial Sequence
  Synthetic
ctccaccccgaccaactgc

SEQ ID NO: 36375 - DNA, 19 bp, Artificial Sequence
  Synthetic
ttggctcctcggcatgggc

SEQ ID NO: 36376 - DNA, 19 bp, Artificial Sequence
  Synthetic
tgagggggcggtcaccgat

SEQ ID NO: 36377 - DNA, 22 bp, Artificial Sequence
  Synthetic
ctcaaaatccacctggctgcct

SEQ ID NO: 36378 - DNA, 22 bp, Artificial Sequence
  Synthetic
ggacctgttgcttcagagcctt

SEQ ID NO: 36379 - DNA, 21 bp, Artificial Sequence
  Synthetic
cgggacaacggcacagaaagt

SEQ ID NO: 36380 - DNA, 20 bp, Artificial Sequence
  Synthetic
aaactgcctagagaccggag

SEQ ID NO: 36381 - DNA, 21 bp, Artificial Sequence
  Synthetic
accaagggtccacgtcgaatg

SEQ ID NO: 36382 - DNA, 19 bp, Artificial Sequence
  Synthetic
aagtctcccgagcccgacc

SEQ ID NO: 36383 - DNA, 20 bp, Artificial Sequence
  Synthetic
gctcctggtcttccgcctcc

SEQ ID NO: 36384 - DNA, 22 bp, Artificial Sequence
  Synthetic
cgcctttgaggtcctgagagac

SEQ ID NO: 36385 - DNA, 19 bp, Artificial Sequence
  Synthetic
tgtagggagcactcggggc

SEQ ID NO: 36386 - DNA, 21 bp, Artificial Sequence
  Synthetic
gggctttgtggcaccaacctc

SEQ ID NO: 36387 - DNA, 19 bp, Artificial Sequence
  Synthetic
gggatgatgggcgggacca

SEQ ID NO: 36388 - DNA, 19 bp, Artificial Sequence
  Synthetic
ttacgctgcagcacggggc

SEQ ID NO: 36389 - DNA, 19 bp, Artificial Sequence
  Synthetic
cccgatgacccgatgctcg

SEQ ID NO: 36390 - DNA, 20 bp, Artificial Sequence
  Synthetic
cccttggaactgacgggcac

SEQ ID NO: 36391 - DNA, 22 bp, Artificial Sequence
  Synthetic
gccagactctcttcagtgaccg

SEQ ID NO: 36392 - DNA, 21 bp, Artificial Sequence
  Synthetic
gttgatggcatcgtcacgcac

SEQ ID NO: 36393 - DNA, 21 bp, Artificial Sequence
  Synthetic
tggaggcatgaaacggaagca

SEQ ID NO: 36394 - DNA, 22 bp, Artificial Sequence
  Synthetic
aagcggacagagcagactgttt

SEQ ID NO: 36395 - DNA, 19 bp, Artificial Sequence
  Synthetic
gccagtggggggggtgttt

SEQ ID NO: 36396 - DNA, 21 bp, Artificial Sequence
  Synthetic
caccaccgagggaaagttggt

SEQ ID NO: 36397 - DNA, 20 bp, Artificial Sequence
  Synthetic
agagtggggctgtggatggt

SEQ ID NO: 36398 - DNA, 21 bp, Artificial Sequence
  Synthetic
gggcctgtatgaagaaagagc

SEQ ID NO: 36399 - DNA, 22 bp, Artificial Sequence
  Synthetic
ggcccaaccttgccctatacca

SEQ ID NO: 36400 - DNA, 19 bp, Artificial Sequence
  Synthetic
tttagcaggccggtggtgg

SEQ ID NO: 36401 - DNA, 21 bp, Artificial Sequence
  Synthetic
cccggcaagccaaagtaggcc

SEQ ID NO: 36402 - DNA, 21 bp, Artificial Sequence
  Synthetic
acgtctcagggcatgcttcac

SEQ ID NO: 36403 - DNA, 22 bp, Artificial Sequence
  Synthetic
gcaacggaagatgcgtgcacta

SEQ ID NO: 36404 - DNA, 21 bp, Artificial Sequence
  Synthetic
cgtctttgtggagcccaaggg

SEQ ID NO: 36405 - DNA, 19 bp, Artificial Sequence
  Synthetic
ggcttcttgcgggccaaca

SEQ ID NO: 36406 - DNA, 19 bp, Artificial Sequence
  Synthetic
atgtggtggcgccagcgtg

SEQ ID NO: 36407 - DNA, 21 bp, Artificial Sequence
  Synthetic
gcctcaccagaaggcgttcct

SEQ ID NO: 36408 - DNA, 22 bp, Artificial Sequence
  Synthetic
ccggtctcgggactgtttgaga

SEQ ID NO: 36409 - DNA, 22 bp, Artificial Sequence
  Synthetic
ccagcctcaactacgactcgtg

SEQ ID NO: 36410 - DNA, 20 bp, Artificial Sequence
  Synthetic
gtctgcgagcgttagggtcc

SEQ ID NO: 36411 - DNA, 20 bp, Artificial Sequence
  Synthetic
agccgggcttcagcatcaat

SEQ ID NO: 36412 - DNA, 22 bp, Artificial Sequence
  Synthetic
catgccaagatcgctgagacgt

SEQ ID NO: 36413 - DNA, 20 bp, Artificial Sequence
  Synthetic
tacgcggtgttcacccggga

SEQ ID NO: 36414 - DNA, 22 bp, Artificial Sequence
  Synthetic
gctatttccaaacagcaggcac

SEQ ID NO: 36415 - DNA, 22 bp, Artificial Sequence
  Synthetic
acatgcttaatccctttgccac

SEQ ID NO: 36416 - DNA, 20 bp, Artificial Sequence
  Synthetic
tgcttgctaaaaaggctgct

SEQ ID NO: 36417 - DNA, 20 bp, Artificial Sequence
  Synthetic
atttcctggctcgtgtcacg

SEQ ID NO: 36418 - DNA, 21 bp, Artificial Sequence
  Synthetic
acagtggctagaaattgtgcc

SEQ ID NO: 36419 - DNA, 20 bp, Artificial Sequence
  Synthetic
gttaggtaagggacgctgct

SEQ ID NO: 36420 - DNA, 22 bp, Artificial Sequence
  Synthetic
aaatcaatgtcagggccatcaa

SEQ ID NO: 36421 - DNA, 22 bp, Artificial Sequence
  Synthetic
caatggatggccactaacacct

SEQ ID NO: 36422 - DNA, 20 bp, Artificial Sequence
  Synthetic
gaggtaaccatggacccact

SEQ ID NO: 36423 - DNA, 22 bp, Artificial Sequence
  Synthetic
actcacaggggtgcaaccaaat

SEQ ID NO: 36424 - DNA, 24 bp, Artificial Sequence
  Synthetic
gactgttgaaaaatgcaagggaat

SEQ ID NO: 36425 - DNA, 25 bp, Artificial Sequence
  Synthetic
gctttaccattattgcacagtcttt

SEQ ID NO: 36426 - DNA, 24 bp, Artificial Sequence
  Synthetic
cagcactacagtcttgtaatgtcc

SEQ ID NO: 36427 - DNA, 21 bp, Artificial Sequence
  Synthetic
acggtcgcgatactgtcggta

SEQ ID NO: 36428 - DNA, 21 bp, Artificial Sequence
  Synthetic
ccgaccctatacccaaaccac

SEQ ID NO: 36429 - DNA, 24 bp, Artificial Sequence
  Synthetic
agaaatcttaccctttgttcccag

SEQ ID NO: 36430 - DNA, 22 bp, Artificial Sequence
  Synthetic
gtttctgcagcaggataagtgg

SEQ ID NO: 36431 - DNA, 25 bp, Artificial Sequence
  Synthetic
tggatctttactttgcgtttcagat

SEQ ID NO: 36432 - DNA, 22 bp, Artificial Sequence
  Synthetic
tggaaccgtttgccttcactga

SEQ ID NO: 36433 - DNA, 21 bp, Artificial Sequence
  Synthetic
catgtcctgtccgctgtcacc

SEQ ID NO: 36434 - DNA, 24 bp, Artificial Sequence
  Synthetic
aaatgcacatattacccagtccaa

SEQ ID NO: 36435 - DNA, 25 bp, Artificial Sequence
  Synthetic
gcctgctttataccaatatagtgca

SEQ ID NO: 36436 - DNA, 24 bp, Artificial Sequence
  Synthetic
gtgtagcacatagtttttgtgtcc

SEQ ID NO: 36437 - DNA, 20 bp, Artificial Sequence
  Synthetic
tgtgtccaggcagacaagta

SEQ ID NO: 36438 - DNA, 20 bp, Artificial Sequence
  Synthetic
gtgccggaccctgttccaat

SEQ ID NO: 36439 - DNA, 21 bp, Artificial Sequence
  Synthetic
gctgtgataaaaacctggggt

SEQ ID NO: 36440 - DNA, 25 bp, Artificial Sequence
  Synthetic
ttttgatagcaaaataaggatggcc

SEQ ID NO: 36441 - DNA, 20 bp, Artificial Sequence
  Synthetic
catcgccaggcacaacatca

SEQ ID NO: 36442 - DNA, 24 bp, Artificial Sequence
  Synthetic
aaaatcagggtacttgcatgtagt

SEQ ID NO: 36443 - DNA, 24 bp, Artificial Sequence
  Synthetic
agcatacaacagacacacacataa

SEQ ID NO: 36444 - DNA, 20 bp, Artificial Sequence
  Synthetic
taaaggctaggggacggccg

SEQ ID NO: 36445 - DNA, 22 bp, Artificial Sequence
  Synthetic
ccgcccggaaacttaacgtctt

SEQ ID NO: 36446 - DNA, 20 bp, Artificial Sequence
  Synthetic
cccactttctcgcacgggac

SEQ ID NO: 36447 - DNA, 20 bp, Artificial Sequence
  Synthetic
tgacctcggggacacgcatc

SEQ ID NO: 36448 - DNA, 22 bp, Artificial Sequence
  Synthetic
tgggtgtagaacagagacgcga

SEQ ID NO: 36449 - DNA, 22 bp, Artificial Sequence
  Synthetic
cgcaagtcttggtgtagccaga

SEQ ID NO: 36450 - DNA, 20 bp, Artificial Sequence
  Synthetic
gatgatgtcgtaggcgccgc

SEQ ID NO: 36451 - DNA, 22 bp, Artificial Sequence
  Synthetic
cggagacgtccaaccctctgta

SEQ ID NO: 36452 - DNA, 21 bp, Artificial Sequence
  Synthetic
ccaagcggtacaggagaggtg

SEQ ID NO: 36453 - DNA, 22 bp, Artificial Sequence
  Synthetic
gcttgtttggaagcttgctgca

SEQ ID NO: 36454 - DNA, 20 bp, Artificial Sequence
  Synthetic
cgcaccataccctgccagga

SEQ ID NO: 36455 - DNA, 21 bp, Artificial Sequence
  Synthetic
aggaaaggtcccctgccagat

SEQ ID NO: 36456 - DNA, 22 bp, Artificial Sequence
  Synthetic
ggggcatggaagagatggaacc

SEQ ID NO: 36457 - DNA, 22 bp, Artificial Sequence
  Synthetic
gccatcttctcgcagaccctga

SEQ ID NO: 36458 - DNA, 20 bp, Artificial Sequence
  Synthetic
gtatctgcggcggccttgtg

SEQ ID NO: 36459 - DNA, 20 bp, Artificial Sequence
  Synthetic
gccacccgtgtcagttcgtg

SEQ ID NO: 36460 - DNA, 21 bp, Artificial Sequence
  Synthetic
gcacatcgcgcatctacaccg

SEQ ID NO: 36461 - DNA, 22 bp, Artificial Sequence
  Synthetic
ggcgaagtcatcggtttcaagc

SEQ ID NO: 36462 - DNA, 22 bp, Artificial Sequence
  Synthetic
ggattctgccgataccatgccg

SEQ ID NO: 36463 - DNA, 22 bp, Artificial Sequence
  Synthetic
tgaagctgctgaccatcgtcaa

SEQ ID NO: 36464 - DNA, 18 bp, Artificial Sequence
  Synthetic
gccaaagcaaaccccgcg

SEQ ID NO: 36465 - DNA, 21 bp, Artificial Sequence
  Synthetic
gcgccagcatgtcattgaccg

SEQ ID NO: 36466 - DNA, 20 bp, Artificial Sequence
  Synthetic
cgaaatcccgcagagcgtca

SEQ ID NO: 36467 - DNA, 20 bp, Artificial Sequence
  Synthetic
ggcggaacagttgaaggcgg

SEQ ID NO: 36468 - DNA, 20 bp, Artificial Sequence
  Synthetic
gggctggtgctgtcggttac

SEQ ID NO: 36469 - DNA, 20 bp, Artificial Sequence
  Synthetic
aatgaccgaccaaccgtggg

SEQ ID NO: 36470 - DNA, 20 bp, Artificial Sequence
  Synthetic
cagcttttgtttgcgcccga

SEQ ID NO: 36471 - DNA, 18 bp, Artificial Sequence
  Synthetic
gcgcgaagtgtggctggt

SEQ ID NO: 36472 - DNA, 19 bp, Artificial Sequence
  Synthetic
ccgcacgccgcattattgc

SEQ ID NO: 36473 - DNA, 19 bp, Artificial Sequence
  Synthetic
tggctgaaacaggccgccg

SEQ ID NO: 36474 - DNA, 20 bp, Artificial Sequence
  Synthetic
tttcagacggcatcggcagt

SEQ ID NO: 36475 - DNA, 19 bp, Artificial Sequence
  Synthetic
accgcctcgcccttttcgg

SEQ ID NO: 36476 - DNA, 21 bp, Artificial Sequence
  Synthetic
cgttcctgccggtaaacaggg

SEQ ID NO: 36477 - DNA, 18 bp, Artificial Sequence
  Synthetic
cgcgccgaacgacaaacc

SEQ ID NO: 36478 - DNA, 22 bp, Artificial Sequence
  Synthetic
acgcaaaacgaacaggcgattt

SEQ ID NO: 36479 - DNA, 20 bp, Artificial Sequence
  Synthetic
tctccgccaaacacgcgatg

SEQ ID NO: 36480 - DNA, 19 bp, Artificial Sequence
  Synthetic
gcgctgcatggcaggcatt

SEQ ID NO: 36481 - DNA, 20 bp, Artificial Sequence
  Synthetic
cccgtggggcgtgattgttc

SEQ ID NO: 36482 - DNA, 19 bp, Artificial Sequence
  Synthetic
cgaaaaaggcgcgcaaggc

SEQ ID NO: 36483 - DNA, 19 bp, Artificial Sequence
  Synthetic
atgcccgaaacaggcggcg

SEQ ID NO: 36484 - DNA, 20 bp, Artificial Sequence
  Synthetic
ttcagcctggtcttggtcgc

SEQ ID NO: 36485 - DNA, 22 bp, Artificial Sequence
  Synthetic
agcgcggaaggcataaaggaag

SEQ ID NO: 36486 - DNA, 22 bp, Artificial Sequence
  Synthetic
gcatcgccaaaaccactttcgg

SEQ ID NO: 36487 - DNA, 21 bp, Artificial Sequence
  Synthetic
accagtgcaatcggcgtatgc

SEQ ID NO: 36488 - DNA, 21 bp, Artificial Sequence
  Synthetic
ggcgtttgttcaactcggcga

SEQ ID NO: 36489 - DNA, 20 bp, Artificial Sequence
  Synthetic
gttttgtggcgccagcagtg

SEQ ID NO: 36490 - DNA, 19 bp, Artificial Sequence
  Synthetic
accgctgctccgctcgagt

SEQ ID NO: 36491 - DNA, 19 bp, Artificial Sequence
  Synthetic
ttgccatggacaacgccga

SEQ ID NO: 36492 - DNA, 20 bp, Artificial Sequence
  Synthetic
gacaagggcgacgtggaaga

SEQ ID NO: 36493 - DNA, 19 bp, Artificial Sequence
  Synthetic
gcctgcgaccgttacgacc

SEQ ID NO: 36494 - DNA, 19 bp, Artificial Sequence
  Synthetic
accgccctgacgttcttgg

SEQ ID NO: 36495 - DNA, 18 bp, Artificial Sequence
  Synthetic
atggccgagcttcacccg

SEQ ID NO: 36496 - DNA, 19 bp, Artificial Sequence
  Synthetic
tgtggcagccgctcaaacg

SEQ ID NO: 36497 - DNA, 22 bp, Artificial Sequence
  Synthetic
ggcatcggtttgaacgtcgtcc

SEQ ID NO: 36498 - DNA, 20 bp, Artificial Sequence
  Synthetic
tccgtcctgaccgccgttta

SEQ ID NO: 36499 - DNA, 22 bp, Artificial Sequence
  Synthetic
cctcgggctggatcaggcatac

SEQ ID NO: 36500 - DNA, 20 bp, Artificial Sequence
  Synthetic
ggcacggtgttggcagacaa

SEQ ID NO: 36501 - DNA, 22 bp, Artificial Sequence
  Synthetic
ggaaaacgtcgtcgcccacatc

SEQ ID NO: 36502 - DNA, 22 bp, Artificial Sequence
  Synthetic
gcgcccgaaatataggcgaaca

SEQ ID NO: 36503 - DNA, 18 bp, Artificial Sequence
  Synthetic
cgccgcatcatcgacgct

SEQ ID NO: 36504 - DNA, 22 bp, Artificial Sequence
  Synthetic
ccgactatgctgtctgccggta

SEQ ID NO: 36505 - DNA, 18 bp, Artificial Sequence
  Synthetic
gcccttcctgccaaggca

SEQ ID NO: 36506 - DNA, 19 bp, Artificial Sequence
  Synthetic
caccaacgccgaaaacgcc

SEQ ID NO: 36507 - DNA, 18 bp, Artificial Sequence
  Synthetic
ggcaaaggcttcggggct

SEQ ID NO: 36508 - DNA, 19 bp, Artificial Sequence
  Synthetic
acggcacagcagggcatcg

SEQ ID NO: 36509 - DNA, 19 bp, Artificial Sequence
  Synthetic
acggcctgcggcaaattcc

SEQ ID NO: 36510 - DNA, 21 bp, Artificial Sequence
  Synthetic
cgcgcttgttccaaaaggtgt

SEQ ID NO: 36511 - DNA, 19 bp, Artificial Sequence
  Synthetic
gcgcaaacctctgccgcat

SEQ ID NO: 36512 - DNA, 18 bp, Artificial Sequence
  Synthetic
cgtgttcacgccgcacct

SEQ ID NO: 36513 - DNA, 20 bp, Artificial Sequence
  Synthetic
tccgacctgggaacactggt

SEQ ID NO: 36514 - DNA, 19 bp, Artificial Sequence
  Synthetic
cggcctcgccttccaaacg

SEQ ID NO: 36515 - DNA, 22 bp, Artificial Sequence
  Synthetic
ttcgagatgaaaagcggtatcg

SEQ ID NO: 36516 - DNA, 20 bp, Artificial Sequence
  Synthetic
tgcccctgtgctcccaagta

SEQ ID NO: 36517 - DNA, 20 bp, Artificial Sequence
  Synthetic
cttcccctgcctcgaaacgc

SEQ ID NO: 36518 - DNA, 20 bp, Artificial Sequence
  Synthetic
tggcggtcaaagtcgaaccc

SEQ ID NO: 36519 - DNA, 19 bp, Artificial Sequence
  Synthetic
cgtttcaagctggggcgcg

SEQ ID NO: 36520 - DNA, 19 bp, Artificial Sequence
  Synthetic
catggtcgtcggcttggct

SEQ ID NO: 36521 - DNA, 21 bp, Artificial Sequence
  Synthetic
gcgatgctggatttgggcttg

SEQ ID NO: 36522 - DNA, 19 bp, Artificial Sequence
  Synthetic
aacgtccgaccatcgcacc

SEQ ID NO: 36523 - DNA, 19 bp, Artificial Sequence
  Synthetic
ccagcatttcgcacaccgc

SEQ ID NO: 36524 - DNA, 21 bp, Artificial Sequence
  Synthetic
gcggggcagcccatattgatg

SEQ ID NO: 36525 - DNA, 21 bp, Artificial Sequence
  Synthetic
cggcggtttgtttgaggacgg

SEQ ID NO: 36526 - DNA, 21 bp, Artificial Sequence
  Synthetic
tacccttcccgatagccgcac

SEQ ID NO: 36527 - DNA, 20 bp, Artificial Sequence
  Synthetic
ttcgccatatcgtccagcgg

SEQ ID NO: 36528 - DNA, 20 bp, Artificial Sequence
  Synthetic
agttcagatacaccggcgcg

SEQ ID NO: 36529 - DNA, 22 bp, Artificial Sequence
  Synthetic
cgtcggcgtattcctcgtcatg

SEQ ID NO: 36530 - DNA, 20 bp, Artificial Sequence
  Synthetic
gtggttatcgcccgtcgcaa

SEQ ID NO: 36531 - DNA, 22 bp, Artificial Sequence
  Synthetic
ccgattaccactgtgaaccgca

SEQ ID NO: 36532 - DNA, 20 bp, Artificial Sequence
  Synthetic
aaaccctcgaacatgccgcc

SEQ ID NO: 36533 - DNA, 20 bp, Artificial Sequence
  Synthetic
acctccccctaccggcacac

SEQ ID NO: 36534 - DNA, 20 bp, Artificial Sequence
  Synthetic
atctgccacgacatcgcctc

SEQ ID NO: 36535 - DNA, 19 bp, Artificial Sequence
  Synthetic
gcgcccaactgtccgacct

SEQ ID NO: 36536 - DNA, 21 bp, Artificial Sequence
  Synthetic
aaccctgaagaggatcagcgc

SEQ ID NO: 36537 - DNA, 22 bp, Artificial Sequence
  Synthetic
gtcgtcctataccccgccaaac

SEQ ID NO: 36538 - DNA, 21 bp, Artificial Sequence
  Synthetic
ggactggacatacacccggct

SEQ ID NO: 36539 - DNA, 22 bp, Artificial Sequence
  Synthetic
tgattggcagccgatcgaacaa

SEQ ID NO: 36540 - DNA, 17 bp, Artificial Sequence
  Synthetic
aacgttgtcgccggcgt

SEQ ID NO: 36541 - DNA, 19 bp, Artificial Sequence
  Synthetic
cccgaccgcatcctctgca

SEQ ID NO: 36542 - DNA, 20 bp, Artificial Sequence
  Synthetic
cttgcgggccgataaattcg

SEQ ID NO: 36543 - DNA, 22 bp, Artificial Sequence
  Synthetic
gcgaaaaaaccgtcttgtgcga

SEQ ID NO: 36544 - DNA, 18 bp, Artificial Sequence
  Synthetic
gctgcacgcctgcggaaa

SEQ ID NO: 36545 - DNA, 19 bp, Artificial Sequence
  Synthetic
cgaccggtttggatgcggt

SEQ ID NO: 36546 - DNA, 18 bp, Artificial Sequence
  Synthetic
cgccgcctgctcaatgca

SEQ ID NO: 36547 - DNA, 22 bp, Artificial Sequence
  Synthetic
cgatttacgagggcagcatcga

SEQ ID NO: 36548 - DNA, 18 bp, Artificial Sequence
  Synthetic
gcctgcgcaaaccggtca

SEQ ID NO: 36549 - DNA, 18 bp, Artificial Sequence
  Synthetic
acagttcttcgccgccgc

SEQ ID NO: 36550 - DNA, 18 bp, Artificial Sequence
  Synthetic
ttgccgcactcgatgccg

SEQ ID NO: 36551 - DNA, 19 bp, Artificial Sequence
  Synthetic
gtggcactgagcggacgtt

SEQ ID NO: 36552 - DNA, 21 bp, Artificial Sequence
  Synthetic
cctccaaccttgccgttgtcg

SEQ ID NO: 36553 - DNA, 22 bp, Artificial Sequence
  Synthetic
ggaagaagcggcggaaaaagtg

SEQ ID NO: 36554 - DNA, 19 bp, Artificial Sequence
  Synthetic
agctcggggctgtatcggg

SEQ ID NO: 36555 - DNA, 19 bp, Artificial Sequence
  Synthetic
acgcgctggcaaccctctc

SEQ ID NO: 36556 - DNA, 19 bp, Artificial Sequence
  Synthetic
accgcattcgccaccaccg

SEQ ID NO: 36557 - DNA, 19 bp, Artificial Sequence
  Synthetic
tcggcttcaaccacggcac

SEQ ID NO: 36558 - DNA, 19 bp, Artificial Sequence
  Synthetic
agaagccgcgggcagcaag

SEQ ID NO: 36559 - DNA, 19 bp, Artificial Sequence
  Synthetic
tccgcgaactcgaagcgtt

SEQ ID NO: 36560 - DNA, 21 bp, Artificial Sequence
  Synthetic
cgtcgaccagaccatcgccat

SEQ ID NO: 36561 - DNA, 22 bp, Artificial Sequence
  Synthetic
gctgcgatttcgaaccgtttgc

SEQ ID NO: 36562 - DNA, 21 bp, Artificial Sequence
  Synthetic
gcacatccaacagcagggtca

SEQ ID NO: 36563 - DNA, 19 bp, Artificial Sequence
  Synthetic
tcgcccgcatcttccgcac

SEQ ID NO: 36564 - DNA, 20 bp, Artificial Sequence
  Synthetic
gatggtttccagcggcgaga

SEQ ID NO: 36565 - DNA, 19 bp, Artificial Sequence
  Synthetic
cggtgggtttcgcgcttga

SEQ ID NO: 36566 - DNA, 19 bp, Artificial Sequence
  Synthetic
aaggccgtctgaagccgcc

SEQ ID NO: 36567 - DNA, 19 bp, Artificial Sequence
  Synthetic
gcctgtcgttgagcgcgtt

SEQ ID NO: 36568 - DNA, 18 bp, Artificial Sequence
  Synthetic
gcggcgtggaagcgtcta

SEQ ID NO: 36569 - DNA, 21 bp, Artificial Sequence
  Synthetic
ctccgaatccgtcgccttcaa

SEQ ID NO: 36570 - DNA, 20 bp, Artificial Sequence
  Synthetic
aggacttggcaggcgaagac

SEQ ID NO: 36571 - DNA, 18 bp, Artificial Sequence
  Synthetic
aaacgcgggctgctgctg

SEQ ID NO: 36572 - DNA, 18 bp, Artificial Sequence
  Synthetic
tacgccaatcggtgcgcc

SEQ ID NO: 36573 - DNA, 21 bp, Artificial Sequence
  Synthetic
aagcgtaactcaaggcaatgt

SEQ ID NO: 36574 - DNA, 20 bp, Artificial Sequence
  Synthetic
aaacacgccaaagcagaagt

SEQ ID NO: 36575 - DNA, 18 bp, Artificial Sequence
  Synthetic
acaggccgttgagcagcg

SEQ ID NO: 36576 - DNA, 19 bp, Artificial Sequence
  Synthetic
tggtgcgtcctgcccgttc

SEQ ID NO: 36577 - DNA, 19 bp, Artificial Sequence
  Synthetic
tccagccgtccgcgtatcc

SEQ ID NO: 36578 - DNA, 20 bp, Artificial Sequence
  Synthetic
cgtcgaagcgggcaacattg

SEQ ID NO: 36579 - DNA, 20 bp, Artificial Sequence
  Synthetic
tgctctgcccctgtttcagg

SEQ ID NO: 36580 - DNA, 18 bp, Artificial Sequence
  Synthetic
accagcttgccgccgaat

SEQ ID NO: 36581 - DNA, 21 bp, Artificial Sequence
  Synthetic
gacggctacgggctgaatcag

SEQ ID NO: 36582 - DNA, 20 bp, Artificial Sequence
  Synthetic
gccgtaccgctgaccttcct

SEQ ID NO: 36583 - DNA, 20 bp, Artificial Sequence
  Synthetic
tggcaaccttcaacagccgc

SEQ ID NO: 36584 - DNA, 18 bp, Artificial Sequence
  Synthetic
cgtgatgcccacccgcaa

SEQ ID NO: 36585 - DNA, 21 bp, Artificial Sequence
  Synthetic
aaaagccctcttcaatgacgg

SEQ ID NO: 36586 - DNA, 20 bp, Artificial Sequence
  Synthetic
gaaaggactcgatttgcgcc

SEQ ID NO: 36587 - DNA, 21 bp, Artificial Sequence
  Synthetic
tggcaatccaaaactcacgat

SEQ ID NO: 36588 - DNA, 19 bp, Artificial Sequence
  Synthetic
cagccagaagtcgtcggca

SEQ ID NO: 36589 - DNA, 19 bp, Artificial Sequence
  Synthetic
accggcctcacaccgtcca

SEQ ID NO: 36590 - DNA, 20 bp, Artificial Sequence
  Synthetic
atcaggcaacccagtgcctc

SEQ ID NO: 36591 - DNA, 19 bp, Artificial Sequence
  Synthetic
aacctaccccggcggcatg

SEQ ID NO: 36592 - DNA, 20 bp, Artificial Sequence
  Synthetic
tcctgcttcagacggcattt

SEQ ID NO: 36593 - DNA, 24 bp, Artificial Sequence
  Synthetic
aaagcattatgccaaatctgcaaa

SEQ ID NO: 36594 - DNA, 19 bp, Artificial Sequence
  Synthetic
tcaacaccggcagcgcagg

SEQ ID NO: 36595 - DNA, 22 bp, Artificial Sequence
  Synthetic
gcgcagatacgccaatgcttcc

SEQ ID NO: 36596 - DNA, 18 bp, Artificial Sequence
  Synthetic
accggcaggcgcaaaacc

SEQ ID NO: 36597 - DNA, 21 bp, Artificial Sequence
  Synthetic
ccgcttcttgattttccgccg

SEQ ID NO: 36598 - DNA, 21 bp, Artificial Sequence
  Synthetic
gtaatcgcgccggtttaacgc

SEQ ID NO: 36599 - DNA, 20 bp, Artificial Sequence
  Synthetic
ccccaaagtttgcggccgta

SEQ ID NO: 36600 - DNA, 21 bp, Artificial Sequence
  Synthetic
cgaggttgaagacatggccgc

SEQ ID NO: 36601 - DNA, 18 bp, Artificial Sequence
  Synthetic
gcgtttttcggctcgggc

SEQ ID NO: 36602 - DNA, 18 bp, Artificial Sequence
  Synthetic
cgccgtttccgtccgcta

SEQ ID NO: 36603 - DNA, 21 bp, Artificial Sequence
  Synthetic
cgatgctcaaacgcaactggc

SEQ ID NO: 36604 - DNA, 22 bp, Artificial Sequence
  Synthetic
aggcgatgaaacaatccgcgaa

SEQ ID NO: 36605 - DNA, 18 bp, Artificial Sequence
  Synthetic
cgccttcatgctgccggt

SEQ ID NO: 36606 - DNA, 19 bp, Artificial Sequence
  Synthetic
tatcgccctgagtgccgcc

SEQ ID NO: 36607 - DNA, 21 bp, Artificial Sequence
  Synthetic
ggattgtgttccttcggcggt

SEQ ID NO: 36608 - DNA, 19 bp, Artificial Sequence
  Synthetic
tcgacatcctgcggctggg

SEQ ID NO: 36609 - DNA, 22 bp, Artificial Sequence
  Synthetic
gcctgacttcggacgacatcaa

SEQ ID NO: 36610 - DNA, 19 bp, Artificial Sequence
  Synthetic
tcaaactcgccgccggctg

SEQ ID NO: 36611 - DNA, 20 bp, Artificial Sequence
  Synthetic
gcccgagttcgaccgcgata

SEQ ID NO: 36612 - DNA, 22 bp, Artificial Sequence
  Synthetic
cgaaactgaatcccgttgccgg

SEQ ID NO: 36613 - DNA, 21 bp, Artificial Sequence
  Synthetic
atccttcgtgcaggataccgc

SEQ ID NO: 36614 - DNA, 18 bp, Artificial Sequence
  Synthetic
cttcgcgggcttggtcga

SEQ ID NO: 36615 - DNA, 19 bp, Artificial Sequence
  Synthetic
acgaaatggcgcacgtcgg

SEQ ID NO: 36616 - DNA, 22 bp, Artificial Sequence
  Synthetic
gtgtcataatgcggcgttggtc

SEQ ID NO: 36617 - DNA, 20 bp, Artificial Sequence
  Synthetic
cgtaaaccgccgcactggag

SEQ ID NO: 36618 - DNA, 19 bp, Artificial Sequence
  Synthetic
aagccgccgccgaactctc

SEQ ID NO: 36619 - DNA, 22 bp, Artificial Sequence
  Synthetic
ggcgatggtgcatacccaatcg

SEQ ID NO: 36620 - DNA, 22 bp, Artificial Sequence
  Synthetic
ggcgcggatttggtctttgtca

SEQ ID NO: 36621 - DNA, 22 bp, Artificial Sequence
  Synthetic
ccgtttcaaaccttgcgacacg

SEQ ID NO: 36622 - DNA, 19 bp, Artificial Sequence
  Synthetic
aacaatgccgaccacgcct

SEQ ID NO: 36623 - DNA, 19 bp, Artificial Sequence
  Synthetic
aacgtggcaggcgaggttt

SEQ ID NO: 36624 - DNA, 19 bp, Artificial Sequence
  Synthetic
tccggcttttccttcggcg

SEQ ID NO: 36625 - DNA, 20 bp, Artificial Sequence
  Synthetic
tcgtttccgccatccacacg

SEQ ID NO: 36626 - DNA, 22 bp, Artificial Sequence
  Synthetic
cccaacagcgtaaacaccctgt

SEQ ID NO: 36627 - DNA, 22 bp, Artificial Sequence
  Synthetic
cgcaaagaattacgcacctggc

SEQ ID NO: 36628 - DNA, 19 bp, Artificial Sequence
  Synthetic
acgccggcactcttgaccg

SEQ ID NO: 36629 - DNA, 20 bp, Artificial Sequence
  Synthetic
ttgtcgccgaaagccaacat

SEQ ID NO: 36630 - DNA, 21 bp, Artificial Sequence
  Synthetic
acaacgccgtttttgccttcg

SEQ ID NO: 36631 - DNA, 19 bp, Artificial Sequence
  Synthetic
gccgcagataaccccgacg

SEQ ID NO: 36632 - DNA, 20 bp, Artificial Sequence
  Synthetic
gcgcgtgtcgttcagcactt

SEQ ID NO: 36633 - DNA, 21 bp, Artificial Sequence
  Synthetic
ccaattcgtcggccgccttag

SEQ ID NO: 36634 - DNA, 19 bp, Artificial Sequence
  Synthetic
tcacgcgcattcccctgcc

SEQ ID NO: 36635 - DNA, 22 bp, Artificial Sequence
  Synthetic
gctttgggaatcaggcgcacat

SEQ ID NO: 36636 - DNA, 22 bp, Artificial Sequence
  Synthetic
ccgatgccgaacgaaatacgga

SEQ ID NO: 36637 - DNA, 19 bp, Artificial Sequence
  Synthetic
tatgggcagggcgggttgc

SEQ ID NO: 36638 - DNA, 20 bp, Artificial Sequence
  Synthetic
tggagaaacggccatacagc

SEQ ID NO: 36639 - DNA, 19 bp, Artificial Sequence
  Synthetic
atgatgatgcagccgccga

SEQ ID NO: 36640 - DNA, 22 bp, Artificial Sequence
  Synthetic
cgccaaaatccaagccgtttgc

SEQ ID NO: 36641 - DNA, 18 bp, Artificial Sequence
  Synthetic
gcgtgcgttgccgaaagc

SEQ ID NO: 36642 - DNA, 20 bp, Artificial Sequence
  Synthetic
tttcaatcgccgttcccgcc

SEQ ID NO: 36643 - DNA, 19 bp, Artificial Sequence
  Synthetic
gcaggttcggcagcttcgg

SEQ ID NO: 36644 - DNA, 19 bp, Artificial Sequence
  Synthetic
cgccgacacgccgtcaatg

SEQ ID NO: 36645 - DNA, 21 bp, Artificial Sequence
  Synthetic
accatactcatgcgcgatgcc

SEQ ID NO: 36646 - DNA, 19 bp, Artificial Sequence
  Synthetic
cgtccatcacggcggcaaa

SEQ ID NO: 36647 - DNA, 22 bp, Artificial Sequence
  Synthetic
ccgcaaacttaatcacgccctg

SEQ ID NO: 36648 - DNA, 18 bp, Artificial Sequence
  Synthetic
attgccgtccgccgtcga

SEQ ID NO: 36649 - DNA, 19 bp, Artificial Sequence
  Synthetic
ttccacactgctcggcgcg

SEQ ID NO: 36650 - DNA, 18 bp, Artificial Sequence
  Synthetic
cccgagcgaggcgacatt

SEQ ID NO: 36651 - DNA, 19 bp, Artificial Sequence
  Synthetic
cccgacattgcccaggctt

SEQ ID NO: 36652 - DNA, 22 bp, Artificial Sequence
  Synthetic
cctgactgtatgccgggtcttg

SEQ ID NO: 36653 - DNA, 21 bp, Artificial Sequence
  Synthetic
gacatcattgccgccattgcc

SEQ ID NO: 36654 - DNA, 20 bp, Artificial Sequence
  Synthetic
ggttcggtgatgcggggcta

SEQ ID NO: 36655 - DNA, 20 bp, Artificial Sequence
  Synthetic
cggggcttttgctgcctttg

SEQ ID NO: 36656 - DNA, 19 bp, Artificial Sequence
  Synthetic
atcggcctgtgttcggcgg

SEQ ID NO: 36657 - DNA, 20 bp, Artificial Sequence
  Synthetic
acaccaataggcgctttccc

SEQ ID NO: 36658 - DNA, 21 bp, Artificial Sequence
  Synthetic
gtccctttggcttcaatcaca

SEQ ID NO: 36659 - DNA, 19 bp, Artificial Sequence
  Synthetic
atcgggggcaggtcaaacg

SEQ ID NO: 36660 - DNA, 19 bp, Artificial Sequence
  Synthetic
cccccttatgacgctgccg

SEQ ID NO: 36661 - DNA, 19 bp, Artificial Sequence
  Synthetic
aaaccgaccgctggctggc

SEQ ID NO: 36662 - DNA, 18 bp, Artificial Sequence
  Synthetic
ctggtggcgggtgctgtt

SEQ ID NO: 36663 - DNA, 21 bp, Artificial Sequence
  Synthetic
ggccgctacgacatcgtcaat

SEQ ID NO: 36664 - DNA, 21 bp, Artificial Sequence
  Synthetic
cctcgtcaaaatcaggatcgg

SEQ ID NO: 36665 - DNA, 22 bp, Artificial Sequence
  Synthetic
gcgaatccatcggtatggctgc

SEQ ID NO: 36666 - DNA, 20 bp, Artificial Sequence
  Synthetic
gcaacacgaagacggccaca

SEQ ID NO: 36667 - DNA, 20 bp, Artificial Sequence
  Synthetic
agcatcggcgtttcagacgg

SEQ ID NO: 36668 - DNA, 20 bp, Artificial Sequence
  Synthetic
cgagcgtggcgatgatgtcg

SEQ ID NO: 36669 - DNA, 22 bp, Artificial Sequence
  Synthetic
ccttctttgtcggcatcgagga

SEQ ID NO: 36670 - DNA, 19 bp, Artificial Sequence
  Synthetic
aacacaccgcctccgccac

SEQ ID NO: 36671 - DNA, 20 bp, Artificial Sequence
  Synthetic
gcggcaatggaggaagcagc

SEQ ID NO: 36672 - DNA, 19 bp, Artificial Sequence
  Synthetic
ggcgcgctgatgaccgaag

SEQ ID NO: 36673 - DNA, 21 bp, Artificial Sequence
  Synthetic
ggtaacggaaccgaacaggcg

SEQ ID NO: 36674 - DNA, 19 bp, Artificial Sequence
  Synthetic
tcatccggccttgcctggc

SEQ ID NO: 36675 - DNA, 18 bp, Artificial Sequence
  Synthetic
tcagcttcggcgttgccc

SEQ ID NO: 36676 - DNA, 22 bp, Artificial Sequence
  Synthetic
ccgcccagcacaaaatactcca

SEQ ID NO: 36677 - DNA, 22 bp, Artificial Sequence
  Synthetic
catgccgtctgaaacccaaacc

SEQ ID NO: 36678 - DNA, 22 bp, Artificial Sequence
  Synthetic
gcatgagcattgccgacatcaa

SEQ ID NO: 36679 - DNA, 18 bp, Artificial Sequence
  Synthetic
ttgcgcgacttggggcag

SEQ ID NO: 36680 - DNA, 19 bp, Artificial Sequence
  Synthetic
tcctcggcgaagggcagtc

SEQ ID NO: 36681 - DNA, 19 bp, Artificial Sequence
  Synthetic
agcggcgcgtggaacaagg

SEQ ID NO: 36682 - DNA, 19 bp, Artificial Sequence
  Synthetic
atgcagaagctgccgcccg

SEQ ID NO: 36683 - DNA, 21 bp, Artificial Sequence
  Synthetic
caaacactacggctcgctggt

SEQ ID NO: 36684 - DNA, 20 bp, Artificial Sequence
  Synthetic
gccgcagcagcatccgtatg

SEQ ID NO: 36685 - DNA, 22 bp, Artificial Sequence
  Synthetic
cctgctggaagccgattcttcc

SEQ ID NO: 36686 - DNA, 19 bp, Artificial Sequence
  Synthetic
caacatcccgccgcacaac

SEQ ID NO: 36687 - DNA, 19 bp, Artificial Sequence
  Synthetic
ccctgcgcatcaccttcgg

SEQ ID NO: 36688 - DNA, 20 bp, Artificial Sequence
  Synthetic
gccgacaaagcctacaccgc

SEQ ID NO: 36689 - DNA, 20 bp, Artificial Sequence
  Synthetic
ggttggcaacgatttcggcg

SEQ ID NO: 36690 - DNA, 19 bp, Artificial Sequence
  Synthetic
acggggctgtcttggttgc

SEQ ID NO: 36691 - DNA, 21 bp, Artificial Sequence
  Synthetic
agctgaccgcctttgtcgaag

SEQ ID NO: 36692 - DNA, 21 bp, Artificial Sequence
  Synthetic
gcaagtcttcgatgctgccgc

SEQ ID NO: 36693 - DNA, 21 bp, Artificial Sequence
  Synthetic
gcaagaatgcgccccgtatgc

SEQ ID NO: 36694 - DNA, 18 bp, Artificial Sequence
  Synthetic
aagccgaccgcgtgttgg

SEQ ID NO: 36695 - DNA, 22 bp, Artificial Sequence
  Synthetic
acaagacctgccggaaaatcca

SEQ ID NO: 36696 - DNA, 21 bp, Artificial Sequence
  Synthetic
gcgcgatttggtgcccgaatt

SEQ ID NO: 36697 - DNA, 21 bp, Artificial Sequence
  Synthetic
ggacaaattgcacagggttct

SEQ ID NO: 36698 - DNA, 20 bp, Artificial Sequence
  Synthetic
cggtcaaacgcagcggcata

SEQ ID NO: 36699 - DNA, 19 bp, Artificial Sequence
  Synthetic
acacggcatcggcacttcc

SEQ ID NO: 36700 - DNA, 22 bp, Artificial Sequence
  Synthetic
gggcagggattggttttgggta

SEQ ID NO: 36701 - DNA, 20 bp, Artificial Sequence
  Synthetic
cggattggacttcgggcagg

SEQ ID NO: 36702 - DNA, 19 bp, Artificial Sequence
  Synthetic
tgatggcggcggcaatcgg

SEQ ID NO: 36703 - DNA, 22 bp, Artificial Sequence
  Synthetic
ccacagcaacatagaatgcggc

SEQ ID NO: 36704 - DNA, 21 bp, Artificial Sequence
  Synthetic
cggcgagaaattcggtggtca

SEQ ID NO: 36705 - DNA, 20 bp, Artificial Sequence
  Synthetic
gtatgccttgtagcccgcgt

SEQ ID NO: 36706 - DNA, 18 bp, Artificial Sequence
  Synthetic
ccgaaagcggcgtcgtca

SEQ ID NO: 36707 - DNA, 22 bp, Artificial Sequence
  Synthetic
cgaaatcatcaacgacgacggc

SEQ ID NO: 36708 - DNA, 23 bp, Artificial Sequence
  Synthetic
gggtttgatgataggtttcgctt

SEQ ID NO: 36709 - DNA, 19 bp, Artificial Sequence
  Synthetic
tgggctattacggccgcgc

SEQ ID NO: 36710 - DNA, 20 bp, Artificial Sequence
  Synthetic
ttgcacgccgatttcgtggg

SEQ ID NO: 36711 - DNA, 20 bp, Artificial Sequence
  Synthetic
ccgaagtcgttggcggcaaa

SEQ ID NO: 36712 - DNA, 19 bp, Artificial Sequence
  Synthetic
gaaccaacaaggctgcggc

SEQ ID NO: 36713 - DNA, 19 bp, Artificial Sequence
  Synthetic
gcccgcgtccatccacatg

SEQ ID NO: 36714 - DNA, 19 bp, Artificial Sequence
  Synthetic
tgaacgcggcgagttggaa

SEQ ID NO: 36715 - DNA, 22 bp, Artificial Sequence
  Synthetic
agtgcatattgaggcgcggatg

SEQ ID NO: 36716 - DNA, 21 bp, Artificial Sequence
  Synthetic
ctgcgtttttcaagcgaggca

SEQ ID NO: 36717 - DNA, 21 bp, Artificial Sequence
  Synthetic
cgggaatccggaacccaaacg

SEQ ID NO: 36718 - DNA, 20 bp, Artificial Sequence
  Synthetic
tcaaggctggcgcaaggttt

SEQ ID NO: 36719 - DNA, 19 bp, Artificial Sequence
  Synthetic
tcgcccacatcgcccaatc

SEQ ID NO: 36720 - DNA, 19 bp, Artificial Sequence
  Synthetic
gcggcgtgggcaaaaccac

SEQ ID NO: 36721 - DNA, 18 bp, Artificial Sequence
  Synthetic
cgacacacgcgccaacct

SEQ ID NO: 36722 - DNA, 21 bp, Artificial Sequence
  Synthetic
gcaggcataccgcgacgtatt

SEQ ID NO: 36723 - DNA, 18 bp, Artificial Sequence
  Synthetic
aatgctgccactgccggg

SEQ ID NO: 36724 - DNA, 19 bp, Artificial Sequence
  Synthetic
gcggctggcacaaatcgcc

SEQ ID NO: 36725 - DNA, 20 bp, Artificial Sequence
  Synthetic
acgacgaagcggacgcattg

SEQ ID NO: 36726 - DNA, 19 bp, Artificial Sequence
  Synthetic
acgggcaaggcagccgatg

SEQ ID NO: 36727 - DNA, 22 bp, Artificial Sequence
  Synthetic
cgatgcggttttcactttcggc

SEQ ID NO: 36728 - DNA, 20 bp, Artificial Sequence
  Synthetic
gcttcaaccgccctgctctc

SEQ ID NO: 36729 - DNA, 21 bp, Artificial Sequence
  Synthetic
tgtctatccaaccggtgacag

SEQ ID NO: 36730 - DNA, 20 bp, Artificial Sequence
  Synthetic
ccggaatttcaggttgctgc

SEQ ID NO: 36731 - DNA, 20 bp, Artificial Sequence
  Synthetic
gaggatgagccgaaagaagc

SEQ ID NO: 36732 - DNA, 19 bp, Artificial Sequence
  Synthetic
ttcggctccaacaccgccc

SEQ ID NO: 36733 - DNA, 22 bp, Artificial Sequence
  Synthetic
ccgatgacttggatgtgcggat

SEQ ID NO: 36734 - DNA, 20 bp, Artificial Sequence
  Synthetic
gcctttgagggcttcggcaa

SEQ ID NO: 36735 - DNA, 21 bp, Artificial Sequence
  Synthetic
tcggaaaccgtctgccttgtc

SEQ ID NO: 36736 - DNA, 21 bp, Artificial Sequence
  Synthetic
gcttcctcatcggcggtgtac

SEQ ID NO: 36737 - DNA, 18 bp, Artificial Sequence
  Synthetic
ttacgcgcgggtatgggc

SEQ ID NO: 36738 - DNA, 19 bp, Artificial Sequence
  Synthetic
tgaccgatgccgtcaacgc

SEQ ID NO: 36739 - DNA, 19 bp, Artificial Sequence
  Synthetic
cgcgcgcaggactttacca

SEQ ID NO: 36740 - DNA, 18 bp, Artificial Sequence
  Synthetic
acgggctggacaacgcct

SEQ ID NO: 36741 - DNA, 21 bp, Artificial Sequence
  Synthetic
cggcttcgcggtaggtttcac

SEQ ID NO: 36742 - DNA, 22 bp, Artificial Sequence
  Synthetic
ccgttgacgaggacttttccgt

SEQ ID NO: 36743 - DNA, 20 bp, Artificial Sequence
  Synthetic
gccggtcagtgaaacggcag

SEQ ID NO: 36744 - DNA, 21 bp, Artificial Sequence
  Synthetic
aaggggaaaaaaccggcagga

SEQ ID NO: 36745 - DNA, 19 bp, Artificial Sequence
  Synthetic
tgccgctgcggagtacgac

SEQ ID NO: 36746 - DNA, 19 bp, Artificial Sequence
  Synthetic
gacctgcttctgcctccgc

SEQ ID NO: 36747 - DNA, 21 bp, Artificial Sequence
  Synthetic
gccttatgttgccgacagcgt

SEQ ID NO: 36748 - DNA, 20 bp, Artificial Sequence
  Synthetic
agtgcttcgggcagttggtt

SEQ ID NO: 36749 - DNA, 20 bp, Artificial Sequence
  Synthetic
atcgggcgtttagtttccgt

SEQ ID NO: 36750 - DNA, 20 bp, Artificial Sequence
  Synthetic
cgttcgtagctgtcgggctg

SEQ ID NO: 36751 - DNA, 20 bp, Artificial Sequence
  Synthetic
ccgaatgcagtaagtcggca

SEQ ID NO: 36752 - DNA, 20 bp, Artificial Sequence
  Synthetic
aatatttcgggcgcgggggc

SEQ ID NO: 36753 - DNA, 21 bp, Artificial Sequence
  Synthetic
taaggagcgcggtgttttggc

SEQ ID NO: 36754 - DNA, 22 bp, Artificial Sequence
  Synthetic
cgatttgtccgaaaacgccgaa

SEQ ID NO: 36755 - DNA, 18 bp, Artificial Sequence
  Synthetic
tgcatacgaggcacgccg

SEQ ID NO: 36756 - DNA, 20 bp, Artificial Sequence
  Synthetic
ggctcgcaggaactcatgct

SEQ ID NO: 36757 - DNA, 22 bp, Artificial Sequence
  Synthetic
ccgcgttaccctcgacaaacac

SEQ ID NO: 36758 - DNA, 18 bp, Artificial Sequence
  Synthetic
ccacgcgcatcatccgca

SEQ ID NO: 36759 - DNA, 21 bp, Artificial Sequence
  Synthetic
gaaacgtttcggctaccgcac

SEQ ID NO: 36760 - DNA, 21 bp, Artificial Sequence
  Synthetic
acagcatcgtcgtcaacggag

SEQ ID NO: 36761 - DNA, 22 bp, Artificial Sequence
  Synthetic
gacatgtggcaacaggcaggca

SEQ ID NO: 36762 - DNA, 19 bp, Artificial Sequence
  Synthetic
agacgatgcctgccgtgcc

SEQ ID NO: 36763 - DNA, 20 bp, Artificial Sequence
  Synthetic
ggaaagggcgatggcttcga

SEQ ID NO: 36764 - DNA, 21 bp, Artificial Sequence
  Synthetic
gcggctacggtaataacgccg

SEQ ID NO: 36765 - DNA, 20 bp, Artificial Sequence
  Synthetic
attgtaggctgcggtcagat

SEQ ID NO: 36766 - DNA, 20 bp, Artificial Sequence
  Synthetic
gcaggagcatcccgatccgc

SEQ ID NO: 36767 - DNA, 22 bp, Artificial Sequence
  Synthetic
caaacacctgctggttgccaat

SEQ ID NO: 36768 - DNA, 21 bp, Artificial Sequence
  Synthetic
ccgtagagtctggcgatgccg

SEQ ID NO: 36769 - DNA, 19 bp, Artificial Sequence
  Synthetic
agcgcgtccaaaccctgcg

SEQ ID NO: 36770 - DNA, 19 bp, Artificial Sequence
  Synthetic
cgagcagggtgcggatgac

SEQ ID NO: 36771 - DNA, 22 bp, Artificial Sequence
  Synthetic
cggtattcgtgcacccagcttt

SEQ ID NO: 36772 - DNA, 20 bp, Artificial Sequence
  Synthetic
gagagcttggcgacggactg

SEQ ID NO: 36773 - DNA, 20 bp, Artificial Sequence
  Synthetic
ttgcggtttgtcggtttgcg

SEQ ID NO: 36774 - DNA, 21 bp, Artificial Sequence
  Synthetic
gcggcttggtaaaggtaggcg

SEQ ID NO: 36775 - DNA, 19 bp, Artificial Sequence
  Synthetic
gggggccagcagtatcagc

SEQ ID NO: 36776 - DNA, 22 bp, Artificial Sequence
  Synthetic
ccgccgatgtgttgattttggg

SEQ ID NO: 36777 - DNA, 21 bp, Artificial Sequence
  Synthetic
ggtaccggttcgaccatcaat

SEQ ID NO: 36778 - DNA, 18 bp, Artificial Sequence
  Synthetic
tacacgatgccgcccgct

SEQ ID NO: 36779 - DNA, 20 bp, Artificial Sequence
  Synthetic
cgtgcctgttgttgtgtact

SEQ ID NO: 36780 - DNA, 20 bp, Artificial Sequence
  Synthetic
attgtgatgatgcgcgtggt

SEQ ID NO: 36781 - DNA, 22 bp, Artificial Sequence
  Synthetic
tgtccggtattgagcgcggata

SEQ ID NO: 36782 - DNA, 22 bp, Artificial Sequence
  Synthetic
cattgcgtgaaacataatccgc

SEQ ID NO: 36783 - DNA, 20 bp, Artificial Sequence
  Synthetic
cggcaaaggcagcggttgaa

SEQ ID NO: 36784 - DNA, 20 bp, Artificial Sequence
  Synthetic
gggttagggagagggcattg

SEQ ID NO: 36785 - DNA, 20 bp, Artificial Sequence
  Synthetic
tccgcaaatcaaagccgact

SEQ ID NO: 36786 - DNA, 21 bp, Artificial Sequence
  Synthetic
ggcgaccagggttttgccttc

SEQ ID NO: 36787 - DNA, 18 bp, Artificial Sequence
  Synthetic
aggcactgcatgagcggg

SEQ ID NO: 36788 - DNA, 22 bp, Artificial Sequence
  Synthetic
cggatggcgcgcaaaaaaagac

SEQ ID NO: 36789 - DNA, 20 bp, Artificial Sequence
  Synthetic
gcctcattgggcatgcgcta

SEQ ID NO: 36790 - DNA, 19 bp, Artificial Sequence
  Synthetic
acccttgcggacggaagcc

SEQ ID NO: 36791 - DNA, 22 bp, Artificial Sequence
  Synthetic
catagcttccggtttggtttct

SEQ ID NO: 36792 - DNA, 22 bp, Artificial Sequence
  Synthetic
ccggtttattcgcctcctgctt

SEQ ID NO: 36793 - DNA, 20 bp, Artificial Sequence
  Synthetic
acctgctgtcccaactgctg

SEQ ID NO: 36794 - DNA, 20 bp, Artificial Sequence
  Synthetic
caccgatgtcctgagccgtc

SEQ ID NO: 36795 - DNA, 19 bp, Artificial Sequence
  Synthetic
agtccgtgccgcattgccg

SEQ ID NO: 36796 - DNA, 20 bp, Artificial Sequence
  Synthetic
gcagacccgtaccgttgtgg

SEQ ID NO: 36797 - DNA, 22 bp, Artificial Sequence
  Synthetic
cccaatgaggcttcgtgggttt

SEQ ID NO: 36798 - DNA, 20 bp, Artificial Sequence
  Synthetic
atctagattcccgcctgcgc

SEQ ID NO: 36799 - DNA, 19 bp, Artificial Sequence
  Synthetic
tcgagccagaacacggcgg

SEQ ID NO: 36800 - DNA, 22 bp, Artificial Sequence
  Synthetic
ggaattcgcccaatgagtccca

SEQ ID NO: 36801 - DNA, 22 bp, Artificial Sequence
  Synthetic
caatgcgtggacgtaggcgacg

SEQ ID NO: 36802 - DNA, 19 bp, Artificial Sequence
  Synthetic
aaggcgggcgcttcggaac

SEQ ID NO: 36803 - DNA, 20 bp, Artificial Sequence
  Synthetic
tgttggccaagggcttcagc

SEQ ID NO: 36804 - DNA, 22 bp, Artificial Sequence
  Synthetic
gcgaaaaaggcgacgtatgacg

SEQ ID NO: 36805 - DNA, 19 bp, Artificial Sequence
  Synthetic
tggggttatgccggtgcgg

SEQ ID NO: 36806 - DNA, 18 bp, Artificial Sequence
  Synthetic
atccgaagccgcgatgcg

SEQ ID NO: 36807 - DNA, 18 bp, Artificial Sequence
  Synthetic
tccccttggcgcgtttcg

SEQ ID NO: 36808 - DNA, 21 bp, Artificial Sequence
  Synthetic
gttgtcagggaatggggcagg

SEQ ID NO: 36809 - DNA, 19 bp, Artificial Sequence
  Synthetic
tggtttgacggcaggacgg

SEQ ID NO: 36810 - DNA, 21 bp, Artificial Sequence
  Synthetic
cgcctaagaaacggatggcgg

SEQ ID NO: 36811 - DNA, 20 bp, Artificial Sequence
  Synthetic
gcgcaacatccggaatcggc

SEQ ID NO: 36812 - DNA, 19 bp, Artificial Sequence
  Synthetic
tgggtgcgatgagcgaggc

SEQ ID NO: 36813 - DNA, 19 bp, Artificial Sequence
  Synthetic
agactgcctgcgcgacaaa

SEQ ID NO: 36814 - DNA, 19 bp, Artificial Sequence
  Synthetic
gcgggcgtgtgcaatgaca

SEQ ID NO: 36815 - DNA, 20 bp, Artificial Sequence
  Synthetic
gccccgcggttcagaaactg

SEQ ID NO: 36816 - DNA, 19 bp, Artificial Sequence
  Synthetic
tttcaggcggcgggcttcc

SEQ ID NO: 36817 - DNA, 22 bp, Artificial Sequence
  Synthetic
gcctttgtccgcaacaagcatt

SEQ ID NO: 36818 - DNA, 20 bp, Artificial Sequence
  Synthetic
ctcgagaacagcgcgtcgcc

SEQ ID NO: 36819 - DNA, 19 bp, Artificial Sequence
  Synthetic
caaacaacccggaccccga

SEQ ID NO: 36820 - DNA, 22 bp, Artificial Sequence
  Synthetic
gaaacacggcgcggatatttcc

SEQ ID NO: 36821 - DNA, 21 bp, Artificial Sequence
  Synthetic
accggataccgcgaacacaat

SEQ ID NO: 36822 - DNA, 20 bp, Artificial Sequence
  Synthetic
cgtctttggcggcgggattt

SEQ ID NO: 36823 - DNA, 19 bp, Artificial Sequence
  Synthetic
caagtgtaggcgcggcgta

SEQ ID NO: 36824 - DNA, 21 bp, Artificial Sequence
  Synthetic
gacgcggctttttcctgcaat

SEQ ID NO: 36825 - DNA, 20 bp, Artificial Sequence
  Synthetic
ggcagtctatcaggccggca

SEQ ID NO: 36826 - DNA, 19 bp, Artificial Sequence
  Synthetic
cgggattgcctttgcacgc

SEQ ID NO: 36827 - DNA, 22 bp, Artificial Sequence
  Synthetic
ggtgtaccggttgtaacgccag

SEQ ID NO: 36828 - DNA, 19 bp, Artificial Sequence
  Synthetic
taaaggcggacgcggtcgc

SEQ ID NO: 36829 - DNA, 19 bp, Artificial Sequence
  Synthetic
acgggcgaacgttcggacg

SEQ ID NO: 36830 - DNA, 20 bp, Artificial Sequence
  Synthetic
ggtcgatgacttcctgcgcg

SEQ ID NO: 36831 - DNA, 19 bp, Artificial Sequence
  Synthetic
tcacccgcgccgagtacgt

SEQ ID NO: 36832 - DNA, 19 bp, Artificial Sequence
  Synthetic
tgcccgggcttcttcacgc

SEQ ID NO: 36833 - DNA, 19 bp, Artificial Sequence
  Synthetic
gtggtagccggtgccgtag

SEQ ID NO: 36834 - DNA, 18 bp, Artificial Sequence
  Synthetic
gtcgcctgcggttttggc

SEQ ID NO: 36835 - DNA, 19 bp, Artificial Sequence
  Synthetic
gccgataaaggcgcggtcg

SEQ ID NO: 36836 - DNA, 22 bp, Artificial Sequence
  Synthetic
gcaggcgtagtcttaggaggtg

SEQ ID NO: 36837 - DNA, 20 bp, Artificial Sequence
  Synthetic
gaagttgccgactacttcgc

SEQ ID NO: 36838 - DNA, 19 bp, Artificial Sequence
  Synthetic
cgatttggctggcaaggcg

SEQ ID NO: 36839 - DNA, 22 bp, Artificial Sequence
  Synthetic
ccgcctttgacgttgaaggaga

SEQ ID NO: 36840 - DNA, 22 bp, Artificial Sequence
  Synthetic
ggaaaagcggttgtcttcggca

SEQ ID NO: 36841 - DNA, 22 bp, Artificial Sequence
  Synthetic
ccgcgtggaaaaaaatcgtcca

SEQ ID NO: 36842 - DNA, 20 bp, Artificial Sequence
  Synthetic
ggacgcgaccgggaaattgc

SEQ ID NO: 36843 - DNA, 22 bp, Artificial Sequence
  Synthetic
ccctgatgcggtttgattcccg

SEQ ID NO: 36844 - DNA, 18 bp, Artificial Sequence
  Synthetic
aaaaaccgaccgcgccgc

SEQ ID NO: 36845 - DNA, 22 bp, Artificial Sequence
  Synthetic
cgggtttttcagcagctcaacc

SEQ ID NO: 36846 - DNA, 20 bp, Artificial Sequence
  Synthetic
aaacgggtgtggctgtcgcc

SEQ ID NO: 36847 - DNA, 19 bp, Artificial Sequence
  Synthetic
tgcgccgcactgttgtctt

SEQ ID NO: 36848 - DNA, 21 bp, Artificial Sequence
  Synthetic
cctcacatggttgagggtctt

SEQ ID NO: 36849 - DNA, 18 bp, Artificial Sequence
  Synthetic
tttggcgcctgcgtggac

SEQ ID NO: 36850 - DNA, 20 bp, Artificial Sequence
  Synthetic
gcgtatcggccgagcatcag

SEQ ID NO: 36851 - DNA, 19 bp, Artificial Sequence
  Synthetic
gcgggcgtttgacgacgac

SEQ ID NO: 36852 - DNA, 21 bp, Artificial Sequence
  Synthetic
cggcatgtggatggatcgata

SEQ ID NO: 36853 - DNA, 20 bp, Artificial Sequence
  Synthetic
gaagagggaaggggcggaac

SEQ ID NO: 36854 - DNA, 19 bp, Artificial Sequence
  Synthetic
gctttggaagtcgtgccgc

SEQ ID NO: 36855 - DNA, 22 bp, Artificial Sequence
  Synthetic
tggattacggggatgtgggtca

SEQ ID NO: 36856 - DNA, 19 bp, Artificial Sequence
  Synthetic
gcattgacacgcgaaccgc

SEQ ID NO: 36857 - DNA, 19 bp, Artificial Sequence
  Synthetic
cgtctgctccggctgaaca

SEQ ID NO: 36858 - DNA, 20 bp, Artificial Sequence
  Synthetic
gtttggtttccgccgcaacg

SEQ ID NO: 36859 - DNA, 18 bp, Artificial Sequence
  Synthetic
ccgtgggatgccgccaaa

SEQ ID NO: 36860 - DNA, 20 bp, Artificial Sequence
  Synthetic
tggctggataagggcgttgc

SEQ ID NO: 36861 - DNA, 22 bp, Artificial Sequence
  Synthetic
gatggaaaataggcgcaacggc

SEQ ID NO: 36862 - DNA, 18 bp, Artificial Sequence
  Synthetic
accgcttttcctgccgcg

SEQ ID NO: 36863 - DNA, 22 bp, Artificial Sequence
  Synthetic
gctcctagtacgagaggaccgg

SEQ ID NO: 36864 - DNA, 21 bp, Artificial Sequence
  Synthetic
ggcaagcctttcaacaatccg

SEQ ID NO: 36865 - DNA, 21 bp, Artificial Sequence
  Synthetic
aacagacggcatcagaagcgt

SEQ ID NO: 36866 - DNA, 20 bp, Artificial Sequence
  Synthetic
ccatttttcgcgcacggtca

SEQ ID NO: 36867 - DNA, 19 bp, Artificial Sequence
  Synthetic
cgcagggggattcggcact

SEQ ID NO: 36868 - DNA, 20 bp, Artificial Sequence
  Synthetic
gtatcgctgcggatgaggcc

SEQ ID NO: 36869 - DNA, 18 bp, Artificial Sequence
  Synthetic
agcaacgccgcttcgtcg

SEQ ID NO: 36870 - DNA, 19 bp, Artificial Sequence
  Synthetic
aaagacgcgcccgccacag

SEQ ID NO: 36871 - DNA, 19 bp, Artificial Sequence
  Synthetic
tatgccccggtgcgaacgg

SEQ ID NO: 36872 - DNA, 20 bp, Artificial Sequence
  Synthetic
cagggaaggaaaccgtcggc

SEQ ID NO: 36873 - DNA, 20 bp, Artificial Sequence
  Synthetic
gccggttatatctgcggcgg

SEQ ID NO: 36874 - DNA, 19 bp, Artificial Sequence
  Synthetic
cggtcggcgttgacggtaa

SEQ ID NO: 36875 - DNA, 21 bp, Artificial Sequence
  Synthetic
tacagactctgggcggctcgg

SEQ ID NO: 36876 - DNA, 19 bp, Artificial Sequence
  Synthetic
tgcgcggcaaagtgctcaa

SEQ ID NO: 36877 - DNA, 21 bp, Artificial Sequence
  Synthetic
gcctgcctattcgcccgaatc

SEQ ID NO: 36878 - DNA, 21 bp, Artificial Sequence
  Synthetic
cgaagcggacgagctcgaaga

SEQ ID NO: 36879 - DNA, 18 bp, Artificial Sequence
  Synthetic
acggcaatacctccgccg

SEQ ID NO: 36880 - DNA, 22 bp, Artificial Sequence
  Synthetic
gcacaatgtccgcatcccgaat

SEQ ID NO: 36881 - DNA, 20 bp, Artificial Sequence
  Synthetic
gggaagcgttgggcgtgaac

SEQ ID NO: 36882 - DNA, 21 bp, Artificial Sequence
  Synthetic
cgggtaacgcaggtttggtgc

SEQ ID NO: 36883 - DNA, 22 bp, Artificial Sequence
  Synthetic
agctgcaggctgaagatttccg

SEQ ID NO: 36884 - DNA, 18 bp, Artificial Sequence
  Synthetic
cacgcgcgcatttctgcc

SEQ ID NO: 36885 - DNA, 20 bp, Artificial Sequence
  Synthetic
cgatgtcttcgggcgcaagg

SEQ ID NO: 36886 - DNA, 20 bp, Artificial Sequence
  Synthetic
gggattgctttgccggtcgg

SEQ ID NO: 36887 - DNA, 20 bp, Artificial Sequence
  Synthetic
ttttcccgtccatccgcctg

SEQ ID NO: 36888 - DNA, 22 bp, Artificial Sequence
  Synthetic
gtgcggcatcttacgaactcga

SEQ ID NO: 36889 - DNA, 19 bp, Artificial Sequence
  Synthetic
cgcgaagaggcaaaaggcg

SEQ ID NO: 36890 - DNA, 19 bp, Artificial Sequence
  Synthetic
agcgcgctgagttcgtctt

SEQ ID NO: 36891 - DNA, 20 bp, Artificial Sequence
  Synthetic
ttagcgtgcaactgcctgcg

SEQ ID NO: 36892 - DNA, 20 bp, Artificial Sequence
  Synthetic
cgacgacgaccgctacctct

SEQ ID NO: 36893 - DNA, 21 bp, Artificial Sequence
  Synthetic
cgaggcaggctttttacgcgg

SEQ ID NO: 36894 - DNA, 19 bp, Artificial Sequence
  Synthetic
gcgttgccgggatttgccc

SEQ ID NO: 36895 - DNA, 19 bp, Artificial Sequence
  Synthetic
gctggatgctgcccgaagg

SEQ ID NO: 36896 - DNA, 20 bp, Artificial Sequence
  Synthetic
aaatcctcaaaggcggcggc

SEQ ID NO: 36897 - DNA, 20 bp, Artificial Sequence
  Synthetic
cttggagtcagttcccggcc

SEQ ID NO: 36898 - DNA, 21 bp, Artificial Sequence
  Synthetic
cgcatccacctgctgaatccc

SEQ ID NO: 36899 - DNA, 20 bp, Artificial Sequence
  Synthetic
ttgacgttccacgcgtgaaa

SEQ ID NO: 36900 - DNA, 20 bp, Artificial Sequence
  Synthetic
gcggattttgccgatggcct

SEQ ID NO: 36901 - DNA, 21 bp, Artificial Sequence
  Synthetic
gggcgcggatttcgatatcga

SEQ ID NO: 36902 - DNA, 22 bp, Artificial Sequence
  Synthetic
cgtaaccgtcgacgtattcggc

SEQ ID NO: 36903 - DNA, 22 bp, Artificial Sequence
  Synthetic
actccatcgacgcactgatacg

SEQ ID NO: 36904 - DNA, 21 bp, Artificial Sequence
  Synthetic
tgccggtcgcaatacctttga

SEQ ID NO: 36905 - DNA, 21 bp, Artificial Sequence
  Synthetic
aggcattacgctgcaacttgc

SEQ ID NO: 36906 - DNA, 20 bp, Artificial Sequence
  Synthetic
ggacgagggcgagaaagcgc

SEQ ID NO: 36907 - DNA, 21 bp, Artificial Sequence
  Synthetic
ccgatctgcctgccattctgc

SEQ ID NO: 36908 - DNA, 20 bp, Artificial Sequence
  Synthetic
gcggaggggacaaagatgcc

SEQ ID NO: 36909 - DNA, 18 bp, Artificial Sequence
  Synthetic
gcaggcgcacgcaggatt

SEQ ID NO: 36910 - DNA, 21 bp, Artificial Sequence
  Synthetic
gccctgatgaacggcggagaa

SEQ ID NO: 36911 - DNA, 20 bp, Artificial Sequence
  Synthetic
caggcgttggaaatggcgga

SEQ ID NO: 36912 - DNA, 20 bp, Artificial Sequence
  Synthetic
ccgctggacgatgccaacac

SEQ ID NO: 36913 - DNA, 18 bp, Artificial Sequence
  Synthetic
accgaacgcgctgccgat

SEQ ID NO: 36914 - DNA, 19 bp, Artificial Sequence
  Synthetic
tgcaacacacgtccgacgg

SEQ ID NO: 36915 - DNA, 19 bp, Artificial Sequence
  Synthetic
gcctctccggcggcatcaa

SEQ ID NO: 36916 - DNA, 19 bp, Artificial Sequence
  Synthetic
tggcaggcaaccgaccacg

SEQ ID NO: 36917 - DNA, 19 bp, Artificial Sequence
  Synthetic
ctggcgttgaagcagcagc

SEQ ID NO: 36918 - DNA, 21 bp, Artificial Sequence
  Synthetic
ggttggacacggtgttggagc

SEQ ID NO: 36919 - DNA, 19 bp, Artificial Sequence
  Synthetic
gaatgcggtcagcgtgtgc

SEQ ID NO: 36920 - DNA, 22 bp, Artificial Sequence
  Synthetic
gccgttttgttcctgctgaacc

SEQ ID NO: 36921 - DNA, 19 bp, Artificial Sequence
  Synthetic
cggcaagcgcgatatgggc

SEQ ID NO: 36922 - DNA, 20 bp, Artificial Sequence
  Synthetic
cggtttcgacatcacgccca

SEQ ID NO: 36923 - DNA, 21 bp, Artificial Sequence
  Synthetic
catcatccatccggcaggctc

SEQ ID NO: 36924 - DNA, 19 bp, Artificial Sequence
  Synthetic
gcgttcggcggcatcatcg

SEQ ID NO: 36925 - DNA, 22 bp, Artificial Sequence
  Synthetic
gtcgccatcgttaccgataccg

SEQ ID NO: 36926 - DNA, 21 bp, Artificial Sequence
  Synthetic
gctgaccgccattgtgttcgt

SEQ ID NO: 36927 - DNA, 19 bp, Artificial Sequence
  Synthetic
ttccgtcatcgccaccgcc

SEQ ID NO: 36928 - DNA, 22 bp, Artificial Sequence
  Synthetic
ccgccgatgcctgtatcaactt

SEQ ID NO: 36929 - DNA, 23 bp, Artificial Sequence
  Synthetic
caaatcaaacgcataagttcgct

SEQ ID NO: 36930 - DNA, 23 bp, Artificial Sequence
  Synthetic
ctcctaattcatctttgacggca

SEQ ID NO: 36931 - DNA, 20 bp, Artificial Sequence
  Synthetic
aacgtggcggcatcggattg

SEQ ID NO: 36932 - DNA, 20 bp, Artificial Sequence
  Synthetic
tgtgtttttaccgccacacg

SEQ ID NO: 36933 - DNA, 21 bp, Artificial Sequence
  Synthetic
agatgccgccgattatgatga

SEQ ID NO: 36934 - DNA, 21 bp, Artificial Sequence
  Synthetic
gcaataacgcttcggtcggta

SEQ ID NO: 36935 - DNA, 21 bp, Artificial Sequence
  Synthetic
gcttcaaacatttcacgcgaa

SEQ ID NO: 36936 - DNA, 20 bp, Artificial Sequence
  Synthetic
aatggcgcgaaaaggctaaa

SEQ ID NO: 36937 - DNA, 22 bp, Artificial Sequence
  Synthetic
gctatcacgccaatctcggtat

SEQ ID NO: 36938 - DNA, 18 bp, Artificial Sequence
  Synthetic
gcaacctgcgcctgcgtt

SEQ ID NO: 36939 - DNA, 22 bp, Artificial Sequence
  Synthetic
ggggtaaattcgcctccctgtt

SEQ ID NO: 36940 - DNA, 19 bp, Artificial Sequence
  Synthetic
gatgcgatggggctcaggg

SEQ ID NO: 36941 - DNA, 19 bp, Artificial Sequence
  Synthetic
aatacgtccgcccgccgtg

SEQ ID NO: 36942 - DNA, 20 bp, Artificial Sequence
  Synthetic
gaaggcggtttcgaccagga

SEQ ID NO: 36943 - DNA, 18 bp, Artificial Sequence
  Synthetic
tccaagccctgcaacgcg

SEQ ID NO: 36944 - DNA, 19 bp, Artificial Sequence
  Synthetic
ttctacggccccgccctgt

SEQ ID NO: 36945 - DNA, 20 bp, Artificial Sequence
  Synthetic
gcaaaacggcgcgcatttcg

SEQ ID NO: 36946 - DNA, 21 bp, Artificial Sequence
  Synthetic
ggcgttgttcagcggtctgta

SEQ ID NO: 36947 - DNA, 20 bp, Artificial Sequence
  Synthetic
cgcgcatacaatggcgtgtc

SEQ ID NO: 36948 - DNA, 21 bp, Artificial Sequence
  Synthetic
gtgcgtgatgttttccgtcgg

SEQ ID NO: 36949 - DNA, 19 bp, Artificial Sequence
  Synthetic
gccgcatcgttgatgtgcc

SEQ ID NO: 36950 - DNA, 20 bp, Artificial Sequence
  Synthetic
gcatgcccaacgaggcttcg

SEQ ID NO: 36951 - DNA, 20 bp, Artificial Sequence
  Synthetic
tggctgatgatggcggcaac

SEQ ID NO: 36952 - DNA, 22 bp, Artificial Sequence
  Synthetic
tgatggacacctcgttccacca

SEQ ID NO: 36953 - DNA, 18 bp, Artificial Sequence
  Synthetic
acgctgcgtgtcggtgct

SEQ ID NO: 36954 - DNA, 18 bp, Artificial Sequence
  Synthetic
aaacgccgccgacatcga

SEQ ID NO: 36955 - DNA, 20 bp, Artificial Sequence
  Synthetic
cccgacaacatcaccaccga

SEQ ID NO: 36956 - DNA, 19 bp, Artificial Sequence
  Synthetic
tgccgcggttacttcgtgt

SEQ ID NO: 36957 - DNA, 19 bp, Artificial Sequence
  Synthetic
ctgtctatcggcgaccgcg

SEQ ID NO: 36958 - DNA, 19 bp, Artificial Sequence
  Synthetic
tgatgctgggacgcgcgtc

SEQ ID NO: 36959 - DNA, 20 bp, Artificial Sequence
  Synthetic
ccgctttgctggtggacgat

SEQ ID NO: 36960 - DNA, 21 bp, Artificial Sequence
  Synthetic
tgggtttgggtgcgagtttga

SEQ ID NO: 36961 - DNA, 18 bp, Artificial Sequence
  Synthetic
tggacggctgcggcttga

SEQ ID NO: 36962 - DNA, 21 bp, Artificial Sequence
  Synthetic
gcgacatcgaattgctggcgg

SEQ ID NO: 36963 - DNA, 22 bp, Artificial Sequence
  Synthetic
ggtttgcaaggcttcagcaaca

SEQ ID NO: 36964 - DNA, 21 bp, Artificial Sequence
  Synthetic
gcgacaacccgcgtttggaaa

SEQ ID NO: 36965 - DNA, 20 bp, Artificial Sequence
  Synthetic
ccgccgcgatggaagtttcc

SEQ ID NO: 36966 - DNA, 20 bp, Artificial Sequence
  Synthetic
attgacggcaaaggtcagga

SEQ ID NO: 36967 - DNA, 20 bp, Artificial Sequence
  Synthetic
taaggggcggttggctgttc

SEQ ID NO: 36968 - DNA, 20 bp, Artificial Sequence
  Synthetic
gggaagagccggacggacag

SEQ ID NO: 36969 - DNA, 20 bp, Artificial Sequence
  Synthetic
cggcaaacaatacgcacggc

SEQ ID NO: 36970 - DNA, 19 bp, Artificial Sequence
  Synthetic
gccttgtcctgccgcatct

SEQ ID NO: 36971 - DNA, 19 bp, Artificial Sequence
  Synthetic
tgttcagcgttttgcccgc

SEQ ID NO: 36972 - DNA, 19 bp, Artificial Sequence
  Synthetic
tgacggtgttgcctgccgc

SEQ ID NO: 36973 - DNA, 22 bp, Artificial Sequence
  Synthetic
gtcgagcctgtgaaaatcacgc

SEQ ID NO: 36974 - DNA, 19 bp, Artificial Sequence
  Synthetic
acgacggttcggatgccgg

SEQ ID NO: 36975 - DNA, 19 bp, Artificial Sequence
  Synthetic
gcgtccagggtcagcttgg

SEQ ID NO: 36976 - DNA, 19 bp, Artificial Sequence
  Synthetic
acgatgccgcacactgccg

SEQ ID NO: 36977 - DNA, 19 bp, Artificial Sequence
  Synthetic
tcgggcatcaccagcctga

SEQ ID NO: 36978 - DNA, 21 bp, Artificial Sequence
  Synthetic
cgtccgcttccaagccgaaat

SEQ ID NO: 36979 - DNA, 19 bp, Artificial Sequence
  Synthetic
tggcggctgatgtcgagcg

SEQ ID NO: 36980 - DNA, 20 bp, Artificial Sequence
  Synthetic
cgggcgcactctatccgatg

SEQ ID NO: 36981 - DNA, 19 bp, Artificial Sequence
  Synthetic
tgccaagtgcagacggccg

SEQ ID NO: 36982 - DNA, 20 bp, Artificial Sequence
  Synthetic
ttcaggtggacgtggtggct

SEQ ID NO: 36983 - DNA, 19 bp, Artificial Sequence
  Synthetic
agggttgggctggggcttg

SEQ ID NO: 36984 - DNA, 20 bp, Artificial Sequence
  Synthetic
tggtatccggttgttcgcac

SEQ ID NO: 36985 - DNA, 20 bp, Artificial Sequence
  Synthetic
ccagcaatttgcggcgcaac

SEQ ID NO: 36986 - DNA, 22 bp, Artificial Sequence
  Synthetic
ccacgcgtgtttccctgtcatc

SEQ ID NO: 36987 - DNA, 22 bp, Artificial Sequence
  Synthetic
gtggtggcggtagtgtcatagg

SEQ ID NO: 36988 - DNA, 20 bp, Artificial Sequence
  Synthetic
cgcggtcggaatgttcgtcc

SEQ ID NO: 36989 - DNA, 20 bp, Artificial Sequence
  Synthetic
cccgcgtttttcgtccaccc

SEQ ID NO: 36990 - DNA, 19 bp, Artificial Sequence
  Synthetic
ccggctgccaagcgtttgg

SEQ ID NO: 36991 - DNA, 20 bp, Artificial Sequence
  Synthetic
gggcttccagtgcggcaaat

SEQ ID NO: 36992 - DNA, 21 bp, Artificial Sequence
  Synthetic
acgatgccgtctgaaaagccg

SEQ ID NO: 36993 - DNA, 18 bp, Artificial Sequence
  Synthetic
ggcgcggtgtggaaacga

SEQ ID NO: 36994 - DNA, 22 bp, Artificial Sequence
  Synthetic
ccaagtccaaatccaagccgga

SEQ ID NO: 36995 - DNA, 19 bp, Artificial Sequence
  Synthetic
actgcggctgtcccagtcc

SEQ ID NO: 36996 - DNA, 22 bp, Artificial Sequence
  Synthetic
gccggccgatgatgaaaatgct

SEQ ID NO: 36997 - DNA, 22 bp, Artificial Sequence
  Synthetic
cgccgaacctgaaaacaacaca

SEQ ID NO: 36998 - DNA, 22 bp, Artificial Sequence
  Synthetic
cgtttgtctgcctgctttgtgt

SEQ ID NO: 36999 - DNA, 21 bp, Artificial Sequence
  Synthetic
gcttaaccgccgtcgtcaacg

SEQ ID NO: 37000 - DNA, 22 bp, Artificial Sequence
  Synthetic
cgcaaccattgttttgggcgac

SEQ ID NO: 37001 - DNA, 20 bp, Artificial Sequence
  Synthetic
gatgcggcaactgcgatgga

SEQ ID NO: 37002 - DNA, 20 bp, Artificial Sequence
  Synthetic
ccttccaaagacggcagcca

SEQ ID NO: 37003 - DNA, 19 bp, Artificial Sequence
  Synthetic
caactgcttcatcggcgcg

SEQ ID NO: 37004 - DNA, 19 bp, Artificial Sequence
  Synthetic
tggtcgcccgtcggtttgc

SEQ ID NO: 37005 - DNA, 21 bp, Artificial Sequence
  Synthetic
cccatgctgtcatctcaccgg

SEQ ID NO: 37006 - DNA, 23 bp, Artificial Sequence
  Synthetic
gggttatggttaatatccgcaca

SEQ ID NO: 37007 - DNA, 19 bp, Artificial Sequence
  Synthetic
cggggtgcataccgacagc

SEQ ID NO: 37008 - DNA, 20 bp, Artificial Sequence
  Synthetic
catcgattatgccgcaccgc

SEQ ID NO: 37009 - DNA, 22 bp, Artificial Sequence
  Synthetic
cttccgtgcagactgtcccaaa

SEQ ID NO: 37010 - DNA, 19 bp, Artificial Sequence
  Synthetic
cgcataccgctccctgtcc

SEQ ID NO: 37011 - DNA, 24 bp, Artificial Sequence
  Synthetic
caaatgccgtctgaaaattggttt

SEQ ID NO: 37012 - DNA, 21 bp, Artificial Sequence
  Synthetic
gacggcatctgtacggtgtcc

SEQ ID NO: 37013 - DNA, 22 bp, Artificial Sequence
  Synthetic
ggatgacgggggtcagttcaag

SEQ ID NO: 37014 - DNA, 20 bp, Artificial Sequence
  Synthetic
tgtgggcttcggggtctttg

SEQ ID NO: 37015 - DNA, 23 bp, Artificial Sequence
  Synthetic
gtactgcatatctggtctttggc

SEQ ID NO: 37016 - DNA, 21 bp, Artificial Sequence
  Synthetic
gctcgccgagccgattcaaac

SEQ ID NO: 37017 - DNA, 22 bp, Artificial Sequence
  Synthetic
atcatcggcaaactcaccgcta

SEQ ID NO: 37018 - DNA, 21 bp, Artificial Sequence
  Synthetic
cgcacgagcagaaaccgaatc

SEQ ID NO: 37019 - DNA, 19 bp, Artificial Sequence
  Synthetic
cgcctgtccgcacccaatt

SEQ ID NO: 37020 - DNA, 18 bp, Artificial Sequence
  Synthetic
ctacgaccaggcgcgcaa

SEQ ID NO: 37021 - DNA, 22 bp, Artificial Sequence
  Synthetic
caggcagtgatgcaaaacagcc

SEQ ID NO: 37022 - DNA, 18 bp, Artificial Sequence
  Synthetic
agaagccgcacccgcaca

SEQ ID NO: 37023 - DNA, 18 bp, Artificial Sequence
  Synthetic
gctgcaaagcgtcagccg

SEQ ID NO: 37024 - DNA, 22 bp, Artificial Sequence
  Synthetic
ccgtctgaaaaccttggagcga

SEQ ID NO: 37025 - DNA, 19 bp, Artificial Sequence
  Synthetic
atgaagctgcggacgggcg

SEQ ID NO: 37026 - DNA, 19 bp, Artificial Sequence
  Synthetic
ggcgcagttttccgccctt

SEQ ID NO: 37027 - DNA, 21 bp, Artificial Sequence
  Synthetic
acgtcgcctttttgaaacgcg

SEQ ID NO: 37028 - DNA, 19 bp, Artificial Sequence
  Synthetic
ctcgtctgccgtcatcgcc

SEQ ID NO: 37029 - DNA, 21 bp, Artificial Sequence
  Synthetic
ttttcggcaaacagttcggcg

SEQ ID NO: 37030 - DNA, 19 bp, Artificial Sequence
  Synthetic
cgtaggttgtgccgtcggg

SEQ ID NO: 37031 - DNA, 21 bp, Artificial Sequence
  Synthetic
tgaccgcctctcttgcctaca

SEQ ID NO: 37032 - DNA, 18 bp, Artificial Sequence
  Synthetic
ggcagggttcggcgtgtt

SEQ ID NO: 37033 - DNA, 22 bp, Artificial Sequence
  Synthetic
tggctgcctgattcgatggaag

SEQ ID NO: 37034 - DNA, 20 bp, Artificial Sequence
  Synthetic
gcggagtttttgggcgtgac

SEQ ID NO: 37035 - DNA, 19 bp, Artificial Sequence
  Synthetic
aaccgcctcgtccgtgtcg

SEQ ID NO: 37036 - DNA, 22 bp, Artificial Sequence
  Synthetic
ctttgacaccattgtgccgctg

SEQ ID NO: 37037 - DNA, 22 bp, Artificial Sequence
  Synthetic
gggtgctgaaaaaactggcgga

SEQ ID NO: 37038 - DNA, 19 bp, Artificial Sequence
  Synthetic
tgtgtgtggggacttgggc

SEQ ID NO: 37039 - DNA, 20 bp, Artificial Sequence
  Synthetic
cggcaagccaccatgagacg

SEQ ID NO: 37040 - DNA, 18 bp, Artificial Sequence
  Synthetic
agccgaggaatccgccga

SEQ ID NO: 37041 - DNA, 20 bp, Artificial Sequence
  Synthetic
tgaagcccaccctacagccc

SEQ ID NO: 37042 - DNA, 21 bp, Artificial Sequence
  Synthetic
tgacggctttgttcaggtcgg

SEQ ID NO: 37043 - DNA, 19 bp, Artificial Sequence
  Synthetic
atcgcctgccgcagacttt

SEQ ID NO: 37044 - DNA, 22 bp, Artificial Sequence
  Synthetic
gcattcaatgcggtaggcgagt

SEQ ID NO: 37045 - DNA, 18 bp, Artificial Sequence
  Synthetic
gcgcggcggaatccttca

SEQ ID NO: 37046 - DNA, 22 bp, Artificial Sequence
  Synthetic
cacctgcttacccaagtggacg

SEQ ID NO: 37047 - DNA, 20 bp, Artificial Sequence
  Synthetic
ggatttggggcgtcgtgtcc

SEQ ID NO: 37048 - DNA, 20 bp, Artificial Sequence
  Synthetic
gttgtcgaatttgccgcccg

SEQ ID NO: 37049 - DNA, 21 bp, Artificial Sequence
  Synthetic
gcggcgttttcttcgttgacc

SEQ ID NO: 37050 - DNA, 20 bp, Artificial Sequence
  Synthetic
ttgcgttcgatgcaggggat

SEQ ID NO: 37051 - DNA, 19 bp, Artificial Sequence
  Synthetic
tcttgttcgtccgccgccg

SEQ ID NO: 37052 - DNA, 19 bp, Artificial Sequence
  Synthetic
cgatgggcgtgctgctgat

SEQ ID NO: 37053 - DNA, 22 bp, Artificial Sequence
  Synthetic
cccttggaagacgaccgtgaaa

SEQ ID NO: 37054 - DNA, 22 bp, Artificial Sequence
  Synthetic
gcggctcaattccaaaagtccg

SEQ ID NO: 37055 - DNA, 20 bp, Artificial Sequence
  Synthetic
ggcacttgggcgctcacttc

SEQ ID NO: 37056 - DNA, 21 bp, Artificial Sequence
  Synthetic
cggcgttttccggtttgacct

SEQ ID NO: 37057 - DNA, 19 bp, Artificial Sequence
  Synthetic
tgcctgcggtcagcaccac

SEQ ID NO: 37058 - DNA, 22 bp, Artificial Sequence
  Synthetic
gcttcgcggctgagtttttgtc

SEQ ID NO: 37059 - DNA, 18 bp, Artificial Sequence
  Synthetic
cgcgtgctggtggtcgat

SEQ ID NO: 37060 - DNA, 19 bp, Artificial Sequence
  Synthetic
gcatcaggccgctgtcgag

SEQ ID NO: 37061 - DNA, 20 bp, Artificial Sequence
  Synthetic
tgggagattgcagcttggcg

SEQ ID NO: 37062 - DNA, 22 bp, Artificial Sequence
  Synthetic
cctgccattggtagtggaggtg

SEQ ID NO: 37063 - DNA, 21 bp, Artificial Sequence
  Synthetic
gccgccatattgccctcaaac

SEQ ID NO: 37064 - DNA, 20 bp, Artificial Sequence
  Synthetic
cggcaacccagaccaaaccc

SEQ ID NO: 37065 - DNA, 20 bp, Artificial Sequence
  Synthetic
tacggtgctcggctcggtac

SEQ ID NO: 37066 - DNA, 18 bp, Artificial Sequence
  Synthetic
cgccgccgatgatgcagt

SEQ ID NO: 37067 - DNA, 21 bp, Artificial Sequence
  Synthetic
gttacccgtaccgatggtggc

SEQ ID NO: 37068 - DNA, 18 bp, Artificial Sequence
  Synthetic
gctgtcggcggttttggc

SEQ ID NO: 37069 - DNA, 20 bp, Artificial Sequence
  Synthetic
aaaaacagtgcggtcggtga

SEQ ID NO: 37070 - DNA, 18 bp, Artificial Sequence
  Synthetic
gaggatgtgccgccggtt

SEQ ID NO: 37071 - DNA, 20 bp, Artificial Sequence
  Synthetic
gtttggcggccaacgtttcg

SEQ ID NO: 37072 - DNA, 19 bp, Artificial Sequence
  Synthetic
tggcggtacccggttcgat

SEQ ID NO: 37073 - DNA, 21 bp, Artificial Sequence
  Synthetic
tgcgcgaattaagggaggagg

SEQ ID NO: 37074 - DNA, 21 bp, Artificial Sequence
  Synthetic
gcgcaccggggtaatcaaagg

SEQ ID NO: 37075 - DNA, 19 bp, Artificial Sequence
  Synthetic
tgccgctgctgctgaaggg

SEQ ID NO: 37076 - DNA, 19 bp, Artificial Sequence
  Synthetic
cgcatcggtgccgtccaat

SEQ ID NO: 37077 - DNA, 19 bp, Artificial Sequence
  Synthetic
caaaatcagcgggcgcacg

SEQ ID NO: 37078 - DNA, 20 bp, Artificial Sequence
  Synthetic
atccacgccagttggtagcc

SEQ ID NO: 37079 - DNA, 22 bp, Artificial Sequence
  Synthetic
acgtggtcaaagtgaaggtgct

SEQ ID NO: 37080 - DNA, 21 bp, Artificial Sequence
  Synthetic
cagcacgacgtgaaccaaagc

SEQ ID NO: 37081 - DNA, 21 bp, Artificial Sequence
  Synthetic
gcgttttatcggtgcgggaac

SEQ ID NO: 37082 - DNA, 22 bp, Artificial Sequence
  Synthetic
gctcaccgtccccaaagaaacc

SEQ ID NO: 37083 - DNA, 22 bp, Artificial Sequence
  Synthetic
cccaaacacaggttttcagctg

SEQ ID NO: 37084 - DNA, 19 bp, Artificial Sequence
  Synthetic
cgccgcattgtccgggtta

SEQ ID NO: 37085 - DNA, 21 bp, Artificial Sequence
  Synthetic
tcgccgatacagaccacgtct

SEQ ID NO: 37086 - DNA, 20 bp, Artificial Sequence
  Synthetic
atggaggcggcggtaaagac

SEQ ID NO: 37087 - DNA, 19 bp, Artificial Sequence
  Synthetic
gccgtctgaaaggaggcgc

SEQ ID NO: 37088 - DNA, 19 bp, Artificial Sequence
  Synthetic
cggacggattgcctgccag

SEQ ID NO: 37089 - DNA, 20 bp, Artificial Sequence
  Synthetic
gtacacgcggcttttggtgg

SEQ ID NO: 37090 - DNA, 22 bp, Artificial Sequence
  Synthetic
gtagccggttttgagcagggta

SEQ ID NO: 37091 - DNA, 22 bp, Artificial Sequence
  Synthetic
cgcgcagtgtatccaatgccgt

SEQ ID NO: 37092 - DNA, 19 bp, Artificial Sequence
  Synthetic
ggcaacgccgtaccggttt

SEQ ID NO: 37093 - DNA, 19 bp, Artificial Sequence
  Synthetic
acacagcgggcgaatacgg

SEQ ID NO: 37094 - DNA, 19 bp, Artificial Sequence
  Synthetic
ggcttgggcaacggcttcg

SEQ ID NO: 37095 - DNA, 19 bp, Artificial Sequence
  Synthetic
accaccgcttcggcatcgg

SEQ ID NO: 37096 - DNA, 20 bp, Artificial Sequence
  Synthetic
aatgcttgccgtcgcgatga

SEQ ID NO: 37097 - DNA, 22 bp, Artificial Sequence
  Synthetic
cgcctttgaccaagtctgtcca

SEQ ID NO: 37098 - DNA, 20 bp, Artificial Sequence
  Synthetic
ccgaaaccctcaaagccgcc

SEQ ID NO: 37099 - DNA, 19 bp, Artificial Sequence
  Synthetic
gtggagcgcaaagtcgtgc

SEQ ID NO: 37100 - DNA, 20 bp, Artificial Sequence
  Synthetic
ttttcagcctcgtttcccca

SEQ ID NO: 37101 - DNA, 21 bp, Artificial Sequence
  Synthetic
gctttggctaatgtcggaaga

SEQ ID NO: 37102 - DNA, 19 bp, Artificial Sequence
  Synthetic
atcctgtcccgccccaacc

SEQ ID NO: 37103 - DNA, 19 bp, Artificial Sequence
  Synthetic
aagccctttctgcccgccg

SEQ ID NO: 37104 - DNA, 18 bp, Artificial Sequence
  Synthetic
tccgttcccgcgcattcg

SEQ ID NO: 37105 - DNA, 18 bp, Artificial Sequence
  Synthetic
cagccacgccacgatgct

SEQ ID NO: 37106 - DNA, 22 bp, Artificial Sequence
  Synthetic
cggcattttcagcaacaacggg

SEQ ID NO: 37107 - DNA, 20 bp, Artificial Sequence
  Synthetic
acacgcgtattatggcagca

SEQ ID NO: 37108 - DNA, 20 bp, Artificial Sequence
  Synthetic
cctcatccgaacccgcacag

SEQ ID NO: 37109 - DNA, 20 bp, Artificial Sequence
  Synthetic
gccccaaatctccgtcgtcg

SEQ ID NO: 37110 - DNA, 21 bp, Artificial Sequence
  Synthetic
gtggtaggtgaggtcggcaac

SEQ ID NO: 37111 - DNA, 21 bp, Artificial Sequence
  Synthetic
ggcatgcctaacaagccgaca

SEQ ID NO: 37112 - DNA, 19 bp, Artificial Sequence
  Synthetic
atcgggatagagcgtgcgc

SEQ ID NO: 37113 - DNA, 19 bp, Artificial Sequence
  Synthetic
caccgtcggcgaccaactt

SEQ ID NO: 37114 - DNA, 18 bp, Artificial Sequence
  Synthetic
tcatcagcggcatgggcg

SEQ ID NO: 37115 - DNA, 18 bp, Artificial Sequence
  Synthetic
gtggtcggcgtgggcatt

SEQ ID NO: 37116 - DNA, 19 bp, Artificial Sequence
  Synthetic
ggtcaaacgcccagccgaa

SEQ ID NO: 37117 - DNA, 20 bp, Artificial Sequence
  Synthetic
ggctgatttcgccgctgacg

SEQ ID NO: 37118 - DNA, 21 bp, Artificial Sequence
  Synthetic
atcggcaagccggttttgcag

SEQ ID NO: 37119 - DNA, 19 bp, Artificial Sequence
  Synthetic
cacgaagcccccgtccatg

SEQ ID NO: 37120 - DNA, 18 bp, Artificial Sequence
  Synthetic
cgtcaacatggcgcacgc

SEQ ID NO: 37121 - DNA, 22 bp, Artificial Sequence
  Synthetic
gcgcgattttccagaccacgac

SEQ ID NO: 37122 - DNA, 18 bp, Artificial Sequence
  Synthetic
tgtgtggcacgggcagga

SEQ ID NO: 37123 - DNA, 18 bp, Artificial Sequence
  Synthetic
aagcacgccgcccgtttg

SEQ ID NO: 37124 - DNA, 21 bp, Artificial Sequence
  Synthetic
gtcaaaccggccatcacttgc

SEQ ID NO: 37125 - DNA, 20 bp, Artificial Sequence
  Synthetic
gcagtccgacgcgttccaac

SEQ ID NO: 37126 - DNA, 22 bp, Artificial Sequence
  Synthetic
gccatactgctttccaccagcg

SEQ ID NO: 37127 - DNA, 21 bp, Artificial Sequence
  Synthetic
cttggaagggggctggcaata

SEQ ID NO: 37128 - DNA, 18 bp, Artificial Sequence
  Synthetic
acgcggcggatggaaagc

SEQ ID NO: 37129 - DNA, 22 bp, Artificial Sequence
  Synthetic
gtgcggattgtcgggttctttg

SEQ ID NO: 37130 - DNA, 20 bp, Artificial Sequence
  Synthetic
gggaaaggaaaagccgggca

SEQ ID NO: 37131 - DNA, 18 bp, Artificial Sequence
  Synthetic
tgcgctttaccccggtgg

SEQ ID NO: 37132 - DNA, 20 bp, Artificial Sequence
  Synthetic
cttcgaggaagtagccgccg

SEQ ID NO: 37133 - DNA, 21 bp, Artificial Sequence
  Synthetic
gcagctatgttcagacggcat

SEQ ID NO: 37134 - DNA, 19 bp, Artificial Sequence
  Synthetic
ttaccgccgcctccctgac

SEQ ID NO: 37135 - DNA, 20 bp, Artificial Sequence
  Synthetic
cgcacatggaacaaggcggg

SEQ ID NO: 37136 - DNA, 22 bp, Artificial Sequence
  Synthetic
caccaacgccatcgaaaccaag

SEQ ID NO: 37137 - DNA, 21 bp, Artificial Sequence
  Synthetic
cgcgtgcagcttatggaggac

SEQ ID NO: 37138 - DNA, 18 bp, Artificial Sequence
  Synthetic
attccccatcaccgcgcg

SEQ ID NO: 37139 - DNA, 18 bp, Artificial Sequence
  Synthetic
gcgccacggcaagaaacg

SEQ ID NO: 37140 - DNA, 20 bp, Artificial Sequence
  Synthetic
tctcggcttgtcaaccgttt

SEQ ID NO: 37141 - DNA, 18 bp, Artificial Sequence
  Synthetic
ttccggaccgcccaaacg

SEQ ID NO: 37142 - DNA, 20 bp, Artificial Sequence
  Synthetic
acgctttcagacggcatccg

SEQ ID NO: 37143 - DNA, 21 bp, Artificial Sequence
  Synthetic
gctgcgggactttttggaacg

SEQ ID NO: 37144 - DNA, 19 bp, Artificial Sequence
  Synthetic
tgcgccaaacaccaaagcg

SEQ ID NO: 37145 - DNA, 21 bp, Artificial Sequence
  Synthetic
gggtgcttggaaaaatgccgc

SEQ ID NO: 37146 - DNA, 19 bp, Artificial Sequence
  Synthetic
catcagtacgccgcctgca

SEQ ID NO: 37147 - DNA, 20 bp, Artificial Sequence
  Synthetic
gcgccgccgactttaccatt

SEQ ID NO: 37148 - DNA, 21 bp, Artificial Sequence
  Synthetic
cgccaaactgattgtggcgca

SEQ ID NO: 37149 - DNA, 19 bp, Artificial Sequence
  Synthetic
aacggaatcgagccggccg

SEQ ID NO: 37150 - DNA, 20 bp, Artificial Sequence
  Synthetic
ccgtccaccacgcatcgtaa

SEQ ID NO: 37151 - DNA, 21 bp, Artificial Sequence
  Synthetic
cgccttcatccacctcagtcc

SEQ ID NO: 37152 - DNA, 18 bp, Artificial Sequence
  Synthetic
gacaagatgggcgcgggt

SEQ ID NO: 37153 - DNA, 19 bp, Artificial Sequence
  Synthetic
cgcttccggcatcggcaag

SEQ ID NO: 37154 - DNA, 19 bp, Artificial Sequence
  Synthetic
tcccgaactgctcagcggc

SEQ ID NO: 37155 - DNA, 19 bp, Artificial Sequence
  Synthetic
tgcacgtcttcctgccgcc

SEQ ID NO: 37156 - DNA, 20 bp, Artificial Sequence
  Synthetic
cgacggcctcatcaacccaa

SEQ ID NO: 37157 - DNA, 20 bp, Artificial Sequence
  Synthetic
gcgagacggtgagcgtgaat

SEQ ID NO: 37158 - DNA, 22 bp, Artificial Sequence
  Synthetic
ccccacaagccaaagaacaggc

SEQ ID NO: 37159 - DNA, 22 bp, Artificial Sequence
  Synthetic
gcggcatcatctcgattgccga

SEQ ID NO: 37160 - DNA, 21 bp, Artificial Sequence
  Synthetic
cgcccattccgatcatgtcgc

SEQ ID NO: 37161 - DNA, 19 bp, Artificial Sequence
  Synthetic
ggatgcccgccgtcagaag

SEQ ID NO: 37162 - DNA, 20 bp, Artificial Sequence
  Synthetic
ctgccgccgatgatgatggc

SEQ ID NO: 37163 - DNA, 21 bp, Artificial Sequence
  Synthetic
ggcagcctttcagacggcatc

SEQ ID NO: 37164 - DNA, 18 bp, Artificial Sequence
  Synthetic
aaaacctcggcagcgggc

SEQ ID NO: 37165 - DNA, 20 bp, Artificial Sequence
  Synthetic
cagggttcgactggcggttt

SEQ ID NO: 37166 - DNA, 20 bp, Artificial Sequence
  Synthetic
ccgccgaatatcgcgaatgc

SEQ ID NO: 37167 - DNA, 22 bp, Artificial Sequence
  Synthetic
cctgtcgctcaaacccgtttca

SEQ ID NO: 37168 - DNA, 20 bp, Artificial Sequence
  Synthetic
acgggccgtcaaacaaggtg

SEQ ID NO: 37169 - DNA, 21 bp, Artificial Sequence
  Synthetic
actgcaatacgtcgccttcga

SEQ ID NO: 37170 - DNA, 21 bp, Artificial Sequence
  Synthetic
cagcagccacggtttttcgtg

SEQ ID NO: 37171 - DNA, 18 bp, Artificial Sequence
  Synthetic
tggtaaccgcctgcctgc

SEQ ID NO: 37172 - DNA, 21 bp, Artificial Sequence
  Synthetic
acgatatggcggtcaacagcg

SEQ ID NO: 37173 - DNA, 21 bp, Artificial Sequence
  Synthetic
tgacggcggtacacaaggttc

SEQ ID NO: 37174 - DNA, 22 bp, Artificial Sequence
  Synthetic
gctgaaccttgcccatttggac

SEQ ID NO: 37175 - DNA, 19 bp, Artificial Sequence
  Synthetic
aagcgggtcggtatggcgg

SEQ ID NO: 37176 - DNA, 21 bp, Artificial Sequence
  Synthetic
aatgtccgcctcgctcaacat

SEQ ID NO: 37177 - DNA, 19 bp, Artificial Sequence
  Synthetic
accgcccaaaccgccttgg

SEQ ID NO: 37178 - DNA, 19 bp, Artificial Sequence
  Synthetic
acaccccgcccgaacagga

SEQ ID NO: 37179 - DNA, 21 bp, Artificial Sequence
  Synthetic
cctctggttcctcatccgtag

SEQ ID NO: 37180 - DNA, 20 bp, Artificial Sequence
  Synthetic
cgcttccagtctcggactaa

SEQ ID NO: 37181 - DNA, 23 bp, Artificial Sequence
  Synthetic
atgatgtttccgtatgctccttt

SEQ ID NO: 37182 - DNA, 25 bp, Artificial Sequence
  Synthetic
cttttgtttccatctttgtccacat

SEQ ID NO: 37183 - DNA, 20 bp, Artificial Sequence
  Synthetic
agctgggcctctgagcaata

SEQ ID NO: 37184 - DNA, 24 bp, Artificial Sequence
  Synthetic
gctctattgatcagcctttcagat

SEQ ID NO: 37185 - DNA, 24 bp, Artificial Sequence
  Synthetic
acctccactaaaggattctggtaa

SEQ ID NO: 37186 - DNA, 25 bp, Artificial Sequence
  Synthetic
ttatcaccatatgtgtcctttgtca

SEQ ID NO: 37187 - DNA, 24 bp, Artificial Sequence
  Synthetic
gcttctaacggtactttgcaaaga

SEQ ID NO: 37188 - DNA, 25 bp, Artificial Sequence
  Synthetic
cattcacagtttaacatggaatgca

SEQ ID NO: 37189 - DNA, 21 bp, Artificial Sequence
  Synthetic
tttccgcaagttcgacaatca

SEQ ID NO: 37190 - DNA, 20 bp, Artificial Sequence
  Synthetic
gctcctgtggtgttgcaaat

SEQ ID NO: 37191 - DNA, 22 bp, Artificial Sequence
  Synthetic
cctcattctcaatgtcctgcag

SEQ ID NO: 37192 - DNA, 20 bp, Artificial Sequence
  Synthetic
ggagccacgtcttctccaat

SEQ ID NO: 37193 - DNA, 20 bp, Artificial Sequence
  Synthetic
tcaaagtcacccccctcggt

SEQ ID NO: 37194 - DNA, 20 bp, Artificial Sequence
  Synthetic
ccctttactcggaccgggga

SEQ ID NO: 37195 - DNA, 21 bp, Artificial Sequence
  Synthetic
aggagaggcaggatcaccgac

SEQ ID NO: 37196 - DNA, 20 bp, Artificial Sequence
  Synthetic
tgcaggtttactgtgcagca

SEQ ID NO: 37197 - DNA, 21 bp, Artificial Sequence
  Synthetic
tttgcctgtttttgttgtgcc

SEQ ID NO: 37198 - DNA, 22 bp, Artificial Sequence
  Synthetic
gccatgccttttgtttacacac

SEQ ID NO: 37199 - DNA, 20 bp, Artificial Sequence
  Synthetic
cgctttcctgggtatggcgc

SEQ ID NO: 37200 - DNA, 25 bp, Artificial Sequence
  Synthetic
gcaataatgtccaaaaaatcggggt

SEQ ID NO: 37201 - DNA, 20 bp, Artificial Sequence
  Synthetic
gcggcgtatgtatgctagga

SEQ ID NO: 37202 - DNA, 20 bp, Artificial Sequence
  Synthetic
taccccagtgctctcccaag

SEQ ID NO: 37203 - DNA, 23 bp, Artificial Sequence
  Synthetic
acacacacaaacatgcggaatta

SEQ ID NO: 37204 - DNA, 18 bp, Artificial Sequence
  Synthetic
aaatcccccacgccctgc

SEQ ID NO: 37205 - DNA, 21 bp, Artificial Sequence
  Synthetic
tggctaaccccaaccatccca

SEQ ID NO: 37206 - DNA, 22 bp, Artificial Sequence
  Synthetic
gatcacacaaccaggctcgtgt

SEQ ID NO: 37207 - DNA, 22 bp, Artificial Sequence
  Synthetic
actctagagtgataggcctggt

SEQ ID NO: 37208 - DNA, 21 bp, Artificial Sequence
  Synthetic
accagaggccaaggacctaca

SEQ ID NO: 37209 - DNA, 23 bp, Artificial Sequence
  Synthetic
acatagaagagctacgtgacaca

SEQ ID NO: 37210 - DNA, 18 bp, Artificial Sequence
  Synthetic
gccgagacgcgcaacaac

SEQ ID NO: 37211 - DNA, 24 bp, Artificial Sequence
  Synthetic
aaccactagcctaacatttttgga

SEQ ID NO: 37212 - DNA, 21 bp, Artificial Sequence
  Synthetic
gcggtttccaatgtgaaagga

SEQ ID NO: 37213 - DNA, 20 bp, Artificial Sequence
  Synthetic
caagcagtggatgaggcggc

SEQ ID NO: 37214 - DNA, 20 bp, Artificial Sequence
  Synthetic
gcctagcgttgactggaaca

SEQ ID NO: 37215 - DNA, 20 bp, Artificial Sequence
  Synthetic
ccaggtgtagctcatgctgc

SEQ ID NO: 37216 - DNA, 21 bp, Artificial Sequence
  Synthetic
acgaacatcagtgccccgaag

SEQ ID NO: 37217 - DNA, 20 bp, Artificial Sequence
  Synthetic
atgtggctccgactgcatcg

SEQ ID NO: 37218 - DNA, 22 bp, Artificial Sequence
  Synthetic
ccgcaaataaggaagcgagggt

SEQ ID NO: 37219 - DNA, 25 bp, Artificial Sequence
  Synthetic
gtcttatccaaatctggtagaggtc

SEQ ID NO: 37220 - DNA, 19 bp, Artificial Sequence
  Synthetic
actcacatcggcggggtcg

SEQ ID NO: 37221 - DNA, 24 bp, Artificial Sequence
  Synthetic
gcaaatcctgtaatgtcacattgc

SEQ ID NO: 37222 - DNA, 20 bp, Artificial Sequence
  Synthetic
tcgtgacaacttgagctgga

SEQ ID NO: 37223 - DNA, 20 bp, Artificial Sequence
  Synthetic
tgctgagcacttcctgacaa

SEQ ID NO: 37224 - DNA, 21 bp, Artificial Sequence
  Synthetic
ttcactccatgaccaccttct

SEQ ID NO: 37225 - DNA, 20 bp, Artificial Sequence
  Synthetic
gttgctttacaggtaccgca

SEQ ID NO: 37226 - DNA, 25 bp, Artificial Sequence
  Synthetic
gcattagccaaaaatgactttgact

SEQ ID NO: 37227 - DNA, 22 bp, Artificial Sequence
  Synthetic
cggaggtagagggttgggtgaa

SEQ ID NO: 37228 - DNA, 21 bp, Artificial Sequence
  Synthetic
tcctgttcccacttcagaagg

SEQ ID NO: 37229 - DNA, 20 bp, Artificial Sequence
  Synthetic
gaagccccaacaccagaacc

SEQ ID NO: 37230 - DNA, 25 bp, Artificial Sequence
  Synthetic
cctcctgtaaatctctttcaaaggt

SEQ ID NO: 37231 - DNA, 20 bp, Artificial Sequence
  Synthetic
ggctgcaccaaatcctgtgt

SEQ ID NO: 37232 - DNA, 20 bp, Artificial Sequence
  Synthetic
ggcgccaagtttcttaccag

SEQ ID NO: 37233 - DNA, 21 bp, Artificial Sequence
  Synthetic
cattctcttcctcccaacagc

SEQ ID NO: 37234 - DNA, 21 bp, Artificial Sequence
  Synthetic
gtgtattgggcgtcttgaaca

SEQ ID NO: 37235 - DNA, 24 bp, Artificial Sequence
  Synthetic
agcaattagattcccattggatcg

SEQ ID NO: 37236 - DNA, 24 bp, Artificial Sequence
  Synthetic
aacctccttctatgaatccagcta

SEQ ID NO: 37237 - DNA, 19 bp, Artificial Sequence
  Synthetic
tctgaccaccgcccgggaa

SEQ ID NO: 37238 - DNA, 20 bp, Artificial Sequence
  Synthetic
aggtgcagccgaaccagttg

SEQ ID NO: 37239 - DNA, 22 bp, Artificial Sequence
  Synthetic
gctcaactcggccctatctctg

SEQ ID NO: 37240 - DNA, 21 bp, Artificial Sequence
  Synthetic
gcagccgcgtttaggacaatg

SEQ ID NO: 37241 - DNA, 21 bp, Artificial Sequence
  Synthetic
gcacccacacgtggatgatgg

SEQ ID NO: 37242 - DNA, 21 bp, Artificial Sequence
  Synthetic
ggccaccgttaattcgcggag

SEQ ID NO: 37243 - DNA, 19 bp, Artificial Sequence
  Synthetic
gggcacatgatcgggccac

SEQ ID NO: 37244 - DNA, 22 bp, Artificial Sequence
  Synthetic
ccacgccgtatgctcttgacat

SEQ ID NO: 37245 - DNA, 20 bp, Artificial Sequence
  Synthetic
tggcttctggacactgcgtc

SEQ ID NO: 37246 - DNA, 22 bp, Artificial Sequence
  Synthetic
cggtgaaagacatcaacgtggc

SEQ ID NO: 37247 - DNA, 22 bp, Artificial Sequence
  Synthetic
ggcgcatatgacaccaaccact

SEQ ID NO: 37248 - DNA, 21 bp, Artificial Sequence
  Synthetic
aggagttttgcctgcagccag

SEQ ID NO: 37249 - DNA, 20 bp, Artificial Sequence
  Synthetic
agctgactggccgaggagtt

SEQ ID NO: 37250 - DNA, 21 bp, Artificial Sequence
  Synthetic
cccacacctgaggggggtcat

SEQ ID NO: 37251 - DNA, 20 bp, Artificial Sequence
  Synthetic
cacgttgtcctcaccgctga

SEQ ID NO: 37252 - DNA, 20 bp, Artificial Sequence
  Synthetic
gtgcagtcccggagctttgc

SEQ ID NO: 37253 - DNA, 22 bp, Artificial Sequence
  Synthetic
tcggcgcgtacatgatgatgtt

SEQ ID NO: 37254 - DNA, 22 bp, Artificial Sequence
  Synthetic
gatgagcttagcgcgtacagct

SEQ ID NO: 37255 - DNA, 20 bp, Artificial Sequence
  Synthetic
cacagagtccccgaagccac

SEQ ID NO: 37256 - DNA, 22 bp, Artificial Sequence
  Synthetic
aaacacaaactttgggcattcc

SEQ ID NO: 37257 - DNA, 21 bp, Artificial Sequence
  Synthetic
acacacagcctccaaaacatc

SEQ ID NO: 37258 - DNA, 20 bp, Artificial Sequence
  Synthetic
acactgttggtgagcaggtc

SEQ ID NO: 37259 - DNA, 25 bp, Artificial Sequence
  Synthetic
cgatagtgacttgatcaatgcacat

SEQ ID NO: 37260 - DNA, 24 bp, Artificial Sequence
  Synthetic
tcaccataggattagcactttgtg

SEQ ID NO: 37261 - DNA, 20 bp, Artificial Sequence
  Synthetic
tgcctgctgacaacaatggt

SEQ ID NO: 37262 - DNA, 22 bp, Artificial Sequence
  Synthetic
tcttcagcatgagcaagcattt

SEQ ID NO: 37263 - DNA, 23 bp, Artificial Sequence
  Synthetic
cacaccacattaagaactcgctt

SEQ ID NO: 37264 - DNA, 20 bp, Artificial Sequence
  Synthetic
ttgtaaggtgagctccgtca

SEQ ID NO: 37265 - DNA, 23 bp, Artificial Sequence
  Synthetic
tgggaagaatgtgacagatagct

SEQ ID NO: 37266 - DNA, 21 bp, Artificial Sequence
  Synthetic
cggtagttttcacgtcacact

SEQ ID NO: 37267 - DNA, 23 bp, Artificial Sequence
  Synthetic
ttgctgaaaaggtgtcgacataa

SEQ ID NO: 37268 - DNA, 25 bp, Artificial Sequence
  Synthetic
ccagatgagtgaaacattgtgactt

SEQ ID NO: 37269 - DNA, 20 bp, Artificial Sequence
  Synthetic
acgagtgacaccatcctgaa

SEQ ID NO: 37270 - DNA, 25 bp, Artificial Sequence
  Synthetic
gaaccctctagcaaattagtgtcat

SEQ ID NO: 37271 - DNA, 22 bp, Artificial Sequence
  Synthetic
agacacatctaaagcacccaca

SEQ ID NO: 37272 - DNA, 22 bp, Artificial Sequence
  Synthetic
aaaaaggtacacaaagcagcct

SEQ ID NO: 37273 - DNA, 24 bp, Artificial Sequence
  Synthetic
ttgtacttcattgccacaaggtta

SEQ ID NO: 37274 - DNA, 20 bp, Artificial Sequence
  Synthetic
aggcccacatggaaatagct

SEQ ID NO: 37275 - DNA, 25 bp, Artificial Sequence
  Synthetic
gcatcaatactactcttaggaggca

SEQ ID NO: 37276 - DNA, 22 bp, Artificial Sequence
  Synthetic
tcctcagatcttgcctgtttgt

SEQ ID NO: 37277 - DNA, 23 bp, Artificial Sequence
  Synthetic
gtttaacagctgagttggctctt

SEQ ID NO: 37278 - DNA, 21 bp, Artificial Sequence
  Synthetic
tgaagacgtactgtagcagct

SEQ ID NO: 37279 - DNA, 20 bp, Artificial Sequence
  Synthetic
aagtcatggacagcaaccgc

SEQ ID NO: 37280 - DNA, 22 bp, Artificial Sequence
  Synthetic
ggatggtatgtctggtcccaat

SEQ ID NO: 37281 - DNA, 23 bp, Artificial Sequence
  Synthetic
ttagtgcagctactgaaaagcat

SEQ ID NO: 37282 - DNA, 22 bp, Artificial Sequence
  Synthetic
gcgagctctattctttgcacta

SEQ ID NO: 37283 - DNA, 24 bp, Artificial Sequence
  Synthetic
ggagaaatgtttacgcaggtaagc

SEQ ID NO: 37284 - DNA, 23 bp, Artificial Sequence
  Synthetic
gggtaagcatcaatagccagtga

SEQ ID NO: 37285 - DNA, 24 bp, Artificial Sequence
  Synthetic
tgaaatgacatggtcatagcagca

SEQ ID NO: 37286 - DNA, 20 bp, Artificial Sequence
  Synthetic
tctgctgcgaaaagcttgag

SEQ ID NO: 37287 - DNA, 24 bp, Artificial Sequence
  Synthetic
tcatcaaagactacaatgtcagca

SEQ ID NO: 37288 - DNA, 25 bp, Artificial Sequence
  Synthetic
tgtagaacattttgaagcattgagc

SEQ ID NO: 37289 - DNA, 21 bp, Artificial Sequence
  Synthetic
gtgacgaatagcttcttcgcg

SEQ ID NO: 37290 - DNA, 21 bp, Artificial Sequence
  Synthetic
ggacgaacacgactctgtctg

SEQ ID NO: 37291 - DNA, 23 bp, Artificial Sequence
  Synthetic
actctcagtaggtttcttggcaa

SEQ ID NO: 37292 - DNA, 22 bp, Artificial Sequence
  Synthetic
gcgagctcgagaaagtcagttt

SEQ ID NO: 37293 - DNA, 25 bp, Artificial Sequence
  Synthetic
agtcaattgtaaccttgaccacttt

SEQ ID NO: 37294 - DNA, 22 bp, Artificial Sequence
  Synthetic
gaatcgacaagtagtgtgccag

SEQ ID NO: 37295 - DNA, 22 bp, Artificial Sequence
  Synthetic
tgcttccgatgatgatgcattt

SEQ ID NO: 37296 - DNA, 20 bp, Artificial Sequence
  Synthetic
aataggctgcagctgacgtg

SEQ ID NO: 37297 - DNA, 20 bp, Artificial Sequence
  Synthetic
tcaggggagaaaggcacatt

SEQ ID NO: 37298 - DNA, 20 bp, Artificial Sequence
  Synthetic
ttacacccccaaaagcgcaa

SEQ ID NO: 37299 - DNA, 25 bp, Artificial Sequence
  Synthetic
ttgaactatcagcacctaaagacat

SEQ ID NO: 37300 - DNA, 21 bp, Artificial Sequence
  Synthetic
gcatcagcgagtgtcacctta

SEQ ID NO: 37301 - DNA, 23 bp, Artificial Sequence
  Synthetic
aatcgccttgttaaattggttgg

SEQ ID NO: 37302 - DNA, 23 bp, Artificial Sequence
  Synthetic
ggttgcagaggatcataaactgt

SEQ ID NO: 37303 - DNA, 24 bp, Artificial Sequence
  Synthetic
gcaacaactagtcatgcaacaaag

SEQ ID NO: 37304 - DNA, 23 bp, Artificial Sequence
  Synthetic
gccatcttttattgagcgcaatt

SEQ ID NO: 37305 - DNA, 23 bp, Artificial Sequence
  Synthetic
agtctttaacacctgagtgccta

SEQ ID NO: 37306 - DNA, 23 bp, Artificial Sequence
  Synthetic
ccaggctaggaataggaaaccta

SEQ ID NO: 37307 - DNA, 22 bp, Artificial Sequence
  Synthetic
gccattcgcaagtgaccacgaa

SEQ ID NO: 37308 - DNA, 22 bp, Artificial Sequence
  Synthetic
tgcaacccatacgatgccttct

SEQ ID NO: 37309 - DNA, 20 bp, Artificial Sequence
  Synthetic
cgccagtggggaatgtccag

SEQ ID NO: 37310 - DNA, 21 bp, Artificial Sequence
  Synthetic
accatccagatgaggcagatg

SEQ ID NO: 37311 - DNA, 23 bp, Artificial Sequence
  Synthetic
cactagatgtccgtgatggtact

SEQ ID NO: 37312 - DNA, 22 bp, Artificial Sequence
  Synthetic
gcatggcttctctcctggattt

SEQ ID NO: 37313 - DNA, 20 bp, Artificial Sequence
  Synthetic
ttggccttgtggtaaatgcg

SEQ ID NO: 37314 - DNA, 20 bp, Artificial Sequence
  Synthetic
caacgtgaccttcacctcca

SEQ ID NO: 37315 - DNA, 21 bp, Artificial Sequence
  Synthetic
gcctgaacaacctagaagggt

SEQ ID NO: 37316 - DNA, 23 bp, Artificial Sequence
  Synthetic
ttagcattcgagcaagaacagaa

SEQ ID NO: 37317 - DNA, 22 bp, Artificial Sequence
  Synthetic
agtgtgattagtgcttgcaagt

SEQ ID NO: 37318 - DNA, 20 bp, Artificial Sequence
  Synthetic
aagatctcagagcctgggtc

SEQ ID NO: 37319 - DNA, 21 bp, Artificial Sequence
  Synthetic
cagcttttgtcgggtaatggt

SEQ ID NO: 37320 - DNA, 23 bp, Artificial Sequence
  Synthetic
gcttcatcttctgctattccact

SEQ ID NO: 37321 - DNA, 21 bp, Artificial Sequence
  Synthetic
ccaacaacagtatgtggcgtc

SEQ ID NO: 37322 - DNA, 22 bp, Artificial Sequence
  Synthetic
tcaactgaacttcttgctgtgc

SEQ ID NO: 37323 - DNA, 24 bp, Artificial Sequence
  Synthetic
acttaacagtccattcacctgttt

SEQ ID NO: 37324 - DNA, 21 bp, Artificial Sequence
  Synthetic
ccgaaagacagagctacagca

SEQ ID NO: 37325 - DNA, 24 bp, Artificial Sequence
  Synthetic
ggtccaataggctcaataacaaca

SEQ ID NO: 37326 - DNA, 20 bp, Artificial Sequence
  Synthetic
tagctctgttaaaggcccgc

SEQ ID NO: 37327 - DNA, 21 bp, Artificial Sequence
  Synthetic
acctttgttagggtctcccat

SEQ ID NO: 37328 - DNA, 23 bp, Artificial Sequence
  Synthetic
ggactggcgatatactttcgttt

SEQ ID NO: 37329 - DNA, 20 bp, Artificial Sequence
  Synthetic
gtcggtcaagtctgcctgat

SEQ ID NO: 37330 - DNA, 21 bp, Artificial Sequence
  Synthetic
cctccgcttcctcgtcttcgt

SEQ ID NO: 37331 - DNA, 20 bp, Artificial Sequence
  Synthetic
tacttcagcgccaccaagag

SEQ ID NO: 37332 - DNA, 24 bp, Artificial Sequence
  Synthetic
cccttgaaggatatgttccaatgt

SEQ ID NO: 37333 - DNA, 22 bp, Artificial Sequence
  Synthetic
gtgaaagcaggtaggcaattgt

SEQ ID NO: 37334 - DNA, 23 bp, Artificial Sequence
  Synthetic
ggcctttcttctttgttgctgtt

SEQ ID NO: 37335 - DNA, 23 bp, Artificial Sequence
  Synthetic
aaaccatctgcatttctcgtctt

SEQ ID NO: 37336 - DNA, 21 bp, Artificial Sequence
  Synthetic
tctcacccattttccgtctct

SEQ ID NO: 37337 - DNA, 21 bp, Artificial Sequence
  Synthetic
cttcaaatgctgcagaatggc

SEQ ID NO: 37338 - DNA, 25 bp, Artificial Sequence
  Synthetic
agttgcaatatgcttatcgaccttt

SEQ ID NO: 37339 - DNA, 23 bp, Artificial Sequence
  Synthetic
gttccaggagtattagctactgc

SEQ ID NO: 37340 - DNA, 24 bp, Artificial Sequence
  Synthetic
cacttctgaacaagatttggcttg

SEQ ID NO: 37341 - DNA, 25 bp, Artificial Sequence
  Synthetic
tctttatctttttgagttcgtgcca

SEQ ID NO: 37342 - DNA, 24 bp, Artificial Sequence
  Synthetic
cttctttatcctcatcgtcaagct

SEQ ID NO: 37343 - DNA, 25 bp, Artificial Sequence
  Synthetic
ttcatatttagagcctggatttccc

SEQ ID NO: 37344 - DNA, 22 bp, Artificial Sequence
  Synthetic
ccaatgtgggcaatgattgact

SEQ ID NO: 37345 - DNA, 21 bp, Artificial Sequence
  Synthetic
gggacgatatagggagcttca

SEQ ID NO: 37346 - DNA, 23 bp, Artificial Sequence
  Synthetic
ccaaaatttcctatcggggtacg

SEQ ID NO: 37347 - DNA, 23 bp, Artificial Sequence
  Synthetic
ccttgtaaaacgtaaggtgcttg

SEQ ID NO: 37348 - DNA, 20 bp, Artificial Sequence
  Synthetic
aaggtctcgtgaaaccgcta

SEQ ID NO: 37349 - DNA, 24 bp, Artificial Sequence
  Synthetic
ggacaaggttatctggatactcct

SEQ ID NO: 37350 - DNA, 20 bp, Artificial Sequence
  Synthetic
gaagttgtcccagtcgcctc

SEQ ID NO: 37351 - DNA, 23 bp, Artificial Sequence
  Synthetic
actgacaagatcgcaacacttac

SEQ ID NO: 37352 - DNA, 22 bp, Artificial Sequence
  Synthetic
ctggggcatattcttcaccatc

SEQ ID NO: 37353 - DNA, 25 bp, Artificial Sequence
  Synthetic
ccatagatgattttgaggtgaaggc

SEQ ID NO: 37354 - DNA, 21 bp, Artificial Sequence
  Synthetic
taccggcatcttgttgtgcag

SEQ ID NO: 37355 - DNA, 22 bp, Artificial Sequence
  Synthetic
aggtactaacgacaaagcgaca

SEQ ID NO: 37356 - DNA, 22 bp, Artificial Sequence
  Synthetic
agcgtaagaaaggccatttgag

SEQ ID NO: 37357 - DNA, 21 bp, Artificial Sequence
  Synthetic
ggttccatgtgtaggctggtc

SEQ ID NO: 37358 - DNA, 21 bp, Artificial Sequence
  Synthetic
gggaggtgaaatctggcaaac

SEQ ID NO: 37359 - DNA, 24 bp, Artificial Sequence
  Synthetic
cccataaattccaagaaccaccta

SEQ ID NO: 37360 - DNA, 20 bp, Artificial Sequence
  Synthetic
taccatctgcttgtcgctct

SEQ ID NO: 37361 - DNA, 21 bp, Artificial Sequence
  Synthetic
gccgtgtttatctgtcactgt

SEQ ID NO: 37362 - DNA, 21 bp, Artificial Sequence
  Synthetic
gttctgcaaagaggcgttcaa

SEQ ID NO: 37363 - DNA, 21 bp, Artificial Sequence
  Synthetic
ctgataaagtcctgccagacg

SEQ ID NO: 37364 - DNA, 23 bp, Artificial Sequence
  Synthetic
ttcccatatcatcacctctggat

SEQ ID NO: 37365 - DNA, 22 bp, Artificial Sequence
  Synthetic
atgacaaatcaaagccactgct

SEQ ID NO: 37366 - DNA, 25 bp, Artificial Sequence
  Synthetic
cgtcatagtcagttgtaattgcctt

SEQ ID NO: 37367 - DNA, 23 bp, Artificial Sequence
  Synthetic
gcttgactctgatcaatgccata

SEQ ID NO: 37368 - DNA, 25 bp, Artificial Sequence
  Synthetic
ccttcctcgatactacctttttgag

SEQ ID NO: 37369 - DNA, 22 bp, Artificial Sequence
  Synthetic
agtaacagaacgtttgaagcga

SEQ ID NO: 37370 - DNA, 22 bp, Artificial Sequence
  Synthetic
aaagccgctgaaaaagctatgc

SEQ ID NO: 37371 - DNA, 23 bp, Artificial Sequence
  Synthetic
cggacaagtgaaacaatcctgaa

SEQ ID NO: 37372 - DNA, 20 bp, Artificial Sequence
  Synthetic
ccgtccccattgaagcaaca

SEQ ID NO: 37373 - DNA, 22 bp, Artificial Sequence
  Synthetic
gagctgtgatggatggtgattg

SEQ ID NO: 37374 - DNA, 21 bp, Artificial Sequence
  Synthetic
tgaagatcgcgctctgctaaa

SEQ ID NO: 37375 - DNA, 21 bp, Artificial Sequence
  Synthetic
aaagcagccactaattccgtt

SEQ ID NO: 37376 - DNA, 20 bp, Artificial Sequence
  Synthetic
gtacgccttgtcttgatgca

SEQ ID NO: 37377 - DNA, 20 bp, Artificial Sequence
  Synthetic
agcttgcggtgactgtttct

SEQ ID NO: 37378 - DNA, 22 bp, Artificial Sequence
  Synthetic
ccagacggtaaatcttcgacaa

SEQ ID NO: 37379 - DNA, 21 bp, Artificial Sequence
  Synthetic
cgtggcttaatcgtcgtttct

SEQ ID NO: 37380 - DNA, 24 bp, Artificial Sequence
  Synthetic
gaactactcgataacccatgcaaa

SEQ ID NO: 37381 - DNA, 20 bp, Artificial Sequence
  Synthetic
tgcatgttggtagaatgccc

SEQ ID NO: 37382 - DNA, 23 bp, Artificial Sequence
  Synthetic
ggctgaataaatgctcgatttgg

SEQ ID NO: 37383 - DNA, 24 bp, Artificial Sequence
  Synthetic
tcaacgtgatctaatgctttttgc

SEQ ID NO: 37384 - DNA, 20 bp, Artificial Sequence
  Synthetic
gcatcaagatgataggcgca

SEQ ID NO: 37385 - DNA, 20 bp, Artificial Sequence
  Synthetic
gacagccttttccaagggca

SEQ ID NO: 37386 - DNA, 24 bp, Artificial Sequence
  Synthetic
cttttaagaaatcagccgcggtta

SEQ ID NO: 37387 - DNA, 20 bp, Artificial Sequence
  Synthetic
cccccaatgcttccaggaat

SEQ ID NO: 37388 - DNA, 20 bp, Artificial Sequence
  Synthetic
tgacctgcaaagtgtcctgg

SEQ ID NO: 37389 - DNA, 22 bp, Artificial Sequence
  Synthetic
ggcgtgttgtccttaatgcagc

SEQ ID NO: 37390 - DNA, 25 bp, Artificial Sequence
  Synthetic
ccgtttttatgactgaaatctcacc

SEQ ID NO: 37391 - DNA, 25 bp, Artificial Sequence
  Synthetic
gctaaaaaattagcctcaccatcaa

SEQ ID NO: 37392 - DNA, 21 bp, Artificial Sequence
  Synthetic
tggtctaggatttgccaaggt

SEQ ID NO: 37393 - DNA, 25 bp, Artificial Sequence
  Synthetic
ccatctaaaccttaccctatcagga

SEQ ID NO: 37394 - DNA, 23 bp, Artificial Sequence
  Synthetic
ccttagccatgttaaaaccagga

SEQ ID NO: 37395 - DNA, 22 bp, Artificial Sequence
  Synthetic
cgattgggatgacagaaccttt

SEQ ID NO: 37396 - DNA, 20 bp, Artificial Sequence
  Synthetic
ggcagcaacaggttatgtca

SEQ ID NO: 37397 - DNA, 20 bp, Artificial Sequence
  Synthetic
atcaccacggagcagagtac

SEQ ID NO: 37398 - DNA, 25 bp, Artificial Sequence
  Synthetic
ccatttggataaagaagaagccatc

SEQ ID NO: 37399 - DNA, 23 bp, Artificial Sequence
  Synthetic
tccctcgattgattgatgaactg

SEQ ID NO: 37400 - DNA, 25 bp, Artificial Sequence
  Synthetic
gtggacgattgatagttgatggtaa

SEQ ID NO: 37401 - DNA, 21 bp, Artificial Sequence
  Synthetic
tggaagcccatttgaccatct

SEQ ID NO: 37402 - DNA, 24 bp, Artificial Sequence
  Synthetic
cgttgtctatattgaagctgccaa

SEQ ID NO: 37403 - DNA, 20 bp, Artificial Sequence
  Synthetic
ggattgtccacacagcacca

SEQ ID NO: 37404 - DNA, 25 bp, Artificial Sequence
  Synthetic
tcttcctaataaagagccacaatgg

SEQ ID NO: 37405 - DNA, 22 bp, Artificial Sequence
  Synthetic
tctgcgaaaaaacctgaagacg

SEQ ID NO: 37406 - DNA, 23 bp, Artificial Sequence
  Synthetic
cgcttagcttaatgacacactca

SEQ ID NO: 37407 - DNA, 22 bp, Artificial Sequence
  Synthetic
aaggcatcgctgggtagctatg

SEQ ID NO: 37408 - DNA, 21 bp, Artificial Sequence
  Synthetic
agggccatcgctcaacggata

SEQ ID NO: 37409 - DNA, 20 bp, Artificial Sequence
  Synthetic
accgaagctgtggatgacac

SEQ ID NO: 37410 - DNA, 21 bp, Artificial Sequence
  Synthetic
aatgggtgagagcgtgccttt

SEQ ID NO: 37411 - DNA, 20 bp, Artificial Sequence
  Synthetic
tagctcagctgggagagcgc

SEQ ID NO: 37412 - DNA, 20 bp, Artificial Sequence
  Synthetic
tgttcttcaaggtgaacgcc

SEQ ID NO: 37413 - DNA, 20 bp, Artificial Sequence
  Synthetic
tcgacgttcttgcaacagca

SEQ ID NO: 37414 - DNA, 23 bp, Artificial Sequence
  Synthetic
gtgaaattatcgtgggtgatgct

SEQ ID NO: 37415 - DNA, 25 bp, Artificial Sequence
  Synthetic
gttttcgtttttgtccgtaatgaca

SEQ ID NO: 37416 - DNA, 22 bp, Artificial Sequence
  Synthetic
gcaatcttaccatcgcttgaca

SEQ ID NO: 37417 - DNA, 23 bp, Artificial Sequence
  Synthetic
tgacacgtgacttgatagcattt

SEQ ID NO: 37418 - DNA, 21 bp, Artificial Sequence
  Synthetic
gttggaaaaagcgcacacttc

SEQ ID NO: 37419 - DNA, 24 bp, Artificial Sequence
  Synthetic
agcaacttgattggcaatctcata

SEQ ID NO: 37420 - DNA, 24 bp, Artificial Sequence
  Synthetic
ctcgtatcttctgtctcatcgaca

SEQ ID NO: 37421 - DNA, 21 bp, Artificial Sequence
  Synthetic
tccgtttcaccagccttaact

SEQ ID NO: 37422 - DNA, 24 bp, Artificial Sequence
  Synthetic
gcgcatcaaaacctgttaagagac

SEQ ID NO: 37423 - DNA, 23 bp, Artificial Sequence
  Synthetic
ggcgtattgtttgagaaaagctg

SEQ ID NO: 37424 - DNA, 25 bp, Artificial Sequence
  Synthetic
ggattgtcattgagcctttcttgaa

SEQ ID NO: 37425 - DNA, 20 bp, Artificial Sequence
  Synthetic
gcgttacatggcagatgctg

SEQ ID NO: 37426 - DNA, 24 bp, Artificial Sequence
  Synthetic
gatgttgaaaacaataccgcgatc

SEQ ID NO: 37427 - DNA, 20 bp, Artificial Sequence
  Synthetic
ttggctgcttttaacagggc

SEQ ID NO: 37428 - DNA, 23 bp, Artificial Sequence
  Synthetic
tggaaaggtaacagttgcacttg

SEQ ID NO: 37429 - DNA, 24 bp, Artificial Sequence
  Synthetic
tcagttcttgagtacacagctttc

SEQ ID NO: 37430 - DNA, 20 bp, Artificial Sequence
  Synthetic
gcagtcgatcagtcagggtt

SEQ ID NO: 37431 - DNA, 20 bp, Artificial Sequence
  Synthetic
gatggctcaggcatatgctg

SEQ ID NO: 37432 - DNA, 20 bp, Artificial Sequence
  Synthetic
caaaacgtagtcccgcatca

SEQ ID NO: 37433 - DNA, 21 bp, Artificial Sequence
  Synthetic
gcctgggcctctctagcagta

SEQ ID NO: 37434 - DNA, 22 bp, Artificial Sequence
  Synthetic
cgggcagatgcatcacagcaaa

SEQ ID NO: 37435 - DNA, 21 bp, Artificial Sequence
  Synthetic
tcaaccgcagcacaaaatggc

SEQ ID NO: 37436 - DNA, 22 bp, Artificial Sequence
  Synthetic
gtccaaccctcattggcaacga

SEQ ID NO: 37437 - DNA, 22 bp, Artificial Sequence
  Synthetic
gggctcgtaaacctctggttcg

SEQ ID NO: 37438 - DNA, 22 bp, Artificial Sequence
  Synthetic
gtccgggctcattggtgtttga

SEQ ID NO: 37439 - DNA, 20 bp, Artificial Sequence
  Synthetic
gcagctggatcccttcgctg

SEQ ID NO: 37440 - DNA, 19 bp, Artificial Sequence
  Synthetic
cgcagtcttcacgccggac

SEQ ID NO: 37441 - DNA, 22 bp, Artificial Sequence
  Synthetic
tccacgtcatcatgccacaact

SEQ ID NO: 37442 - DNA, 21 bp, Artificial Sequence
  Synthetic
cctccacatccactcaggtgc

SEQ ID NO: 37443 - DNA, 20 bp, Artificial Sequence
  Synthetic
ttgtagaagcgggtggcgag

SEQ ID NO: 37444 - DNA, 22 bp, Artificial Sequence
  Synthetic
gctggttgagacacggttccat

SEQ ID NO: 37445 - DNA, 22 bp, Artificial Sequence
  Synthetic
gtggattggggccagaatgaca

SEQ ID NO: 37446 - DNA, 21 bp, Artificial Sequence
  Synthetic
caacatcaccagaccgccagt

SEQ ID NO: 37447 - DNA, 20 bp, Artificial Sequence
  Synthetic
tatgtgtagccggccttggt

SEQ ID NO: 37448 - DNA, 24 bp, Artificial Sequence
  Synthetic
ctaggactgccataacaaatgaca

SEQ ID NO: 37449 - DNA, 20 bp, Artificial Sequence
  Synthetic
ctgaaaaccttgtgcagcgg

SEQ ID NO: 37450 - DNA, 21 bp, Artificial Sequence
  Synthetic
aggtgcacaatcaacaagacg

SEQ ID NO: 37451 - DNA, 23 bp, Artificial Sequence
  Synthetic
gcgaatgtagcatcacgtctaac

SEQ ID NO: 37452 - DNA, 25 bp, Artificial Sequence
  Synthetic
tgtaagaacttcatgtagaccttcc

SEQ ID NO: 37453 - DNA, 24 bp, Artificial Sequence
  Synthetic
ggcataatccaaaacaaacaacca

SEQ ID NO: 37454 - DNA, 25 bp, Artificial Sequence
  Synthetic
tcatttatcgatggtacaacacaca

SEQ ID NO: 37455 - DNA, 24 bp, Artificial Sequence
  Synthetic
ccttcaaaagagtcaacaccatca

SEQ ID NO: 37456 - DNA, 24 bp, Artificial Sequence
  Synthetic
acaaacacctttatgtgagtcacg

SEQ ID NO: 37457 - DNA, 25 bp, Artificial Sequence
  Synthetic
gcataacaagcacaacgataatcag

SEQ ID NO: 37458 - DNA, 21 bp, Artificial Sequence
  Synthetic
atcagaaccaacatgagcacc

SEQ ID NO: 37459 - DNA, 23 bp, Artificial Sequence
  Synthetic
aattcagcagcactcaccttaaa

SEQ ID NO: 37460 - DNA, 25 bp, Artificial Sequence
  Synthetic
gatccattagcaatagcatcctcat

SEQ ID NO: 37461 - DNA, 22 bp, Artificial Sequence
  Synthetic
accagcttgtagacgaattgtg

SEQ ID NO: 37462 - DNA, 25 bp, Artificial Sequence
  Synthetic
acctaataggatccaaacaaccaat

SEQ ID NO: 37463 - DNA, 21 bp, Artificial Sequence
  Synthetic
catggattgctcgtgttccat

SEQ ID NO: 37464 - DNA, 23 bp, Artificial Sequence
  Synthetic
ttgccaagagatgcataaactct

SEQ ID NO: 37465 - DNA, 23 bp, Artificial Sequence
  Synthetic
attcagctgtgtcatagtaggga

SEQ ID NO: 37466 - DNA, 20 bp, Artificial Sequence
  Synthetic
tagagcccaacaccatggct

SEQ ID NO: 37467 - DNA, 22 bp, Artificial Sequence
  Synthetic
aacaaaactcatgtggtccctt

SEQ ID NO: 37468 - DNA, 20 bp, Artificial Sequence
  Synthetic
tggtgcacgtaaaggttgga

SEQ ID NO: 37469 - DNA, 21 bp, Artificial Sequence
  Synthetic
acatccatacccaaccaacca

SEQ ID NO: 37470 - DNA, 23 bp, Artificial Sequence
  Synthetic
aggttgcttgtcataacagtacc

SEQ ID NO: 37471 - DNA, 25 bp, Artificial Sequence
  Synthetic
tgtaaaaaccaagttgtcaacatcg

SEQ ID NO: 37472 - DNA, 20 bp, Artificial Sequence
  Synthetic
taaggttgagaggacgggcc

SEQ ID NO: 37473 - DNA, 25 bp, Artificial Sequence
  Synthetic
cagaataaaaaccatcctgcaatcc

SEQ ID NO: 37474 - DNA, 20 bp, Artificial Sequence
  Synthetic
cgtcctgctatacggcttga

SEQ ID NO: 37475 - DNA, 24 bp, Artificial Sequence
  Synthetic
caacagaaataatgagccaaaccc

SEQ ID NO: 37476 - DNA, 25 bp, Artificial Sequence
  Synthetic
gacatttagtacttcagctggaaca

SEQ ID NO: 37477 - DNA, 24 bp, Artificial Sequence
  Synthetic
ccgtaaacctggagagagatgatt

SEQ ID NO: 37478 - DNA, 21 bp, Artificial Sequence
  Synthetic
caccttccttagcaacccaaa

SEQ ID NO: 37479 - DNA, 23 bp, Artificial Sequence
  Synthetic
ccaaagtaacagcagcaacaaga

SEQ ID NO: 37480 - DNA, 22 bp, Artificial Sequence
  Synthetic
cgcagcctgattaggaatcaat

SEQ ID NO: 37481 - DNA, 20 bp, Artificial Sequence
  Synthetic
ttcctcacaatctgtcgcct

SEQ ID NO: 37482 - DNA, 21 bp, Artificial Sequence
  Synthetic
cgcgtcaggtctgtaaaactg

SEQ ID NO: 37483 - DNA, 21 bp, Artificial Sequence
  Synthetic
aaataatgcagcagccacact

SEQ ID NO: 37484 - DNA, 20 bp, Artificial Sequence
  Synthetic
ttcttgaaggtgccagctgg

SEQ ID NO: 37485 - DNA, 21 bp, Artificial Sequence
  Synthetic
agggttgggtagtcggagtgt

SEQ ID NO: 37486 - DNA, 21 bp, Artificial Sequence
  Synthetic
attttgaatgtcaggtgggca

SEQ ID NO: 37487 - DNA, 20 bp, Artificial Sequence
  Synthetic
cagcagggcctgtaggatct

SEQ ID NO: 37488 - DNA, 22 bp, Artificial Sequence
  Synthetic
tgtcacctgaaccattgctaac

SEQ ID NO: 37489 - DNA, 23 bp, Artificial Sequence
  Synthetic
cagacttgtcttgctgtaaagca

SEQ ID NO: 37490 - DNA, 23 bp, Artificial Sequence
  Synthetic
agatgaaaccatagagccacttg

SEQ ID NO: 37491 - DNA, 21 bp, Artificial Sequence
  Synthetic
tgctgcacaagtgaatgtcac

SEQ ID NO: 37492 - DNA, 25 bp, Artificial Sequence
  Synthetic
tgatattacattaccccccagtaca

SEQ ID NO: 37493 - DNA, 25 bp, Artificial Sequence
  Synthetic
ccactatgaaattcaacaagaggga

SEQ ID NO: 37494 - DNA, 23 bp, Artificial Sequence
  Synthetic
agcaggattttccacatcatcaa

SEQ ID NO: 37495 - DNA, 25 bp, Artificial Sequence
  Synthetic
atcgcctaaaatccaaatttccaaa

SEQ ID NO: 37496 - DNA, 21 bp, Artificial Sequence
  Synthetic
tcaccaacactctcaaggaca

SEQ ID NO: 37497 - DNA, 22 bp, Artificial Sequence
  Synthetic
tcgaattggctttgaatgtcct

SEQ ID NO: 37498 - DNA, 20 bp, Artificial Sequence
  Synthetic
ggcggtgaggtatcaagtcc

SEQ ID NO: 37499 - DNA, 22 bp, Artificial Sequence
  Synthetic
cttcctcaatgtctgccaaaga

SEQ ID NO: 37500 - DNA, 21 bp, Artificial Sequence
  Synthetic
acaacccttgaacagcaaact

SEQ ID NO: 37501 - DNA, 25 bp, Artificial Sequence
  Synthetic
tgtggatctttaaagtggtaagcac

SEQ ID NO: 37502 - DNA, 24 bp, Artificial Sequence
  Synthetic
cagatttccaatcttcctgatcca

SEQ ID NO: 37503 - DNA, 24 bp, Artificial Sequence
  Synthetic
acctgaatgatatttggtgggaaa

SEQ ID NO: 37504 - DNA, 21 bp, Artificial Sequence
  Synthetic
cttcccaatggcagtgtactc

SEQ ID NO: 37505 - DNA, 25 bp, Artificial Sequence
  Synthetic
tctgatctaggatcatccactgatg

SEQ ID NO: 37506 - DNA, 25 bp, Artificial Sequence
  Synthetic
gccagataatttagagttcgatggt

SEQ ID NO: 37507 - DNA, 20 bp, Artificial Sequence
  Synthetic
gatgaaaccaaggccccacc

SEQ ID NO: 37508 - DNA, 22 bp, Artificial Sequence
  Synthetic
agggcatagctgcaggaaaatt

SEQ ID NO: 37509 - DNA, 25 bp, Artificial Sequence
  Synthetic
aaatctcttttggtcaacttctcct

SEQ ID NO: 37510 - DNA, 25 bp, Artificial Sequence
  Synthetic
gaaaataactaatagctggacccca

SEQ ID NO: 37511 - DNA, 20 bp, Artificial Sequence
  Synthetic
ccgggaagtttttgagcgaa

SEQ ID NO: 37512 - DNA, 21 bp, Artificial Sequence
  Synthetic
ggcatagtcacgttcaatgct

SEQ ID NO: 37513 - DNA, 24 bp, Artificial Sequence
  Synthetic
gcctctagtttgtttctctggtac

SEQ ID NO: 37514 - DNA, 24 bp, Artificial Sequence
  Synthetic
tgtcctcaacatatttctcgaggt

SEQ ID NO: 37515 - DNA, 21 bp, Artificial Sequence
  Synthetic
aacacctttgatctggaaccg

SEQ ID NO: 37516 - DNA, 20 bp, Artificial Sequence
  Synthetic
atgtcctagaaacgcaggcg

SEQ ID NO: 37517 - DNA, 20 bp, Artificial Sequence
  Synthetic
atctgccatttctgcaagca

SEQ ID NO: 37518 - DNA, 20 bp, Artificial Sequence
  Synthetic
ccataaaccccaccccaaag

SEQ ID NO: 37519 - DNA, 20 bp, Artificial Sequence
  Synthetic
gatggttgctcgtttcccaa

SEQ ID NO: 37520 - DNA, 24 bp, Artificial Sequence
  Synthetic
tctcttctggcataaaagaagcaa

SEQ ID NO: 37521 - DNA, 23 bp, Artificial Sequence
  Synthetic
gcaatctgcatgaggaagcatac

SEQ ID NO: 37522 - DNA, 21 bp, Artificial Sequence
  Synthetic
tccatcgtgacaacttgagct

SEQ ID NO: 37523 - DNA, 21 bp, Artificial Sequence
  Synthetic
tgctgagcacttcctgacaat

SEQ ID NO: 37524 - DNA, 19 bp, Artificial Sequence
  Synthetic
cgacacgcgcgtggaacag

SEQ ID NO: 37525 - DNA, 19 bp, Artificial Sequence
  Synthetic
agagctccgagcgcgatcc

SEQ ID NO: 37526 - DNA, 19 bp, Artificial Sequence
  Synthetic
ggaagccatccgccctctc

SEQ ID NO: 37527 - DNA, 20 bp, Artificial Sequence
  Synthetic
cgaagtcccgcctcatgggc

SEQ ID NO: 37528 - DNA, 19 bp, Artificial Sequence
  Synthetic
tcggcagagtcttgccgcc

SEQ ID NO: 37529 - DNA, 21 bp, Artificial Sequence
  Synthetic
gctctgcctcccgtctctctc

SEQ ID NO: 37530 - DNA, 20 bp, Artificial Sequence
  Synthetic
tacccgggaggccggagaag

SEQ ID NO: 37531 - DNA, 19 bp, Artificial Sequence
  Synthetic
tggaaacacggcctgcgtc

SEQ ID NO: 37532 - DNA, 21 bp, Artificial Sequence
  Synthetic
tctctcgcttaccgttcatca

SEQ ID NO: 37533 - DNA, 22 bp, Artificial Sequence
  Synthetic
ctacttacttttttgcgcgtgg

SEQ ID NO: 37534 - DNA, 20 bp, Artificial Sequence
  Synthetic
gggtgcagtggctaagaagg

SEQ ID NO: 37535 - DNA, 20 bp, Artificial Sequence
  Synthetic
gaaatctccggcggggaatt

SEQ ID NO: 37536 - DNA, 20 bp, Artificial Sequence
  Synthetic
cgagagatgccaaactccga

SEQ ID NO: 37537 - DNA, 24 bp, Artificial Sequence
  Synthetic
ccgtcacgctaaatatgaatatgc

SEQ ID NO: 37538 - DNA, 21 bp, Artificial Sequence
  Synthetic
ggccacgagtacattcatgtt

SEQ ID NO: 37539 - DNA, 20 bp, Artificial Sequence
  Synthetic
tacggaacaaggccaaaccg

SEQ ID NO: 37540 - DNA, 23 bp, Artificial Sequence
  Synthetic
cataagcattttttggcgtcact

SEQ ID NO: 37541 - DNA, 21 bp, Artificial Sequence
  Synthetic
atagcctatggagtagcgcaa

SEQ ID NO: 37542 - DNA, 22 bp, Artificial Sequence
  Synthetic
gcccttgtaggatcacgagcca

SEQ ID NO: 37543 - DNA, 21 bp, Artificial Sequence
  Synthetic
gcgcgtctctctgtgcctcat

SEQ ID NO: 37544 - DNA, 20 bp, Artificial Sequence
  Synthetic
gctggtccggcagctctagg

SEQ ID NO: 37545 - DNA, 21 bp, Artificial Sequence
  Synthetic
cggcgttggtacgtttcccac

SEQ ID NO: 37546 - DNA, 20 bp, Artificial Sequence
  Synthetic
tacgcaccccacgcatacac

SEQ ID NO: 37547 - DNA, 21 bp, Artificial Sequence
  Synthetic
gccagataccttggagtctct

SEQ ID NO: 37548 - DNA, 25 bp, Artificial Sequence
  Synthetic
gaacttgccataggtttttcaaact

SEQ ID NO: 37549 - DNA, 22 bp, Artificial Sequence
  Synthetic
tgtaaatgtgaggccctatggg

SEQ ID NO: 37550 - DNA, 23 bp, Artificial Sequence
  Synthetic
tggttttctgtaattcgttgcct

SEQ ID NO: 37551 - DNA, 23 bp, Artificial Sequence
  Synthetic
actttcctgagtccactctagga

SEQ ID NO: 37552 - DNA, 22 bp, Artificial Sequence
  Synthetic
tgtctcccttgaaacaagcttt

SEQ ID NO: 37553 - DNA, 21 bp, Artificial Sequence
  Synthetic
gtagatggatggtgaatgccc

SEQ ID NO: 37554 - DNA, 23 bp, Artificial Sequence
  Synthetic
gcatttctttccattgcgaatgc

SEQ ID NO: 37555 - DNA, 20 bp, Artificial Sequence
  Synthetic
tcaatgaaaccggcaatggc

SEQ ID NO: 37556 - DNA, 20 bp, Artificial Sequence
  Synthetic
tccgatccgtcaggaccagc

SEQ ID NO: 37557 - DNA, 20 bp, Artificial Sequence
  Synthetic
acggggcctccctccgttag

SEQ ID NO: 37558 - DNA, 21 bp, Artificial Sequence
  Synthetic
ccgcttggttttccgtgtcac

SEQ ID NO: 37559 - DNA, 22 bp, Artificial Sequence
  Synthetic
cctcgccttgcaaactccgtta

SEQ ID NO: 37560 - DNA, 19 bp, Artificial Sequence
  Synthetic
acggcgtctgcgtctccct

SEQ ID NO: 37561 - DNA, 22 bp, Artificial Sequence
  Synthetic
cccggtatggatctcacggtca

SEQ ID NO: 37562 - DNA, 25 bp, Artificial Sequence
  Synthetic
tcactgtcataaaaaagacacacca

SEQ ID NO: 37563 - DNA, 22 bp, Artificial Sequence
  Synthetic
gatatgtttctgcctggggaaa

SEQ ID NO: 37564 - DNA, 21 bp, Artificial Sequence
  Synthetic
acgagaaggtttgtctcaggg

SEQ ID NO: 37565 - DNA, 23 bp, Artificial Sequence
  Synthetic
ggctaagaaggctgtcagttctt

SEQ ID NO: 37566 - DNA, 23 bp, Artificial Sequence
  Synthetic
ccaaggtacgcctaaggttaaat

SEQ ID NO: 37567 - DNA, 21 bp, Artificial Sequence
  Synthetic
cgacaacgtttcctgtaagct

SEQ ID NO: 37568 - DNA, 20 bp, Artificial Sequence
  Synthetic
cttttctccgccttcccgat

SEQ ID NO: 37569 - DNA, 20 bp, Artificial Sequence
  Synthetic
taacgccacagcctgttctt

SEQ ID NO: 37570 - DNA, 20 bp, Artificial Sequence
  Synthetic
cactgaagcaaagcaccctg

SEQ ID NO: 37571 - DNA, 22 bp, Artificial Sequence
  Synthetic
tgcgaaaaagagttgggattcc

SEQ ID NO: 37572 - DNA, 20 bp, Artificial Sequence
  Synthetic
ttatcgcgagcgctgaacat

SEQ ID NO: 37573 - DNA, 18 bp, Artificial Sequence
  Synthetic
atctgccgcgtggaagcc

SEQ ID NO: 37574 - DNA, 22 bp, Artificial Sequence
  Synthetic
agctctgttctctcccactcca

SEQ ID NO: 37575 - DNA, 19 bp, Artificial Sequence
  Synthetic
acggcgcgcgcatagactc

SEQ ID NO: 37576 - DNA, 19 bp, Artificial Sequence
  Synthetic
acgttcgacgccagacggc

SEQ ID NO: 37577 - DNA, 24 bp, Artificial Sequence
  Synthetic
actgctttgtccatgttatttgga

SEQ ID NO: 37578 - DNA, 24 bp, Artificial Sequence
  Synthetic
tccacaatatcaagtgcaagatcc

SEQ ID NO: 37579 - DNA, 21 bp, Artificial Sequence
  Synthetic
accagtctcgtgacatttcct

SEQ ID NO: 37580 - DNA, 22 bp, Artificial Sequence
  Synthetic
gactcgaaccgtgttaccattc

SEQ ID NO: 37581 - DNA, 21 bp, Artificial Sequence
  Synthetic
tgtgagctgtctagttggtct

SEQ ID NO: 37582 - DNA, 20 bp, Artificial Sequence
  Synthetic
tgttgtcacgctgtagctgc

SEQ ID NO: 37583 - DNA, 21 bp, Artificial Sequence
  Synthetic
ttcttctagcacttcaaccgc

SEQ ID NO: 37584 - DNA, 23 bp, Artificial Sequence
  Synthetic
cacaatgcaagcaataccatacc

SEQ ID NO: 37585 - DNA, 25 bp, Artificial Sequence
  Synthetic
ccatctgagttaaactaaactgtgc

SEQ ID NO: 37586 - DNA, 20 bp, Artificial Sequence
  Synthetic
tctccatcctcgtcctctgt

SEQ ID NO: 37587 - DNA, 20 bp, Artificial Sequence
  Synthetic
cactacatccgtccactgca

SEQ ID NO: 37588 - DNA, 21 bp, Artificial Sequence
  Synthetic
gcaggaacagaaggaaacact

SEQ ID NO: 37589 - DNA, 20 bp, Artificial Sequence
  Synthetic
ggcaccgatacatcgccatt

SEQ ID NO: 37590 - DNA, 24 bp, Artificial Sequence
  Synthetic
ggaggagtacagcctacaatacat

SEQ ID NO: 37591 - DNA, 20 bp, Artificial Sequence
  Synthetic
tacgtttgggggtgactgac

SEQ ID NO: 37592 - DNA, 24 bp, Artificial Sequence
  Synthetic
caccctaatagtacatattgggcg

SEQ ID NO: 37593 - DNA, 20 bp, Artificial Sequence
  Synthetic
atccatggatgtcctgggtg

SEQ ID NO: 37594 - DNA, 22 bp, Artificial Sequence
  Synthetic
gtggaagtgttggtacgttacc

SEQ ID NO: 37595 - DNA, 21 bp, Artificial Sequence
  Synthetic
tgcatgtgtgttttggcatgt

SEQ ID NO: 37596 - DNA, 22 bp, Artificial Sequence
  Synthetic
ctatgctcccatctctgctaca

SEQ ID NO: 37597 - DNA, 25 bp, Artificial Sequence
  Synthetic
cctcaaagctatgttgtaactgtgt

SEQ ID NO: 37598 - DNA, 21 bp, Artificial Sequence
  Synthetic
accatcatccaccttgctaca

SEQ ID NO: 37599 - DNA, 23 bp, Artificial Sequence
  Synthetic
ccctcatagcttactgcagaaga

SEQ ID NO: 37600 - DNA, 25 bp, Artificial Sequence
  Synthetic
ggtggatgatacagtaacaaacagt

SEQ ID NO: 37601 - DNA, 23 bp, Artificial Sequence
  Synthetic
cacaatggttgcaagtttacagg

SEQ ID NO: 37602 - DNA, 23 bp, Artificial Sequence
  Synthetic
tggtgaaaaggttaacgttgtgt

SEQ ID NO: 37603 - DNA, 24 bp, Artificial Sequence
  Synthetic
gcgacaaacctatattccagtctt

SEQ ID NO: 37604 - DNA, 22 bp, Artificial Sequence
  Synthetic
ggaatgtccagcctcatctgca

SEQ ID NO: 37605 - DNA, 20 bp, Artificial Sequence
  Synthetic
ttgtgccatgcctgtttggt

SEQ ID NO: 37606 - DNA, 22 bp, Artificial Sequence
  Synthetic
gtccctagcattgcatcctttc

SEQ ID NO: 37607 - DNA, 25 bp, Artificial Sequence
  Synthetic
cctttattcttgagatgtggacaca

SEQ ID NO: 37608 - DNA, 21 bp, Artificial Sequence
  Synthetic
ccttcaccacctgctgtgatt

SEQ ID NO: 37609 - DNA, 23 bp, Artificial Sequence
  Synthetic
gtgtcaaggttgctatgatcgtt

SEQ ID NO: 37610 - DNA, 21 bp, Artificial Sequence
  Synthetic
aaaagaccttcaagcgctgaa

SEQ ID NO: 37611 - DNA, 24 bp, Artificial Sequence
  Synthetic
caattcatccacacattctgcttc

SEQ ID NO: 37612 - DNA, 23 bp, Artificial Sequence
  Synthetic
accgtaacccaattatcagagca

SEQ ID NO: 37613 - DNA, 23 bp, Artificial Sequence
  Synthetic
acaatttaaaaaagcagccgcat

SEQ ID NO: 37614 - DNA, 25 bp, Artificial Sequence
  Synthetic
gttttgcatcaacactcatcatgtt

SEQ ID NO: 37615 - DNA, 25 bp, Artificial Sequence
  Synthetic
catcagcattctaattgcttgcata

SEQ ID NO: 37616 - DNA, 22 bp, Artificial Sequence
  Synthetic
tgtcgtctgttttccggttggt

SEQ ID NO: 37617 - DNA, 20 bp, Artificial Sequence
  Synthetic
atcagtcagagggtcgatgg

SEQ ID NO: 37618 - DNA, 24 bp, Artificial Sequence
  Synthetic
aaataaggatgtcctgtgcatgaa

SEQ ID NO: 37619 - DNA, 25 bp, Artificial Sequence
  Synthetic
atagtcagtaccttccattggaatg

SEQ ID NO: 37620 - DNA, 23 bp, Artificial Sequence
  Synthetic
ttttctgcagtaggacatttcgt

SEQ ID NO: 37621 - DNA, 21 bp, Artificial Sequence
  Synthetic
gcctcatctgccaggcctacc

SEQ ID NO: 37622 - DNA, 20 bp, Artificial Sequence
  Synthetic
gaaacacggacacccaaagt

SEQ ID NO: 37623 - DNA, 23 bp, Artificial Sequence
  Synthetic
aagctggatttgtaagtgcttct

SEQ ID NO: 37624 - DNA, 25 bp, Artificial Sequence
  Synthetic
ccatatctttaaggcaatcaggcaa

SEQ ID NO: 37625 - DNA, 24 bp, Artificial Sequence
  Synthetic
cccctgttttacagactgtctagc

SEQ ID NO: 37626 - DNA, 23 bp, Artificial Sequence
  Synthetic
gtccatgggtatcacaactatgg

SEQ ID NO: 37627 - DNA, 20 bp, Artificial Sequence
  Synthetic
tgcaaaaccattcgccacct

SEQ ID NO: 37628 - DNA, 21 bp, Artificial Sequence
  Synthetic
agctgaacccaatccagtgaa

SEQ ID NO: 37629 - DNA, 23 bp, Artificial Sequence
  Synthetic
tccagtagtgtcatctggtttct

SEQ ID NO: 37630 - DNA, 20 bp, Artificial Sequence
  Synthetic
gggtctggaggaagggagta

SEQ ID NO: 37631 - DNA, 20 bp, Artificial Sequence
  Synthetic
tagaagcgcctgtcaatggc

SEQ ID NO: 37632 - DNA, 20 bp, Artificial Sequence
  Synthetic
taggcatgcctgtgtatggt

SEQ ID NO: 37633 - DNA, 20 bp, Artificial Sequence
  Synthetic
gcactgcaccacattgacct

SEQ ID NO: 37634 - DNA, 20 bp, Artificial Sequence
  Synthetic
tccttggggtgtaaagctgc

SEQ ID NO: 37635 - DNA, 20 bp, Artificial Sequence
  Synthetic
tctggattacaccccacagc

SEQ ID NO: 37636 - DNA, 25 bp, Artificial Sequence
  Synthetic
tgattatggccatatgatccacagt

SEQ ID NO: 37637 - DNA, 22 bp, Artificial Sequence
  Synthetic
ccaagttacagctaggggagac

SEQ ID NO: 37638 - DNA, 25 bp, Artificial Sequence
  Synthetic
ctctgatgtcaatattctagctccc

SEQ ID NO: 37639 - DNA, 20 bp, Artificial Sequence
  Synthetic
ggttgcctgtaagcacttcc

SEQ ID NO: 37640 - DNA, 24 bp, Artificial Sequence
  Synthetic
gttcaatctttggtttgctctgtt

SEQ ID NO: 37641 - DNA, 20 bp, Artificial Sequence
  Synthetic
gttcccctgctgatctcgga

SEQ ID NO: 37642 - DNA, 23 bp, Artificial Sequence
  Synthetic
ttggcgaaaaaaacaccgtaatc

SEQ ID NO: 37643 - DNA, 21 bp, Artificial Sequence
  Synthetic
ggatttacagccttgccctgg

SEQ ID NO: 37644 - DNA, 20 bp, Artificial Sequence
  Synthetic
tgtaaacagccgctcgcctc

SEQ ID NO: 37645 - DNA, 21 bp, Artificial Sequence
  Synthetic
tgaactatcctccacaagccg

SEQ ID NO: 37646 - DNA, 20 bp, Artificial Sequence
  Synthetic
ctccacaggtgcatggctgc

SEQ ID NO: 37647 - DNA, 22 bp, Artificial Sequence
  Synthetic
gcatcgttctccaacagcagct

SEQ ID NO: 37648 - DNA, 22 bp, Artificial Sequence
  Synthetic
gtccaccgttgatcccatcaca

SEQ ID NO: 37649 - DNA, 21 bp, Artificial Sequence
  Synthetic
gggatctgggcggtaacatcg

SEQ ID NO: 37650 - DNA, 20 bp, Artificial Sequence
  Synthetic
cgtagagcacgtcaccgagc

SEQ ID NO: 37651 - DNA, 21 bp, Artificial Sequence
  Synthetic
tgcccgctcttgagagggaat

SEQ ID NO: 37652 - DNA, 21 bp, Artificial Sequence
  Synthetic
gagcgcaccactgtttttccc

SEQ ID NO: 37653 - DNA, 22 bp, Artificial Sequence
  Synthetic
tcccacctacatcggcatcctc

SEQ ID NO: 37654 - DNA, 20 bp, Artificial Sequence
  Synthetic
cgtggagaagggctgctgtc

SEQ ID NO: 37655 - DNA, 22 bp, Artificial Sequence
  Synthetic
ggcacaacatcaacggctttga

SEQ ID NO: 37656 - DNA, 21 bp, Artificial Sequence
  Synthetic
gcgatcttgccgtgcgcttac

SEQ ID NO: 37657 - DNA, 22 bp, Artificial Sequence
  Synthetic
acgcgctgtgtatcttgtggat

SEQ ID NO: 37658 - DNA, 19 bp, Artificial Sequence
  Synthetic
agaggcggcagatccagga

SEQ ID NO: 37659 - DNA, 20 bp, Artificial Sequence
  Synthetic
ccttgcgcaggtggtcatgc

SEQ ID NO: 37660 - DNA, 20 bp, Artificial Sequence
  Synthetic
cgtcccctacgccgcaattg

SEQ ID NO: 37661 - DNA, 20 bp, Artificial Sequence
  Synthetic
ccgcatggaagactccgcct

SEQ ID NO: 37662 - DNA, 21 bp, Artificial Sequence
  Synthetic
ggcctaacccgtttgcgttcc

SEQ ID NO: 37663 - DNA, 18 bp, Artificial Sequence
  Synthetic
aaccgggttctgccgcga

SEQ ID NO: 37664 - DNA, 22 bp, Artificial Sequence
  Synthetic
cgcgtaaaacttgcccaggctc

SEQ ID NO: 37665 - DNA, 20 bp, Artificial Sequence
  Synthetic
tcacggaggcgtcagtaccc

SEQ ID NO: 37666 - DNA, 19 bp, Artificial Sequence
  Synthetic
tgtacaccagcccggcctc

SEQ ID NO: 37667 - DNA, 19 bp, Artificial Sequence
  Synthetic
gttcaccgtctgcaggccc

SEQ ID NO: 37668 - DNA, 21 bp, Artificial Sequence
  Synthetic
agcaggaagtttagggtggcc

SEQ ID NO: 37669 - DNA, 20 bp, Artificial Sequence
  Synthetic
ggaggagaggacaccaccgc

SEQ ID NO: 37670 - DNA, 22 bp, Artificial Sequence
  Synthetic
tccaatatcgctctccagcacg

SEQ ID NO: 37671 - DNA, 20 bp, Artificial Sequence
  Synthetic
cactgccttctgtagcgtct

SEQ ID NO: 37672 - DNA, 20 bp, Artificial Sequence
  Synthetic
ggggtcttgcatgaggtccg

SEQ ID NO: 37673 - DNA, 19 bp, Artificial Sequence
  Synthetic
tagggacaggtgcggcgac

SEQ ID NO: 37674 - DNA, 19 bp, Artificial Sequence
  Synthetic
tgctagagatggccgcggc

SEQ ID NO: 37675 - DNA, 19 bp, Artificial Sequence
  Synthetic
ccaatttacgcgccgccgc

SEQ ID NO: 37676 - DNA, 22 bp, Artificial Sequence
  Synthetic
taaaggcggtggaggctgggag

SEQ ID NO: 37677 - DNA, 18 bp, Artificial Sequence
  Synthetic
cgcaggcggcaagtgaga

SEQ ID NO: 37678 - DNA, 19 bp, Artificial Sequence
  Synthetic
cgggttcaggcggctgttt

SEQ ID NO: 37679 - DNA, 19 bp, Artificial Sequence
  Synthetic
agtacgtgtcggtggcgcg

SEQ ID NO: 37680 - DNA, 24 bp, Artificial Sequence
  Synthetic
accgtatgtgtgagtttttgtagt

SEQ ID NO: 37681 - DNA, 21 bp, Artificial Sequence
  Synthetic
ggtaagacagctccgtgtttc

SEQ ID NO: 37682 - DNA, 22 bp, Artificial Sequence
  Synthetic
cgttggccggcgtgtacttaaa

SEQ ID NO: 37683 - DNA, 20 bp, Artificial Sequence
  Synthetic
taagcagccggtcattgccg

SEQ ID NO: 37684 - DNA, 21 bp, Artificial Sequence
  Synthetic
ccggtgaagcccgagttgttg

SEQ ID NO: 37685 - DNA, 20 bp, Artificial Sequence
  Synthetic
taatgcccgtgcactgcgag

SEQ ID NO: 37686 - DNA, 22 bp, Artificial Sequence
  Synthetic
aggaccatgtggtggagatgga

SEQ ID NO: 37687 - DNA, 21 bp, Artificial Sequence
  Synthetic
cctgcgcgatgcttacaagct

SEQ ID NO: 37688 - DNA, 20 bp, Artificial Sequence
  Synthetic
agggtctcggggtcgctaaa

SEQ ID NO: 37689 - DNA, 22 bp, Artificial Sequence
  Synthetic
cctcgatcacgtccgagtggta

SEQ ID NO: 37690 - DNA, 20 bp, Artificial Sequence
  Synthetic
ccgtaagatccgcgtgctgc

SEQ ID NO: 37691 - DNA, 20 bp, Artificial Sequence
  Synthetic
catgcggacttcggccagtg

SEQ ID NO: 37692 - DNA, 23 bp, Artificial Sequence
  Synthetic
ctcaccacaaagagtacagcaaa

SEQ ID NO: 37693 - DNA, 23 bp, Artificial Sequence
  Synthetic
ccatcacaaaactgcattccctt

SEQ ID NO: 37694 - DNA, 23 bp, Artificial Sequence
  Synthetic
ccttactttgtttagccccgttt

SEQ ID NO: 37695 - DNA, 20 bp, Artificial Sequence
  Synthetic
gcaggtgagcagggcaaaga

SEQ ID NO: 37696 - DNA, 21 bp, Artificial Sequence
  Synthetic
gcaggagcagaccatcactat

SEQ ID NO: 37697 - DNA, 20 bp, Artificial Sequence
  Synthetic
gttgacgcccaccatgcagg

SEQ ID NO: 37698 - DNA, 21 bp, Artificial Sequence
  Synthetic
tggaatccattggaggagaca

SEQ ID NO: 37699 - DNA, 20 bp, Artificial Sequence
  Synthetic
tgataagccaccgccttctg

SEQ ID NO: 37700 - DNA, 25 bp, Artificial Sequence
  Synthetic
tgcatattttttagagccagtggta

SEQ ID NO: 37701 - DNA, 25 bp, Artificial Sequence
  Synthetic
gctgcacttactgtgaaaacatgag

SEQ ID NO: 37702 - DNA, 22 bp, Artificial Sequence
  Synthetic
ggcctacagagtcctggctgat

SEQ ID NO: 37703 - DNA, 24 bp, Artificial Sequence
  Synthetic
aaaatgagaattacctggggatgg

SEQ ID NO: 37704 - DNA, 22 bp, Artificial Sequence
  Synthetic
ggcattaccggagacacaaaga

SEQ ID NO: 37705 - DNA, 21 bp, Artificial Sequence
  Synthetic
aagacaggagcttactgtgct

SEQ ID NO: 37706 - DNA, 25 bp, Artificial Sequence
  Synthetic
tcagctaggtcagtaagtagttagt

SEQ ID NO: 37707 - DNA, 22 bp, Artificial Sequence
  Synthetic
cctctagatccgcattctctct

SEQ ID NO: 37708 - DNA, 20 bp, Artificial Sequence
  Synthetic
ttccaggggcaaagtctcca

SEQ ID NO: 37709 - DNA, 24 bp, Artificial Sequence
  Synthetic
cgtttattgtttgcctggcttagt

SEQ ID NO: 37710 - DNA, 21 bp, Artificial Sequence
  Synthetic
gctgctagtttccatgcttct

SEQ ID NO: 37711 - DNA, 21 bp, Artificial Sequence
  Synthetic
gtggaacttttgggctggttt

SEQ ID NO: 37712 - DNA, 21 bp, Artificial Sequence
  Synthetic
ttcgtgtgagaatctggggaa

SEQ ID NO: 37713 - DNA, 24 bp, Artificial Sequence
  Synthetic
tctccagatctaactgttcttcgt

SEQ ID NO: 37714 - DNA, 24 bp, Artificial Sequence
  Synthetic
agagtttttgggaccttagcaatt

SEQ ID NO: 37715 - DNA, 21 bp, Artificial Sequence
  Synthetic
tttccatgcaagttggctcat

SEQ ID NO: 37716 - DNA, 24 bp, Artificial Sequence
  Synthetic
ttgatgttggtagaggactttgtc

SEQ ID NO: 37717 - DNA, 25 bp, Artificial Sequence
  Synthetic
tgattcactggtattctgtttgtcc

SEQ ID NO: 37718 - DNA, 25 bp, Artificial Sequence
  Synthetic
tcttacttgttgtacacctgattgg

SEQ ID NO: 37719 - DNA, 24 bp, Artificial Sequence
  Synthetic
cacttcctacactcggatacattg

SEQ ID NO: 37720 - DNA, 22 bp, Artificial Sequence
  Synthetic
agtgtggttgtagcaacattga

SEQ ID NO: 37721 - DNA, 24 bp, Artificial Sequence
  Synthetic
tgtttaaggattttgcctagcgat

SEQ ID NO: 37722 - DNA, 25 bp, Artificial Sequence
  Synthetic
ccttttgctagtagtgtttctgcta

SEQ ID NO: 37723 - DNA, 21 bp, Artificial Sequence
  Synthetic
ccattgctgacactctgacac

SEQ ID NO: 37724 - DNA, 23 bp, Artificial Sequence
  Synthetic
accacattttttgcctcaatcct

SEQ ID NO: 37725 - DNA, 20 bp, Artificial Sequence
  Synthetic
agtgctgcttccatccatga

SEQ ID NO: 37726 - DNA, 23 bp, Artificial Sequence
  Synthetic
ccagtcctctaagacttctggta

SEQ ID NO: 37727 - DNA, 21 bp, Artificial Sequence
  Synthetic
ttgcgctggaactttcaagaa

SEQ ID NO: 37728 - DNA, 23 bp, Artificial Sequence
  Synthetic
tccatcgtttcaagacacgaatt

SEQ ID NO: 37729 - DNA, 25 bp, Artificial Sequence
  Synthetic
tgtgttgttatttccatctcctctt

SEQ ID NO: 37730 - DNA, 21 bp, Artificial Sequence
  Synthetic
gcccagactgttcaagtttct

SEQ ID NO: 37731 - DNA, 23 bp, Artificial Sequence
  Synthetic
ggtgtatttcttttgcccgagat

SEQ ID NO: 37732 - DNA, 22 bp, Artificial Sequence
  Synthetic
ccattagctcccatttcaagca

SEQ ID NO: 37733 - DNA, 20 bp, Artificial Sequence
  Synthetic
gcacggtcccatagatgagt

SEQ ID NO: 37734 - DNA, 22 bp, Artificial Sequence
  Synthetic
ggtccgtaacaggaatggtccc

SEQ ID NO: 37735 - DNA, 21 bp, Artificial Sequence
  Synthetic
tgctactgtttccctgctctt

SEQ ID NO: 37736 - DNA, 21 bp, Artificial Sequence
  Synthetic
gccagcacactttcatctgtt

SEQ ID NO: 37737 - DNA, 21 bp, Artificial Sequence
  Synthetic
cgcttggtccgtaaaatacca

SEQ ID NO: 37738 - DNA, 20 bp, Artificial Sequence
  Synthetic
cggtcggctagtgactccat

SEQ ID NO: 37739 - DNA, 20 bp, Artificial Sequence
  Synthetic
tccagggttcatgcgcatat

SEQ ID NO: 37740 - DNA, 23 bp, Artificial Sequence
  Synthetic
agaaaaacaccaaaaatgcgctt

SEQ ID NO: 37741 - DNA, 20 bp, Artificial Sequence
  Synthetic
acgacccccagtaccagagc

SEQ ID NO: 37742 - DNA, 22 bp, Artificial Sequence
  Synthetic
cagcatccgatggaatgggact

SEQ ID NO: 37743 - DNA, 20 bp, Artificial Sequence
  Synthetic
gaatgtggatgggtggcagg

SEQ ID NO: 37744 - DNA, 24 bp, Artificial Sequence
  Synthetic
tgcaaactacaatagggatgtcct

SEQ ID NO: 37745 - DNA, 20 bp, Artificial Sequence
  Synthetic
ggtagagggtggtggtacca

SEQ ID NO: 37746 - DNA, 23 bp, Artificial Sequence
  Synthetic
tgttccaaactgtgtgtgttagc

SEQ ID NO: 37747 - DNA, 19 bp, Artificial Sequence
  Synthetic
gccaatggcggctcggaaa

SEQ ID NO: 37748 - DNA, 21 bp, Artificial Sequence
  Synthetic
gcaacgacaaatgagggtgag

SEQ ID NO: 37749 - DNA, 21 bp, Artificial Sequence
  Synthetic
agaaagacgctcctacgccga

SEQ ID NO: 37750 - DNA, 16 bp, Artificial Sequence
  Synthetic
agcaagcggcgcccat

SEQ ID NO: 37751 - DNA, 22 bp, Artificial Sequence
  Synthetic
gcccatcgtacacgagcttcca

SEQ ID NO: 37752 - DNA, 20 bp, Artificial Sequence
  Synthetic
actccaagccagtcgtacgc

SEQ ID NO: 37753 - DNA, 21 bp, Artificial Sequence
  Synthetic
agtgggaaatacctctcctgg

SEQ ID NO: 37754 - DNA, 22 bp, Artificial Sequence
  Synthetic
cgggacgcattcctggatttcg

SEQ ID NO: 37755 - DNA, 22 bp, Artificial Sequence
  Synthetic
tccactctatccacttcgccga

SEQ ID NO: 37756 - DNA, 22 bp, Artificial Sequence
  Synthetic
tctccgctccgaagttagggat

SEQ ID NO: 37757 - DNA, 19 bp, Artificial Sequence
  Synthetic
acggccccttgagcaaccg

SEQ ID NO: 37758 - DNA, 19 bp, Artificial Sequence
  Synthetic
taggcggtcgcgtggtctg

SEQ ID NO: 37759 - DNA, 19 bp, Artificial Sequence
  Synthetic
ctcccccaaagcggccaat

SEQ ID NO: 37760 - DNA, 21 bp, Artificial Sequence
  Synthetic
gaaagtgcatccgccaaccac

SEQ ID NO: 37761 - DNA, 21 bp, Artificial Sequence
  Synthetic
caggtatggggtcctctggga

SEQ ID NO: 37762 - DNA, 19 bp, Artificial Sequence
  Synthetic
tgtcaccagctgcccccca

SEQ ID NO: 37763 - DNA, 19 bp, Artificial Sequence
  Synthetic
acgtcccgtctttccgccg

SEQ ID NO: 37764 - DNA, 21 bp, Artificial Sequence
  Synthetic
ggggatctccagtgcgctttc

SEQ ID NO: 37765 - DNA, 21 bp, Artificial Sequence
  Synthetic
taacgggcagtgcgtggggta

SEQ ID NO: 37766 - DNA, 21 bp, Artificial Sequence
  Synthetic
ggaggtgtctgtggtgggcta

SEQ ID NO: 37767 - DNA, 19 bp, Artificial Sequence
  Synthetic
cgagcgttcaaggggaggg

SEQ ID NO: 37768 - DNA, 19 bp, Artificial Sequence
  Synthetic
tctcgtgcggaaccttggc

SEQ ID NO: 37769 - DNA, 22 bp, Artificial Sequence
  Synthetic
cgtcctctgacaccaccttagc

SEQ ID NO: 37770 - DNA, 22 bp, Artificial Sequence
  Synthetic
gcagcaggatgaacaggagcag

SEQ ID NO: 37771 - DNA, 22 bp, Artificial Sequence
  Synthetic
gtcttcctccccaatccctcca

SEQ ID NO: 37772 - DNA, 18 bp, Artificial Sequence
  Synthetic
actaccgctgcgtggcac

SEQ ID NO: 37773 - DNA, 21 bp, Artificial Sequence
  Synthetic
gcaacgccctggtatacctgg

SEQ ID NO: 37774 - DNA, 21 bp, Artificial Sequence
  Synthetic
cactgtccatctcctcggctg

SEQ ID NO: 37775 - DNA, 19 bp, Artificial Sequence
  Synthetic
agagtgcccgacacggtgg

SEQ ID NO: 37776 - DNA, 20 bp, Artificial Sequence
  Synthetic
ggttcagcggcttgccaagg

SEQ ID NO: 37777 - DNA, 22 bp, Artificial Sequence
  Synthetic
agatgttcctagggcatggatt

SEQ ID NO: 37778 - DNA, 23 bp, Artificial Sequence
  Synthetic
ctaggaacgacacaaactctacc

SEQ ID NO: 37779 - DNA, 22 bp, Artificial Sequence
  Synthetic
gccgactcgtgtcattccacat

SEQ ID NO: 37780 - DNA, 22 bp, Artificial Sequence
  Synthetic
ggtgctagacacagatgcggat

SEQ ID NO: 37781 - DNA, 20 bp, Artificial Sequence
  Synthetic
cgctgttcaacgctggtgta

SEQ ID NO: 37782 - DNA, 25 bp, Artificial Sequence
  Synthetic
aggataagaatcaccaacagacatt

SEQ ID NO: 37783 - DNA, 22 bp, Artificial Sequence
  Synthetic
cacttcgaagccaccagtacca

SEQ ID NO: 37784 - DNA, 20 bp, Artificial Sequence
  Synthetic
aaggcaccgaaccctgtttc

SEQ ID NO: 37785 - DNA, 21 bp, Artificial Sequence
  Synthetic
aagcagttccagggaatttcc

SEQ ID NO: 37786 - DNA, 25 bp, Artificial Sequence
  Synthetic
ctgtgtaaccccaatagaatcttca

SEQ ID NO: 37787 - DNA, 25 bp, Artificial Sequence
  Synthetic
ctgttaaaggctgtaaccaaaagtg

SEQ ID NO: 37788 - DNA, 25 bp, Artificial Sequence
  Synthetic
tgatattcctttctgccttgcataa

SEQ ID NO: 37789 - DNA, 21 bp, Artificial Sequence
  Synthetic
gtgttggagccttccccgatg

SEQ ID NO: 37790 - DNA, 20 bp, Artificial Sequence
  Synthetic
acacctgcttccagttcagg

SEQ ID NO: 37791 - DNA, 22 bp, Artificial Sequence
  Synthetic
gttcaaaggtgagggtgacatc

SEQ ID NO: 37792 - DNA, 23 bp, Artificial Sequence
  Synthetic
cacataatcatctgtgctgagca

SEQ ID NO: 37793 - DNA, 22 bp, Artificial Sequence
  Synthetic
tcctaaaggacctcctctgatg

SEQ ID NO: 37794 - DNA, 23 bp, Artificial Sequence
  Synthetic
gtctgattctcctcattcacctg

SEQ ID NO: 37795 - DNA, 22 bp, Artificial Sequence
  Synthetic
atcttttcaggtgtaggggtct

SEQ ID NO: 37796 - DNA, 25 bp, Artificial Sequence
  Synthetic
tttttccaccaatgttaaaacacgt

SEQ ID NO: 37797 - DNA, 20 bp, Artificial Sequence
  Synthetic
ttctgctatgccactgtcct

SEQ ID NO: 37798 - DNA, 25 bp, Artificial Sequence
  Synthetic
tttagtaacccaatctggtaacgac

SEQ ID NO: 37799 - DNA, 22 bp, Artificial Sequence
  Synthetic
gcggctgattctccttgttccc

SEQ ID NO: 37800 - DNA, 24 bp, Artificial Sequence
  Synthetic
tgtttatcgctgtcaaatgctact

SEQ ID NO: 37801 - DNA, 20 bp, Artificial Sequence
  Synthetic
tgctgctaacccagggaaag

SEQ ID NO: 37802 - DNA, 23 bp, Artificial Sequence
  Synthetic
agatttgcatctacatgggaagc

SEQ ID NO: 37803 - DNA, 21 bp, Artificial Sequence
  Synthetic
tggcaccataatgtctgcatg

SEQ ID NO: 37804 - DNA, 20 bp, Artificial Sequence
  Synthetic
aaggcggtcagtactcgaat

SEQ ID NO: 37805 - DNA, 25 bp, Artificial Sequence
  Synthetic
accagtactacctataccaagagga

SEQ ID NO: 37806 - DNA, 24 bp, Artificial Sequence
  Synthetic
gctgatattgaggaggctttggat

SEQ ID NO: 37807 - DNA, 25 bp, Artificial Sequence
  Synthetic
actcatctgaacatgttttcacagt

SEQ ID NO: 37808 - DNA, 25 bp, Artificial Sequence
  Synthetic
tgtttgtacagttgaaggtagcatt

SEQ ID NO: 37809 - DNA, 21 bp, Artificial Sequence
  Synthetic
gagggctaattaggagtgcct

SEQ ID NO: 37810 - DNA, 20 bp, Artificial Sequence
  Synthetic
ctccaagctgccatgtggaa

SEQ ID NO: 37811 - DNA, 20 bp, Artificial Sequence
  Synthetic
attcgcaaggccctgctatg

SEQ ID NO: 37812 - DNA, 20 bp, Artificial Sequence
  Synthetic
atcgttctggtgttgctgcc

SEQ ID NO: 37813 - DNA, 21 bp, Artificial Sequence
  Synthetic
gcgaatttccctgctccacat

SEQ ID NO: 37814 - DNA, 20 bp, Artificial Sequence
  Synthetic
ccacctcaccttgcaccttt

SEQ ID NO: 37815 - DNA, 19 bp, Artificial Sequence
  Synthetic
aacggggctggcgttggag

SEQ ID NO: 37816 - DNA, 20 bp, Artificial Sequence
  Synthetic
cggctggctttttgggacct

SEQ ID NO: 37817 - DNA, 20 bp, Artificial Sequence
  Synthetic
ccaagtcgtccaagatgtcg

SEQ ID NO: 37818 - DNA, 25 bp, Artificial Sequence
  Synthetic
aaacacaggattatcaaaggcaaag

SEQ ID NO: 37819 - DNA, 21 bp, Artificial Sequence
  Synthetic
agactcctctgcatcgattgt

SEQ ID NO: 37820 - DNA, 20 bp, Artificial Sequence
  Synthetic
tctgggagtagagaagcggg

SEQ ID NO: 37821 - DNA, 21 bp, Artificial Sequence
  Synthetic
acaggtgttgaaggtggtaga

SEQ ID NO: 37822 - DNA, 24 bp, Artificial Sequence
  Synthetic
gaccaatttctaagcctctacagg

SEQ ID NO: 37823 - DNA, 20 bp, Artificial Sequence
  Synthetic
ggttgtttgtcagggcatcg

SEQ ID NO: 37824 - DNA, 24 bp, Artificial Sequence
  Synthetic
ttgcttggtccattctaatgcata

SEQ ID NO: 37825 - DNA, 22 bp, Artificial Sequence
  Synthetic
cccatttctcttgcgcaatttg

SEQ ID NO: 37826 - DNA, 24 bp, Artificial Sequence
  Synthetic
ctctccatttttcttcccaatcca

SEQ ID NO: 37827 - DNA, 21 bp, Artificial Sequence
  Synthetic
actcctcacaaagcaaaggtg

SEQ ID NO: 37828 - DNA, 23 bp, Artificial Sequence
  Synthetic
tttaactcagcaatagccctgtt

SEQ ID NO: 37829 - DNA, 22 bp, Artificial Sequence
  Synthetic
gggcgtcttgtaggagcttgtt

SEQ ID NO: 37830 - DNA, 24 bp, Artificial Sequence
  Synthetic
gttatgccagatggtaaagtaggt

SEQ ID NO: 37831 - DNA, 20 bp, Artificial Sequence
  Synthetic
ttcacatggttcccccacat

SEQ ID NO: 37832 - DNA, 24 bp, Artificial Sequence
  Synthetic
aggtgtcttctatgttttgtggag

SEQ ID NO: 37833 - DNA, 22 bp, Artificial Sequence
  Synthetic
tcatccacttggtcatcatcgt

SEQ ID NO: 37834 - DNA, 21 bp, Artificial Sequence
  Synthetic
catcttcgcctactccactgt

SEQ ID NO: 37835 - DNA, 22 bp, Artificial Sequence
  Synthetic
ccagtacctttaccagacccaa

SEQ ID NO: 37836 - DNA, 20 bp, Artificial Sequence
  Synthetic
gatttggagtggcggtcacc

SEQ ID NO: 37837 - DNA, 22 bp, Artificial Sequence
  Synthetic
gcccaacagctccaatacctaa

SEQ ID NO: 37838 - DNA, 23 bp, Artificial Sequence
  Synthetic
gcaccaaaacctgtatcacacat

SEQ ID NO: 37839 - DNA, 25 bp, Artificial Sequence
  Synthetic
cgacttcaaactcttctgtatgtct

SEQ ID NO: 37840 - DNA, 22 bp, Artificial Sequence
  Synthetic
gtttggcatagcacctggaaat

SEQ ID NO: 37841 - DNA, 20 bp, Artificial Sequence
  Synthetic
gtactcaccttgcctcgacc

SEQ ID NO: 37842 - DNA, 25 bp, Artificial Sequence
  Synthetic
gtgtataatcactcgtatccctgtc

SEQ ID NO: 37843 - DNA, 20 bp, Artificial Sequence
  Synthetic
cctctatgccactgtctcca

SEQ ID NO: 37844 - DNA, 19 bp, Artificial Sequence
  Synthetic
cggtcgtggatgcgctgga

SEQ ID NO: 37845 - DNA, 21 bp, Artificial Sequence
  Synthetic
cgtctaattcgcgagagacct

SEQ ID NO: 37846 - DNA, 20 bp, Artificial Sequence
  Synthetic
caagtgtcccacctgtaccc

SEQ ID NO: 37847 - DNA, 20 bp, Artificial Sequence
  Synthetic
tagtggtgcaccagagcgat

SEQ ID NO: 37848 - DNA, 24 bp, Artificial Sequence
  Synthetic
ttcagtagaaaaacgctcagtcat

SEQ ID NO: 37849 - DNA, 21 bp, Artificial Sequence
  Synthetic
acagtccgtgtaccgataacg

SEQ ID NO: 37850 - DNA, 23 bp, Artificial Sequence
  Synthetic
gatcttcgatctcagcatttcct

SEQ ID NO: 37851 - DNA, 21 bp, Artificial Sequence
  Synthetic
caaatgcagcagaatggcatg

SEQ ID NO: 37852 - DNA, 21 bp, Artificial Sequence
  Synthetic
gttttccctgctacacacact

SEQ ID NO: 37853 - DNA, 21 bp, Artificial Sequence
  Synthetic
tcgacagttcaaattggcagt

SEQ ID NO: 37854 - DNA, 20 bp, Artificial Sequence
  Synthetic
tacaattggcctccagtccc

SEQ ID NO: 37855 - DNA, 24 bp, Artificial Sequence
  Synthetic
ggagggattggtaaaatgggtact

SEQ ID NO: 37856 - DNA, 24 bp, Artificial Sequence
  Synthetic
gaaaaggttaaagttgtgtcagca

SEQ ID NO: 37857 - DNA, 20 bp, Artificial Sequence
  Synthetic
atacctggttgccccaacaa

SEQ ID NO: 37858 - DNA, 23 bp, Artificial Sequence
  Synthetic
tgacaatccaatattccagccct

SEQ ID NO: 37859 - DNA, 20 bp, Artificial Sequence
  Synthetic
gaggtagaggaactgggggc

SEQ ID NO: 37860 - DNA, 22 bp, Artificial Sequence
  Synthetic
cgccacctaaattgctacctaa

SEQ ID NO: 37861 - DNA, 22 bp, Artificial Sequence
  Synthetic
aagcatagttggcagcatacat

SEQ ID NO: 37862 - DNA, 22 bp, Artificial Sequence
  Synthetic
caatctgtccagcagtgtactg

SEQ ID NO: 37863 - DNA, 23 bp, Artificial Sequence
  Synthetic
cggtcgttggtttcagatctaac

SEQ ID NO: 37864 - DNA, 22 bp, Artificial Sequence
  Synthetic
tctgttataggcgtctggaaca

SEQ ID NO: 37865 - DNA, 24 bp, Artificial Sequence
  Synthetic
ctaagctgtgctgtactactgttt

SEQ ID NO: 37866 - DNA, 21 bp, Artificial Sequence
  Synthetic
gccatttttgcatcagccaat

SEQ ID NO: 37867 - DNA, 23 bp, Artificial Sequence
  Synthetic
gcttgttggttaactgattgcag

SEQ ID NO: 37868 - DNA, 25 bp, Artificial Sequence
  Synthetic
ccagcttcaataaaacttgactcct

SEQ ID NO: 37869 - DNA, 22 bp, Artificial Sequence
  Synthetic
tcagagtcaggagcattatgca

SEQ ID NO: 37870 - DNA, 24 bp, Artificial Sequence
  Synthetic
cgtggaatgacatacaagctagga

SEQ ID NO: 37871 - DNA, 25 bp, Artificial Sequence
  Synthetic
tgttccctacgaatataaaaccaca

SEQ ID NO: 37872 - DNA, 22 bp, Artificial Sequence
  Synthetic
gtcgagttgtttgcatggtaac

SEQ ID NO: 37873 - DNA, 25 bp, Artificial Sequence
  Synthetic
cttctccactatgtaagaccattcc

SEQ ID NO: 37874 - DNA, 23 bp, Artificial Sequence
  Synthetic
tctaggaatccgtcttccatctg

SEQ ID NO: 37875 - DNA, 25 bp, Artificial Sequence
  Synthetic
tctgtttagtcttgcttcttctgaa

SEQ ID NO: 37876 - DNA, 20 bp, Artificial Sequence
  Synthetic
taggatccttccccgcactg

SEQ ID NO: 37877 - DNA, 20 bp, Artificial Sequence
  Synthetic
aaatgcggcagaatggcatg

SEQ ID NO: 37878 - DNA, 21 bp, Artificial Sequence
  Synthetic
gcaggtagcactaaagggcta

SEQ ID NO: 37879 - DNA, 25 bp, Artificial Sequence
  Synthetic
cccatgcttggatttataatttgca

SEQ ID NO: 37880 - DNA, 25 bp, Artificial Sequence
  Synthetic
ggcttctgctatttacaaacgatac

SEQ ID NO: 37881 - DNA, 21 bp, Artificial Sequence
  Synthetic
ccactgatgaaggagactgga

SEQ ID NO: 37882 - DNA, 22 bp, Artificial Sequence
  Synthetic
gtgtgcttgttactgaaacacg

SEQ ID NO: 37883 - DNA, 20 bp, Artificial Sequence
  Synthetic
ccagattgctgaccaagtgg

SEQ ID NO: 37884 - DNA, 22 bp, Artificial Sequence
  Synthetic
cagacacatctggaaacacagt

SEQ ID NO: 37885 - DNA, 22 bp, Artificial Sequence
  Synthetic
aaatgtaccagcaaccgatacc

SEQ ID NO: 37886 - DNA, 20 bp, Artificial Sequence
  Synthetic
acaaggtcagccatccgtac

SEQ ID NO: 37887 - DNA, 20 bp, Artificial Sequence
  Synthetic
aacatgcgcaatgctttgga

SEQ ID NO: 37888 - DNA, 22 bp, Artificial Sequence
  Synthetic
agatcccacgaaagcgaagagg

SEQ ID NO: 37889 - DNA, 22 bp, Artificial Sequence
  Synthetic
acatcgaacggttccagcaaca

SEQ ID NO: 37890 - DNA, 24 bp, Artificial Sequence
  Synthetic
attccaagggggatactttatgct

SEQ ID NO: 37891 - DNA, 20 bp, Artificial Sequence
  Synthetic
acacctattgagaggctgca

SEQ ID NO: 37892 - DNA, 24 bp, Artificial Sequence
  Synthetic
agaacattaagcaaaatcctgcac

SEQ ID NO: 37893 - DNA, 20 bp, Artificial Sequence
  Synthetic
accacaagcggttccttagt

SEQ ID NO: 37894 - DNA, 25 bp, Artificial Sequence
  Synthetic
tgaactatctcagtttgcattaggt

SEQ ID NO: 37895 - DNA, 24 bp, Artificial Sequence
  Synthetic
tctgttgactctttaccatcttcg

SEQ ID NO: 37896 - DNA, 22 bp, Artificial Sequence
  Synthetic
cgcaatgggagacgttaaaggt

SEQ ID NO: 37897 - DNA, 21 bp, Artificial Sequence
  Synthetic
ccgatttgagtccacagttgc

SEQ ID NO: 37898 - DNA, 20 bp, Artificial Sequence
  Synthetic
caatggagtcgctgacagac

SEQ ID NO: 37899 - DNA, 23 bp, Artificial Sequence
  Synthetic
ataggcccatctgaggtagttcc

SEQ ID NO: 37900 - DNA, 25 bp, Artificial Sequence
  Synthetic
attagatgtgcaacctatagaaccc

SEQ ID NO: 37901 - DNA, 20 bp, Artificial Sequence
  Synthetic
cagaaccagtaccccacgtg

SEQ ID NO: 37902 - DNA, 25 bp, Artificial Sequence
  Synthetic
cgaagaaggtcgtattcgattcagt

SEQ ID NO: 37903 - DNA, 21 bp, Artificial Sequence
  Synthetic
atctttcaggacaatggctgc

SEQ ID NO: 37904 - DNA, 20 bp, Artificial Sequence
  Synthetic
tccaccaattggggaacact

SEQ ID NO: 37905 - DNA, 25 bp, Artificial Sequence
  Synthetic
tttaacagaccttattggctacagc

SEQ ID NO: 37906 - DNA, 21 bp, Artificial Sequence
  Synthetic
ggaattgccgggaagactggg

SEQ ID NO: 37907 - DNA, 22 bp, Artificial Sequence
  Synthetic
cggcactaggaagagttcggag

SEQ ID NO: 37908 - DNA, 20 bp, Artificial Sequence
  Synthetic
gcggagcgcttactgacgat

SEQ ID NO: 37909 - DNA, 22 bp, Artificial Sequence
  Synthetic
gtgcccggtgtcatcattacca

SEQ ID NO: 37910 - DNA, 22 bp, Artificial Sequence
  Synthetic
gcccgctgtggtacaattcaac

SEQ ID NO: 37911 - DNA, 20 bp, Artificial Sequence
  Synthetic
gggcagggacggtttcatcc

SEQ ID NO: 37912 - DNA, 22 bp, Artificial Sequence
  Synthetic
aagatcatagtttggggggcgg

SEQ ID NO: 37913 - DNA, 20 bp, Artificial Sequence
  Synthetic
ggggaccaatgtgggcggtg

SEQ ID NO: 37914 - DNA, 22 bp, Artificial Sequence
  Synthetic
tcttcagagctgctgtctgcac

SEQ ID NO: 37915 - DNA, 21 bp, Artificial Sequence
  Synthetic
agctcacctcattggggctga

SEQ ID NO: 37916 - DNA, 20 bp, Artificial Sequence
  Synthetic
gtaggggcaggcttggcatc

SEQ ID NO: 37917 - DNA, 20 bp, Artificial Sequence
  Synthetic
ttcgcaagccagttagcgcc

SEQ ID NO: 37918 - DNA, 21 bp, Artificial Sequence
  Synthetic
acgcagtggatgaaccgtctc

SEQ ID NO: 37919 - DNA, 20 bp, Artificial Sequence
  Synthetic
gtgtggggccctgatagcag

SEQ ID NO: 37920 - DNA, 21 bp, Artificial Sequence
  Synthetic
tttgtggacggggtgcggata

SEQ ID NO: 37921 - DNA, 21 bp, Artificial Sequence
  Synthetic
cgggcggttatccaactcaca

SEQ ID NO: 37922 - DNA, 22 bp, Artificial Sequence
  Synthetic
accgaccaccataatggccaag

SEQ ID NO: 37923 - DNA, 22 bp, Artificial Sequence
  Synthetic
aggctcgcaccatcattaacgc

SEQ ID NO: 37924 - DNA, 20 bp, Artificial Sequence
  Synthetic
gatagggcggacctgcaagc

SEQ ID NO: 37925 - DNA, 20 bp, Artificial Sequence
  Synthetic
ctggagaagccaccacaatg

SEQ ID NO: 37926 - DNA, 22 bp, Artificial Sequence
  Synthetic
tgaaaatgagggccttcagaga

SEQ ID NO: 37927 - DNA, 21 bp, Artificial Sequence
  Synthetic
gacctttgattggacggtgtg

SEQ ID NO: 37928 - DNA, 25 bp, Artificial Sequence
  Synthetic
gtggctaaaatgctcagtaattgtc

SEQ ID NO: 37929 - DNA, 20 bp, Artificial Sequence
  Synthetic
aaggacggttactgcatcct

SEQ ID NO: 37930 - DNA, 22 bp, Artificial Sequence
  Synthetic
gtcatacaggaaaccagtaggc

SEQ ID NO: 37931 - DNA, 23 bp, Artificial Sequence
  Synthetic
aactgtgaaaccaaatgccaaac

SEQ ID NO: 37932 - DNA, 22 bp, Artificial Sequence
  Synthetic
gataccatcacagcaatgacca

SEQ ID NO: 37933 - DNA, 22 bp, Artificial Sequence
  Synthetic
catccagcaaatacaccatcca

SEQ ID NO: 37934 - DNA, 24 bp, Artificial Sequence
  Synthetic
atgacagactagaagctatggcaa

SEQ ID NO: 37935 - DNA, 22 bp, Artificial Sequence
  Synthetic
tatacgccaatcagccaatcca

SEQ ID NO: 37936 - DNA, 24 bp, Artificial Sequence
  Synthetic
cacaaatgcccagcaaatttacca

SEQ ID NO: 37937 - DNA, 20 bp, Artificial Sequence
  Synthetic
ggcaatccaagcccttcaca

SEQ ID NO: 37938 - DNA, 25 bp, Artificial Sequence
  Synthetic
ctgttttgcttccagtcaaaacatc

SEQ ID NO: 37939 - DNA, 24 bp, Artificial Sequence
  Synthetic
tgaactcaacagtgatgacatcaa

SEQ ID NO: 37940 - DNA, 23 bp, Artificial Sequence
  Synthetic
accaggaatgttcagacaagttc

SEQ ID NO: 37941 - DNA, 21 bp, Artificial Sequence
  Synthetic
ttccctgcatcaataccagct

SEQ ID NO: 37942 - DNA, 21 bp, Artificial Sequence
  Synthetic
gtctgcggaaccggtgagtac

SEQ ID NO: 37943 - DNA, 19 bp, Artificial Sequence
  Synthetic
cgcgcgacgaggaagactt

SEQ ID NO: 37944 - DNA, 22 bp, Artificial Sequence
  Synthetic
ggaagacggcgtgaactatgca

SEQ ID NO: 37945 - DNA, 20 bp, Artificial Sequence
  Synthetic
cctcgacgaacgcccctact

SEQ ID NO: 37946 - DNA, 20 bp, Artificial Sequence
  Synthetic
ggtgggcaacaacaccttgc

SEQ ID NO: 37947 - DNA, 21 bp, Artificial Sequence
  Synthetic
ccacacagtggcaggtccttc

SEQ ID NO: 37948 - DNA, 22 bp, Artificial Sequence
  Synthetic
atctgaagggtaggtgggtgcc

SEQ ID NO: 37949 - DNA, 21 bp, Artificial Sequence
  Synthetic
caaggccttctccggatctgc

SEQ ID NO: 37950 - DNA, 22 bp, Artificial Sequence
  Synthetic
cccaagggtcctgtcatccaga

SEQ ID NO: 37951 - DNA, 22 bp, Artificial Sequence
  Synthetic
aaccatgagatccccggtgttc

SEQ ID NO: 37952 - DNA, 21 bp, Artificial Sequence
  Synthetic
caatgccgtggcctactaccg

SEQ ID NO: 37953 - DNA, 22 bp, Artificial Sequence
  Synthetic
atgacatgcatgtcggccgacc

SEQ ID NO: 37954 - DNA, 20 bp, Artificial Sequence
  Synthetic
cacccctgctgtccagacca

SEQ ID NO: 37955 - DNA, 19 bp, Artificial Sequence
  Synthetic
cgccatcggcagcgttgga

SEQ ID NO: 37956 - DNA, 22 bp, Artificial Sequence
  Synthetic
ctcagcagcctcactgtaaccc

SEQ ID NO: 37957 - DNA, 22 bp, Artificial Sequence
  Synthetic
ccccattaacgcctacaccacg

SEQ ID NO: 37958 - DNA, 20 bp, Artificial Sequence
  Synthetic
accggacgtagccgtgttga

SEQ ID NO: 37959 - DNA, 21 bp, Artificial Sequence
  Synthetic
ggaggtctccgtacctgcaga

SEQ ID NO: 37960 - DNA, 20 bp, Artificial Sequence
  Synthetic
ccccccgactccgacgttga

SEQ ID NO: 37961 - DNA, 22 bp, Artificial Sequence
  Synthetic
taccaggacgtgctcaaggagg

SEQ ID NO: 37962 - DNA, 22 bp, Artificial Sequence
  Synthetic
tacgacgtggttagcaagctcc

SEQ ID NO: 37963 - DNA, 22 bp, Artificial Sequence
  Synthetic
ccagtcaattcctggctaggca

SEQ ID NO: 37964 - DNA, 20 bp, Artificial Sequence
  Synthetic
gcccttgcgagcttggagac

SEQ ID NO: 37965 - DNA, 22 bp, Artificial Sequence
  Synthetic
attgaagtgggcacttggtgag

SEQ ID NO: 37966 - DNA, 20 bp, Artificial Sequence
  Synthetic
gaatcacccaagggagtgga

SEQ ID NO: 37967 - DNA, 21 bp, Artificial Sequence
  Synthetic
cctccactcactccaaaacag

SEQ ID NO: 37968 - DNA, 22 bp, Artificial Sequence
  Synthetic
tgatgcagaagatgagacagca

SEQ ID NO: 37969 - DNA, 21 bp, Artificial Sequence
  Synthetic
ggtcagccaaagccaaacgac

SEQ ID NO: 37970 - DNA, 24 bp, Artificial Sequence
  Synthetic
tatggtgcaaacaaaatgtcctcc

SEQ ID NO: 37971 - DNA, 20 bp, Artificial Sequence
  Synthetic
tggaatgcaccaccaactgg

SEQ ID NO: 37972 - DNA, 20 bp, Artificial Sequence
  Synthetic
atatggacagtgggaggtgc

SEQ ID NO: 37973 - DNA, 22 bp, Artificial Sequence
  Synthetic
gcccacaatacataatgcacct

SEQ ID NO: 37974 - DNA, 21 bp, Artificial Sequence
  Synthetic
agaggcatatggggacagttt

SEQ ID NO: 37975 - DNA, 20 bp, Artificial Sequence
  Synthetic
tgttggggcaatcaggtgtt

SEQ ID NO: 37976 - DNA, 25 bp, Artificial Sequence
  Synthetic
ggacacatataggtttgtacagtca

SEQ ID NO: 37977 - DNA, 22 bp, Artificial Sequence
  Synthetic
tagagctcaggtcgagaccggg

SEQ ID NO: 37978 - DNA, 20 bp, Artificial Sequence
  Synthetic
cgaccccccggattctgacc

SEQ ID NO: 37979 - DNA, 22 bp, Artificial Sequence
  Synthetic
gtacctttgctcctccctcgtg

SEQ ID NO: 37980 - DNA, 21 bp, Artificial Sequence
  Synthetic
aaggcctggaggagccttacc

SEQ ID NO: 37981 - DNA, 20 bp, Artificial Sequence
  Synthetic
ccactggagtcgggactgca

SEQ ID NO: 37982 - DNA, 21 bp, Artificial Sequence
  Synthetic
ggctagaacacctcccaaggc

SEQ ID NO: 37983 - DNA, 22 bp, Artificial Sequence
  Synthetic
tctctcatcatcttcccccggg

SEQ ID NO: 37984 - DNA, 20 bp, Artificial Sequence
  Synthetic
cggcaagccttcccccaatg

SEQ ID NO: 37985 - DNA, 21 bp, Artificial Sequence
  Synthetic
caacgctctcacagatgccct

SEQ ID NO: 37986 - DNA, 21 bp, Artificial Sequence
  Synthetic
ccctacaatccaaccagctcc

SEQ ID NO: 37987 - DNA, 20 bp, Artificial Sequence
  Synthetic
tggaggctcctcaagcgagc

SEQ ID NO: 37988 - DNA, 21 bp, Artificial Sequence
  Synthetic
tggccctttcagcagatcagg

SEQ ID NO: 37989 - DNA, 19 bp, Artificial Sequence
  Synthetic
ctggcttgtctccgccctg

SEQ ID NO: 37990 - DNA, 21 bp, Artificial Sequence
  Synthetic
ctcctccgttcagcctccaag

SEQ ID NO: 37991 - DNA, 18 bp, Artificial Sequence
  Synthetic
cgtcgctgccgatcacga

SEQ ID NO: 37992 - DNA, 23 bp, Artificial Sequence
  Synthetic
cctcatttctactctcacacggc

SEQ ID NO: 37993 - DNA, 24 bp, Artificial Sequence
  Synthetic
gaaaagaacccgtcacttaggatg

SEQ ID NO: 37994 - DNA, 25 bp, Artificial Sequence
  Synthetic
cttgtccgaaaaacgagatttctcc

SEQ ID NO: 37995 - DNA, 20 bp, Artificial Sequence
  Synthetic
cacagattggcgggacaagg

SEQ ID NO: 37996 - DNA, 22 bp, Artificial Sequence
  Synthetic
agaaaagcaaccaggagattgg

SEQ ID NO: 37997 - DNA, 25 bp, Artificial Sequence
  Synthetic
taataaagcttcttccctttgcagc

SEQ ID NO: 37998 - DNA, 20 bp, Artificial Sequence
  Synthetic
aggattcctcattctgggca

SEQ ID NO: 37999 - DNA, 23 bp, Artificial Sequence
  Synthetic
acacagtaaacagaacacaccaa

SEQ ID NO: 38000 - DNA, 25 bp, Artificial Sequence
  Synthetic
ttggacattaaacagaaatcaaccg

SEQ ID NO: 38001 - DNA, 21 bp, Artificial Sequence
  Synthetic
ccaaagatgcagagagaggca

SEQ ID NO: 38002 - DNA, 21 bp, Artificial Sequence
  Synthetic
tgagggaatacaagcaggagt

SEQ ID NO: 38003 - DNA, 22 bp, Artificial Sequence
  Synthetic
ccccatctccacatctccacgc

SEQ ID NO: 38004 - DNA, 20 bp, Artificial Sequence
  Synthetic
cgaaacgacccgcacatggc

SEQ ID NO: 38005 - DNA, 21 bp, Artificial Sequence
  Synthetic
acatacacgcgtgcatgctgc

SEQ ID NO: 38006 - DNA, 22 bp, Artificial Sequence
  Synthetic
tcggttatgacacggcgaaacg

SEQ ID NO: 38007 - DNA, 20 bp, Artificial Sequence
  Synthetic
cacctacacctgcgtgctgg

SEQ ID NO: 38008 - DNA, 19 bp, Artificial Sequence
  Synthetic
gcggcgctatcatctgcgg

SEQ ID NO: 38009 - DNA, 19 bp, Artificial Sequence
  Synthetic
gaagcctctgcggtagcgg

SEQ ID NO: 38010 - DNA, 21 bp, Artificial Sequence
  Synthetic
cggatgatgaatcgcgccatg

SEQ ID NO: 38011 - DNA, 20 bp, Artificial Sequence
  Synthetic
agtagacggcggtgtcctcg

SEQ ID NO: 38012 - DNA, 21 bp, Artificial Sequence
  Synthetic
cgcagcctcgcctttaaacag

SEQ ID NO: 38013 - DNA, 21 bp, Artificial Sequence
  Synthetic
atcatgccccggagatcgtgc

SEQ ID NO: 38014 - DNA, 21 bp, Artificial Sequence
  Synthetic
gctccaaagcgtacgcagtct

SEQ ID NO: 38015 - DNA, 18 bp, Artificial Sequence
  Synthetic
tcaccgttcggcctcgca

SEQ ID NO: 38016 - DNA, 22 bp, Artificial Sequence
  Synthetic
tgcacacacaactggtcatggt

SEQ ID NO: 38017 - DNA, 19 bp, Artificial Sequence
  Synthetic
gcccgaggataacaggccg

SEQ ID NO: 38018 - DNA, 18 bp, Artificial Sequence
  Synthetic
tcgtggcgcacgtccgta

SEQ ID NO: 38019 - DNA, 18 bp, Artificial Sequence
  Synthetic
acgcgcgcgacgagttga

SEQ ID NO: 38020 - DNA, 22 bp, Artificial Sequence
  Synthetic
ccagtttgacgcagtgcatcag

SEQ ID NO: 38021 - DNA, 20 bp, Artificial Sequence
  Synthetic
cgcagtgacgaaagccatgc

SEQ ID NO: 38022 - DNA, 20 bp, Artificial Sequence
  Synthetic
gcgcttccagcacctgcttt

SEQ ID NO: 38023 - DNA, 21 bp, Artificial Sequence
  Synthetic
aggataccggagtcgtaggcg

SEQ ID NO: 38024 - DNA, 20 bp, Artificial Sequence
  Synthetic
actcacgcggataggggaca

SEQ ID NO: 38025 - DNA, 22 bp, Artificial Sequence
  Synthetic
gtcatgaggaccatgtcgcctt

SEQ ID NO: 38026 - DNA, 19 bp, Artificial Sequence
  Synthetic
cctgcacgaagccgcggaa

SEQ ID NO: 38027 - DNA, 18 bp, Artificial Sequence
  Synthetic
actcgagcatgtcggcgc

SEQ ID NO: 38028 - DNA, 19 bp, Artificial Sequence
  Synthetic
ccgcctcggtcaccaactc

SEQ ID NO: 38029 - DNA, 21 bp, Artificial Sequence
  Synthetic
ccaattccacaaaacgcgccg

SEQ ID NO: 38030 - DNA, 19 bp, Artificial Sequence
  Synthetic
gcgaactttccgcgtgcaa

SEQ ID NO: 38031 - DNA, 21 bp, Artificial Sequence
  Synthetic
ccagaagctgttgcagaccct

SEQ ID NO: 38032 - DNA, 19 bp, Artificial Sequence
  Synthetic
gctgagtgttcgcgtgcgc

SEQ ID NO: 38033 - DNA, 22 bp, Artificial Sequence
  Synthetic
ggccgcgagcgacctattaaac

SEQ ID NO: 38034 - DNA, 22 bp, Artificial Sequence
  Synthetic
cgtcccacctacgtactcgtca

SEQ ID NO: 38035 - DNA, 22 bp, Artificial Sequence
  Synthetic
cgcccgctttctactatgaggc

SEQ ID NO: 38036 - DNA, 20 bp, Artificial Sequence
  Synthetic
aggaactctttcgcctgggc

SEQ ID NO: 38037 - DNA, 19 bp, Artificial Sequence
  Synthetic
gcaactcgcgctaagccgc

SEQ ID NO: 38038 - DNA, 20 bp, Artificial Sequence
  Synthetic
ggcgctgatggaaaagccgc

SEQ ID NO: 38039 - DNA, 22 bp, Artificial Sequence
  Synthetic
aacctgcaacagcaagctgtcg

SEQ ID NO: 38040 - DNA, 16 bp, Artificial Sequence
  Synthetic
tctgacagcgcgcgca

SEQ ID NO: 38041 - DNA, 20 bp, Artificial Sequence
  Synthetic
ccagcagaagagccagcacc

SEQ ID NO: 38042 - DNA, 21 bp, Artificial Sequence
  Synthetic
ccgaattggatttgcgcacca

SEQ ID NO: 38043 - DNA, 21 bp, Artificial Sequence
  Synthetic
catcgtccagaaacggcaccc

SEQ ID NO: 38044 - DNA, 21 bp, Artificial Sequence
  Synthetic
tcatcaccgtccccagtcacc

SEQ ID NO: 38045 - DNA, 19 bp, Artificial Sequence
  Synthetic
cgtcagcgtcgtcgtccgt

SEQ ID NO: 38046 - DNA, 18 bp, Artificial Sequence
  Synthetic
ttttcgctgccgtcgccg

SEQ ID NO: 38047 - DNA, 20 bp, Artificial Sequence
  Synthetic
cggtctgaaaagcggccacg

SEQ ID NO: 38048 - DNA, 21 bp, Artificial Sequence
  Synthetic
tgcgcgctaaaggtatcctcg

SEQ ID NO: 38049 - DNA, 20 bp, Artificial Sequence
  Synthetic
acccgcccgcgaaaatagcg

SEQ ID NO: 38050 - DNA, 19 bp, Artificial Sequence
  Synthetic
tgggctgcttgtggggaac

SEQ ID NO: 38051 - DNA, 20 bp, Artificial Sequence
  Synthetic
gtcggggtgcgtgtagccaa

SEQ ID NO: 38052 - DNA, 20 bp, Artificial Sequence
  Synthetic
cgtgctggtcattgggcagg

SEQ ID NO: 38053 - DNA, 22 bp, Artificial Sequence
  Synthetic
cgacgaggaggatgaagtgacc

SEQ ID NO: 38054 - DNA, 20 bp, Artificial Sequence
  Synthetic
tgctgcgggtctttccctcg

SEQ ID NO: 38055 - DNA, 19 bp, Artificial Sequence
  Synthetic
tctggccgacgacgtgagt

SEQ ID NO: 38056 - DNA, 20 bp, Artificial Sequence
  Synthetic
aaacgcggcgttcttcagca

SEQ ID NO: 38057 - DNA, 19 bp, Artificial Sequence
  Synthetic
cgccaccatcaccggccta

SEQ ID NO: 38058 - DNA, 19 bp, Artificial Sequence
  Synthetic
cgtcgtcgtcgtcctcgga

SEQ ID NO: 38059 - DNA, 19 bp, Artificial Sequence
  Synthetic
tcggtcctgttcgcccacc

SEQ ID NO: 38060 - DNA, 18 bp, Artificial Sequence
  Synthetic
agccgccttccacgttgg

SEQ ID NO: 38061 - DNA, 20 bp, Artificial Sequence
  Synthetic
taacagcgtcggctacgggc

SEQ ID NO: 38062 - DNA, 19 bp, Artificial Sequence
  Synthetic
ccacctcgctgcccgtaaa

SEQ ID NO: 38063 - DNA, 19 bp, Artificial Sequence
  Synthetic
ggacgtggaccgcgagtgt

SEQ ID NO: 38064 - DNA, 19 bp, Artificial Sequence
  Synthetic
agtaaggcagtggcgcgtc

SEQ ID NO: 38065 - DNA, 20 bp, Artificial Sequence
  Synthetic
cagtgtgggcgtcagatccg

SEQ ID NO: 38066 - DNA, 21 bp, Artificial Sequence
  Synthetic
tggttgatttccagcgccagt

SEQ ID NO: 38067 - DNA, 20 bp, Artificial Sequence
  Synthetic
acgccggtcggtaaaagagg

SEQ ID NO: 38068 - DNA, 22 bp, Artificial Sequence
  Synthetic
ttgaccgttgttaagtcccggc

SEQ ID NO: 38069 - DNA, 21 bp, Artificial Sequence
  Synthetic
gaaggtctgtagacagggcgc

SEQ ID NO: 38070 - DNA, 21 bp, Artificial Sequence
  Synthetic
tttgcgacggtgaagtggagg

SEQ ID NO: 38071 - DNA, 21 bp, Artificial Sequence
  Synthetic
gctctcgctgacggaatggaa

SEQ ID NO: 38072 - DNA, 20 bp, Artificial Sequence
  Synthetic
tgactttacggggcagcagc

SEQ ID NO: 38073 - DNA, 20 bp, Artificial Sequence
  Synthetic
tcggatgaggcaggcgatgc

SEQ ID NO: 38074 - DNA, 20 bp, Artificial Sequence
  Synthetic
agctgtgcaggtgctcttcg

SEQ ID NO: 38075 - DNA, 20 bp, Artificial Sequence
  Synthetic
tgtcgtccctgcccttctcc

SEQ ID NO: 38076 - DNA, 20 bp, Artificial Sequence
  Synthetic
ctacctcatgacgcacgccg

SEQ ID NO: 38077 - DNA, 18 bp, Artificial Sequence
  Synthetic
gcgccgccacattggtga

SEQ ID NO: 38078 - DNA, 21 bp, Artificial Sequence
  Synthetic
tctccctcaactgccgtcagg

SEQ ID NO: 38079 - DNA, 20 bp, Artificial Sequence
  Synthetic
cggcctacggcgttattgca

SEQ ID NO: 38080 - DNA, 19 bp, Artificial Sequence
  Synthetic
tccgacgcctgtctgctca

SEQ ID NO: 38081 - DNA, 22 bp, Artificial Sequence
  Synthetic
aggggaaaggcgacagagaagg

SEQ ID NO: 38082 - DNA, 22 bp, Artificial Sequence
  Synthetic
taacgaggagcggcaacagaag

SEQ ID NO: 38083 - DNA, 18 bp, Artificial Sequence
  Synthetic
acgagccgcgtgtggtca

SEQ ID NO: 38084 - DNA, 18 bp, Artificial Sequence
  Synthetic
tgaggtgcgcgaggtgtg

SEQ ID NO: 38085 - DNA, 19 bp, Artificial Sequence
  Synthetic
cgacgagcggttggtgggt

SEQ ID NO: 38086 - DNA, 20 bp, Artificial Sequence
  Synthetic
gcgtcttcggtctcgagcaa

SEQ ID NO: 38087 - DNA, 19 bp, Artificial Sequence
  Synthetic
ctcctcgtgcaggtgtgcc

SEQ ID NO: 38088 - DNA, 20 bp, Artificial Sequence
  Synthetic
gcgtgccctgcatcatctgc

SEQ ID NO: 38089 - DNA, 19 bp, Artificial Sequence
  Synthetic
gactcggacgccatcacgg

SEQ ID NO: 38090 - DNA, 19 bp, Artificial Sequence
  Synthetic
agtctgcccagtgaccgcc

SEQ ID NO: 38091 - DNA, 19 bp, Artificial Sequence
  Synthetic
ctacggcctcacttcgcgc

SEQ ID NO: 38092 - DNA, 21 bp, Artificial Sequence
  Synthetic
gtattgagcagcagcacgccg

SEQ ID NO: 38093 - DNA, 19 bp, Artificial Sequence
  Synthetic
cgtcagcagggcccgcaat

SEQ ID NO: 38094 - DNA, 20 bp, Artificial Sequence
  Synthetic
acggtggtcgcgttggtttc

SEQ ID NO: 38095 - DNA, 19 bp, Artificial Sequence
  Synthetic
ccccgcccgtacatcccat

SEQ ID NO: 38096 - DNA, 21 bp, Artificial Sequence
  Synthetic
ctgtgcctaagtctggcctcc

SEQ ID NO: 38097 - DNA, 22 bp, Artificial Sequence
  Synthetic
cgaacatgcacatagtcgcggc

SEQ ID NO: 38098 - DNA, 19 bp, Artificial Sequence
  Synthetic
ccggctgagcgtctccagt

SEQ ID NO: 38099 - DNA, 20 bp, Artificial Sequence
  Synthetic
tcccgcgggccacttacttg

SEQ ID NO: 38100 - DNA, 21 bp, Artificial Sequence
  Synthetic
tccttccccgtgcttacagcc

SEQ ID NO: 38101 - DNA, 19 bp, Artificial Sequence
  Synthetic
cgcggtgcctaacgcggta

SEQ ID NO: 38102 - DNA, 19 bp, Artificial Sequence
  Synthetic
ggtggcgcaacagcgagtc

SEQ ID NO: 38103 - DNA, 21 bp, Artificial Sequence
  Synthetic
cagatggcggtgtccacttgt

SEQ ID NO: 38104 - DNA, 19 bp, Artificial Sequence
  Synthetic
gtcgagtgcgtcgtcggct

SEQ ID NO: 38105 - DNA, 20 bp, Artificial Sequence
  Synthetic
gtccgcgaccggctacgtag

SEQ ID NO: 38106 - DNA, 19 bp, Artificial Sequence
  Synthetic
gcaccgagtccgcgagtct

SEQ ID NO: 38107 - DNA, 18 bp, Artificial Sequence
  Synthetic
tttcgccaccgctgacgt

SEQ ID NO: 38108 - DNA, 19 bp, Artificial Sequence
  Synthetic
tcgtgtcgcgacatggacg

SEQ ID NO: 38109 - DNA, 20 bp, Artificial Sequence
  Synthetic
actggagacacggtagccgg

SEQ ID NO: 38110 - DNA, 21 bp, Artificial Sequence
  Synthetic
gcagcagaatgtacagcgcct

SEQ ID NO: 38111 - DNA, 22 bp, Artificial Sequence
  Synthetic
aagcgccacatacagtgcaaac

SEQ ID NO: 38112 - DNA, 22 bp, Artificial Sequence
  Synthetic
ggaaatacacgaagagcgcgga

SEQ ID NO: 38113 - DNA, 22 bp, Artificial Sequence
  Synthetic
tctaagacgcgagatccgtggg

SEQ ID NO: 38114 - DNA, 21 bp, Artificial Sequence
  Synthetic
agcagggccaaacagatggtg

SEQ ID NO: 38115 - DNA, 22 bp, Artificial Sequence
  Synthetic
taggacttccccgtcgtactgg

SEQ ID NO: 38116 - DNA, 21 bp, Artificial Sequence
  Synthetic
cggtcacggccacctagaaac

SEQ ID NO: 38117 - DNA, 19 bp, Artificial Sequence
  Synthetic
tccgacgggtagggagcct

SEQ ID NO: 38118 - DNA, 18 bp, Artificial Sequence
  Synthetic
tggtggcgctgcacgtag

SEQ ID NO: 38119 - DNA, 20 bp, Artificial Sequence
  Synthetic
cctcgcccatgtgtacgcag

SEQ ID NO: 38120 - DNA, 19 bp, Artificial Sequence
  Synthetic
accacgtcgtgcggtaccc

SEQ ID NO: 38121 - DNA, 20 bp, Artificial Sequence
  Synthetic
ccggatccatcattgcgcga

SEQ ID NO: 38122 - DNA, 20 bp, Artificial Sequence
  Synthetic
ggcctcgcagtgcaacagtc

SEQ ID NO: 38123 - DNA, 21 bp, Artificial Sequence
  Synthetic
ctggcggttttgcaatcgacg

SEQ ID NO: 38124 - DNA, 18 bp, Artificial Sequence
  Synthetic
tcgttcggcgttcaggcc

SEQ ID NO: 38125 - DNA, 19 bp, Artificial Sequence
  Synthetic
ccgacgacgcactcgactg

SEQ ID NO: 38126 - DNA, 18 bp, Artificial Sequence
  Synthetic
tgcgtgtgtggacggcga

SEQ ID NO: 38127 - DNA, 20 bp, Artificial Sequence
  Synthetic
tgtgacacggagggaagttc

SEQ ID NO: 38128 - DNA, 25 bp, Artificial Sequence
  Synthetic
tgaagggggtttacataaatacagc

SEQ ID NO: 38129 - DNA, 20 bp, Artificial Sequence
  Synthetic
ctggagccacacaaatggga

SEQ ID NO: 38130 - DNA, 23 bp, Artificial Sequence
  Synthetic
aattggagagtcacctaagggag

SEQ ID NO: 38131 - DNA, 25 bp, Artificial Sequence
  Synthetic
acagatgtgtacagaactcaaactc

SEQ ID NO: 38132 - DNA, 20 bp, Artificial Sequence
  Synthetic
aggatgcaactgctggtctt

SEQ ID NO: 38133 - DNA, 23 bp, Artificial Sequence
  Synthetic
gaatgtgcaacatcctcaaaggg

SEQ ID NO: 38134 - DNA, 24 bp, Artificial Sequence
  Synthetic
attataggcgcggaatatttaccg

SEQ ID NO: 38135 - DNA, 22 bp, Artificial Sequence
  Synthetic
aatggcgcatgtttctgcatcc

SEQ ID NO: 38136 - DNA, 23 bp, Artificial Sequence
  Synthetic
cctgttgatctgtcagtgaaacg

SEQ ID NO: 38137 - DNA, 22 bp, Artificial Sequence
  Synthetic
atatggtttgtggggtgtctga

SEQ ID NO: 38138 - DNA, 21 bp, Artificial Sequence
  Synthetic
cgacagtgtgagtgtggtagc

SEQ ID NO: 38139 - DNA, 22 bp, Artificial Sequence
  Synthetic
gaaggtaggaccattgaagggc

SEQ ID NO: 38140 - DNA, 23 bp, Artificial Sequence
  Synthetic
acttgggaaatttgtcatggagt

SEQ ID NO: 38141 - DNA, 21 bp, Artificial Sequence
  Synthetic
gtaaggaacgaggcggtgagc

SEQ ID NO: 38142 - DNA, 21 bp, Artificial Sequence
  Synthetic
agcaagtacaaaggaagccac

SEQ ID NO: 38143 - DNA, 23 bp, Artificial Sequence
  Synthetic
ggatttgatgtttaatcgccccg

SEQ ID NO: 38144 - DNA, 20 bp, Artificial Sequence
  Synthetic
gccacccgcgattatgcagt

SEQ ID NO: 38145 - DNA, 20 bp, Artificial Sequence
  Synthetic
cgaatgctggcgcgaacgta

SEQ ID NO: 38146 - DNA, 25 bp, Artificial Sequence
  Synthetic
tacggacaacatcctttttctacag

SEQ ID NO: 38147 - DNA, 25 bp, Artificial Sequence
  Synthetic
ggcaagaacaatttcatcaaatcca

SEQ ID NO: 38148 - DNA, 22 bp, Artificial Sequence
  Synthetic
ttgaatgaggtgtacctggcgg

SEQ ID NO: 38149 - DNA, 22 bp, Artificial Sequence
  Synthetic
gcctggagctgtccatggtatc

SEQ ID NO: 38150 - DNA, 20 bp, Artificial Sequence
  Synthetic
gcgggggaagcggtatgtcg

SEQ ID NO: 38151 - DNA, 23 bp, Artificial Sequence
  Synthetic
cgaatggttttaagaagcaccac

SEQ ID NO: 38152 - DNA, 24 bp, Artificial Sequence
  Synthetic
ctgcagtttgtcattactgaccaa

SEQ ID NO: 38153 - DNA, 22 bp, Artificial Sequence
  Synthetic
cggttccaaatattgcgcaggg

SEQ ID NO: 38154 - DNA, 20 bp, Artificial Sequence
  Synthetic
cgttgaacccggccaaggac

SEQ ID NO: 38155 - DNA, 22 bp, Artificial Sequence
  Synthetic
tgaggaaatgcgagactgcagg

SEQ ID NO: 38156 - DNA, 23 bp, Artificial Sequence
  Synthetic
ctaactgcccagctgttcttaat

SEQ ID NO: 38157 - DNA, 22 bp, Artificial Sequence
  Synthetic
accagtacgaggactgatcggc

SEQ ID NO: 38158 - DNA, 22 bp, Artificial Sequence
  Synthetic
ggtgaatttgatttgccggaag

SEQ ID NO: 38159 - DNA, 25 bp, Artificial Sequence
  Synthetic
tcatccagatatagtactgcttcca

SEQ ID NO: 38160 - DNA, 22 bp, Artificial Sequence
  Synthetic
tacaactacggagacccagaaa

SEQ ID NO: 38161 - DNA, 20 bp, Artificial Sequence
  Synthetic
gcatacccgaggacgcactg

SEQ ID NO: 38162 - DNA, 21 bp, Artificial Sequence
  Synthetic
ttgcaaacctagctgctccgc

SEQ ID NO: 38163 - DNA, 22 bp, Artificial Sequence
  Synthetic
gaagggacggcaagtaaaacgc

SEQ ID NO: 38164 - DNA, 20 bp, Artificial Sequence
  Synthetic
ggatcctagcgtacagccag

SEQ ID NO: 38165 - DNA, 20 bp, Artificial Sequence
  Synthetic
aagccactttagccccagcg

SEQ ID NO: 38166 - DNA, 20 bp, Artificial Sequence
  Synthetic
acggccggatgcagaggaaa

SEQ ID NO: 38167 - DNA, 22 bp, Artificial Sequence
  Synthetic
tggtcttacatgcacatcgccg

SEQ ID NO: 38168 - DNA, 23 bp, Artificial Sequence
  Synthetic
aagacgtaaaccttgaaatgcca

SEQ ID NO: 38169 - DNA, 20 bp, Artificial Sequence
  Synthetic
ccagcgttcgctttgacaac

SEQ ID NO: 38170 - DNA, 21 bp, Artificial Sequence
  Synthetic
gtgagttggcctggaaatgac

SEQ ID NO: 38171 - DNA, 20 bp, Artificial Sequence
  Synthetic
cttaccccgccaactatccc

SEQ ID NO: 38172 - DNA, 20 bp, Artificial Sequence
  Synthetic
gcagggcgcccataacatca

SEQ ID NO: 38173 - DNA, 22 bp, Artificial Sequence
  Synthetic
ctgttggacaccggcataagct

SEQ ID NO: 38174 - DNA, 20 bp, Artificial Sequence
  Synthetic
cggaagccttcaaaacgtgt

SEQ ID NO: 38175 - DNA, 21 bp, Artificial Sequence
  Synthetic
gcttccatacctgggattgtg

SEQ ID NO: 38176 - DNA, 25 bp, Artificial Sequence
  Synthetic
agacagagcactaaaatccctatgg

SEQ ID NO: 38177 - DNA, 20 bp, Artificial Sequence
  Synthetic
cctgggctttggacttctgc

SEQ ID NO: 38178 - DNA, 22 bp, Artificial Sequence
  Synthetic
cagcaacggcaggaaatctggg

SEQ ID NO: 38179 - DNA, 22 bp, Artificial Sequence
  Synthetic
aaagcgaagatcagttgcaacg

SEQ ID NO: 38180 - DNA, 25 bp, Artificial Sequence
  Synthetic
gctgaatttaatcatctgtagtggc

SEQ ID NO: 38181 - DNA, 20 bp, Artificial Sequence
  Synthetic
ctccgacaacagctgctgtc

SEQ ID NO: 38182 - DNA, 22 bp, Artificial Sequence
  Synthetic
ccactaaaagtcgtggtggaag

SEQ ID NO: 38183 - DNA, 25 bp, Artificial Sequence
  Synthetic
cattttttcttcttcgacttttgcc

SEQ ID NO: 38184 - DNA, 24 bp, Artificial Sequence
  Synthetic
aatattgtatttccagagcccccg

SEQ ID NO: 38185 - DNA, 20 bp, Artificial Sequence
  Synthetic
ccactcagcgacaaaccttt

SEQ ID NO: 38186 - DNA, 22 bp, Artificial Sequence
  Synthetic
caatccctacccaccatcttca

SEQ ID NO: 38187 - DNA, 20 bp, Artificial Sequence
  Synthetic
cccccctagcagtaaaggct

SEQ ID NO: 38188 - DNA, 20 bp, Artificial Sequence
  Synthetic
ggacgctggcaatgacaatg

SEQ ID NO: 38189 - DNA, 22 bp, Artificial Sequence
  Synthetic
ggtacttgttgtatggtgccaa

SEQ ID NO: 38190 - DNA, 23 bp, Artificial Sequence
  Synthetic
aactctacttaaaagcaagcgcg

SEQ ID NO: 38191 - DNA, 25 bp, Artificial Sequence
  Synthetic
agttcatgacaacagaagatgaaca

SEQ ID NO: 38192 - DNA, 23 bp, Artificial Sequence
  Synthetic
gtggtatcagacagcatttgtgt

SEQ ID NO: 38193 - DNA, 23 bp, Artificial Sequence
  Synthetic
aaagggaaaatattgcccacact

SEQ ID NO: 38194 - DNA, 21 bp, Artificial Sequence
  Synthetic
caaacccaggaatcctcactg

SEQ ID NO: 38195 - DNA, 25 bp, Artificial Sequence
  Synthetic
ccttttttgatttgcgccttacttg

SEQ ID NO: 38196 - DNA, 25 bp, Artificial Sequence
  Synthetic
cctgttgctatagatgtgaagttgc

SEQ ID NO: 38197 - DNA, 24 bp, Artificial Sequence
  Synthetic
atttcctcccctattgttagctct

SEQ ID NO: 38198 - DNA, 25 bp, Artificial Sequence
  Synthetic
gattgctcacataatcatagtcgca

SEQ ID NO: 38199 - DNA, 22 bp, Artificial Sequence
  Synthetic
ttgggtattggtactgggagag

SEQ ID NO: 38200 - DNA, 21 bp, Artificial Sequence
  Synthetic
tgtcatatctggcacaaccga

SEQ ID NO: 38201 - DNA, 21 bp, Artificial Sequence
  Synthetic
ttcccgcgcaatagtatttgg

SEQ ID NO: 38202 - DNA, 25 bp, Artificial Sequence
  Synthetic
actgaggggaatagaaataggaaga

SEQ ID NO: 38203 - DNA, 22 bp, Artificial Sequence
  Synthetic
atttctttgtcagagcaggcac

SEQ ID NO: 38204 - DNA, 23 bp, Artificial Sequence
  Synthetic
acccctgcaactgaaaaagaaga

SEQ ID NO: 38205 - DNA, 23 bp, Artificial Sequence
  Synthetic
atacacagatcagtaggagaggc

SEQ ID NO: 38206 - DNA, 20 bp, Artificial Sequence
  Synthetic
cggcacgcttcacactgacg

SEQ ID NO: 38207 - DNA, 23 bp, Artificial Sequence
  Synthetic
tatggaacctactgaagagccaa

SEQ ID NO: 38208 - DNA, 19 bp, Artificial Sequence
  Synthetic
ctgtgccgcctagccagca

SEQ ID NO: 38209 - DNA, 22 bp, Artificial Sequence
  Synthetic
acataaatcctccaattggggc

SEQ ID NO: 38210 - DNA, 20 bp, Artificial Sequence
  Synthetic
tcggtgctacctgtgtcaca

SEQ ID NO: 38211 - DNA, 22 bp, Artificial Sequence
  Synthetic
gacggacaagattcacaacctt

SEQ ID NO: 38212 - DNA, 20 bp, Artificial Sequence
  Synthetic
cgatgaggatgaggaggtgg

SEQ ID NO: 38213 - DNA, 24 bp, Artificial Sequence
  Synthetic
aacttacaagacagccaaaaaagg

SEQ ID NO: 38214 - DNA, 20 bp, Artificial Sequence
  Synthetic
tagatgcgtgccaggaacag

SEQ ID NO: 38215 - DNA, 22 bp, Artificial Sequence
  Synthetic
aacagtaacagttcagctacgc

SEQ ID NO: 38216 - DNA, 22 bp, Artificial Sequence
  Synthetic
ctgcatttctttccactcctca

SEQ ID NO: 38217 - DNA, 20 bp, Artificial Sequence
  Synthetic
gaaatttgggcgtgcccccg

SEQ ID NO: 38218 - DNA, 21 bp, Artificial Sequence
  Synthetic
cgactcggaagacttcggagc

SEQ ID NO: 38219 - DNA, 20 bp, Artificial Sequence
  Synthetic
ggaatctccccggttgctcc

SEQ ID NO: 38220 - DNA, 21 bp, Artificial Sequence
  Synthetic
cgcaccgcttgagtccttacg

SEQ ID NO: 38221 - DNA, 21 bp, Artificial Sequence
  Synthetic
tcagcatgcaggccaattggg

SEQ ID NO: 38222 - DNA, 21 bp, Artificial Sequence
  Synthetic
tcagcggctcgtctgatgaca

SEQ ID NO: 38223 - DNA, 22 bp, Artificial Sequence
  Synthetic
cctccatgcgaggttaacacca

SEQ ID NO: 38224 - DNA, 22 bp, Artificial Sequence
  Synthetic
atgcatacgaccaggaagtggc

SEQ ID NO: 38225 - DNA, 22 bp, Artificial Sequence
  Synthetic
atgagatcttgctcggaccagc

SEQ ID NO: 38226 - DNA, 20 bp, Artificial Sequence
  Synthetic
gcgggtgccaagaccatcag

SEQ ID NO: 38227 - DNA, 20 bp, Artificial Sequence
  Synthetic
gcagtgccccagacctacca

SEQ ID NO: 38228 - DNA, 22 bp, Artificial Sequence
  Synthetic
gttcctggctgatggaggttgc

SEQ ID NO: 38229 - DNA, 22 bp, Artificial Sequence
  Synthetic
tatgtcaccccgggagagagac

SEQ ID NO: 38230 - DNA, 22 bp, Artificial Sequence
  Synthetic
tgcctaattcgccttaagccca

SEQ ID NO: 38231 - DNA, 21 bp, Artificial Sequence
  Synthetic
cgggttacaactggctgagca

SEQ ID NO: 38232 - DNA, 20 bp, Artificial Sequence
  Synthetic
gcattcgtcgtgagcggctt

SEQ ID NO: 38233 - DNA, 22 bp, Artificial Sequence
  Synthetic
ggagatggcgtgatgcatacga

SEQ ID NO: 38234 - DNA, 22 bp, Artificial Sequence
  Synthetic
aaggacttgctggacgacaaca

SEQ ID NO: 38235 - DNA, 22 bp, Artificial Sequence
  Synthetic
atcagtgttgtgacctggagcc

SEQ ID NO: 38236 - DNA, 19 bp, Artificial Sequence
  Synthetic
ccgagccttcacggaggct

SEQ ID NO: 38237 - DNA, 22 bp, Artificial Sequence
  Synthetic
ggcgggggagacatttatcaca

SEQ ID NO: 38238 - DNA, 25 bp, Artificial Sequence
  Synthetic
ttcaacaataacaacacaagaagca

SEQ ID NO: 38239 - DNA, 21 bp, Artificial Sequence
  Synthetic
ggcctcaatctcatctggtcc

SEQ ID NO: 38240 - DNA, 22 bp, Artificial Sequence
  Synthetic
caggggctgagtgattacatca

SEQ ID NO: 38241 - DNA, 24 bp, Artificial Sequence
  Synthetic
gccttacattgaaagacaagcaaa

SEQ ID NO: 38242 - DNA, 24 bp, Artificial Sequence
  Synthetic
aatcctgaagctttagtcaggaga

SEQ ID NO: 38243 - DNA, 25 bp, Artificial Sequence
  Synthetic
atcccagactggaagttaaattgac

SEQ ID NO: 38244 - DNA, 23 bp, Artificial Sequence
  Synthetic
aatttccctttttggttcaccca

SEQ ID NO: 38245 - DNA, 22 bp, Artificial Sequence
  Synthetic
tgatgggggcattcatctccac

SEQ ID NO: 38246 - DNA, 22 bp, Artificial Sequence
  Synthetic
ttgggagcttgttcgagagctg

SEQ ID NO: 38247 - DNA, 20 bp, Artificial Sequence
  Synthetic
agtcagggctggaagacgcc

SEQ ID NO: 38248 - DNA, 22 bp, Artificial Sequence
  Synthetic
ttccacacaccgtctcctagga

SEQ ID NO: 38249 - DNA, 23 bp, Artificial Sequence
  Synthetic
agcgtatttgctatgcttgttgt

SEQ ID NO: 38250 - DNA, 24 bp, Artificial Sequence
  Synthetic
gctgacgctattcaatttttggag

SEQ ID NO: 38251 - DNA, 25 bp, Artificial Sequence
  Synthetic
gtacaggtagactctttgtcatacg

SEQ ID NO: 38252 - DNA, 23 bp, Artificial Sequence
  Synthetic
cccttgctggacgtttattgatg

SEQ ID NO: 38253 - DNA, 22 bp, Artificial Sequence
  Synthetic
acggttgatattgttggccccg

SEQ ID NO: 38254 - DNA, 20 bp, Artificial Sequence
  Synthetic
atctgaccgcgtcatctcca

SEQ ID NO: 38255 - DNA, 25 bp, Artificial Sequence
  Synthetic
acttttagaaacagctgacagaact

SEQ ID NO: 38256 - DNA, 25 bp, Artificial Sequence
  Synthetic
gagctcagggtaataataatggtgt

SEQ ID NO: 38257 - DNA, 20 bp, Artificial Sequence
  Synthetic
ttgttttccgccccgaggtt

SEQ ID NO: 38258 - DNA, 21 bp, Artificial Sequence
  Synthetic
ccgcgtcgtacttgctgatcc

SEQ ID NO: 38259 - DNA, 21 bp, Artificial Sequence
  Synthetic
tgtccgatcgatcttcggccc

SEQ ID NO: 38260 - DNA, 20 bp, Artificial Sequence
  Synthetic
tctaaggggatgcgccgtct

SEQ ID NO: 38261 - DNA, 19 bp, Artificial Sequence
  Synthetic
aagcccttgacctccccgc

SEQ ID NO: 38262 - DNA, 18 bp, Artificial Sequence
  Synthetic
tgtcgctgccgggcttga

SEQ ID NO: 38263 - DNA, 22 bp, Artificial Sequence
  Synthetic
gagtcgacatgtacctggctcg

SEQ ID NO: 38264 - DNA, 20 bp, Artificial Sequence
  Synthetic
ccgctgcatacccactcctc

SEQ ID NO: 38265 - DNA, 19 bp, Artificial Sequence
  Synthetic
cctgtgccggctgtcgagt

SEQ ID NO: 38266 - DNA, 20 bp, Artificial Sequence
  Synthetic
ccctcacttgctgctgctcc

SEQ ID NO: 38267 - DNA, 21 bp, Artificial Sequence
  Synthetic
ccagcgcccatctgttatccc

SEQ ID NO: 38268 - DNA, 22 bp, Artificial Sequence
  Synthetic
ttctccgcaagctcacgaatgt

SEQ ID NO: 38269 - DNA, 20 bp, Artificial Sequence
  Synthetic
gacctaccacagctggggcc

SEQ ID NO: 38270 - DNA, 19 bp, Artificial Sequence
  Synthetic
gccttcgtcgcggtgcaga

SEQ ID NO: 38271 - DNA, 21 bp, Artificial Sequence
  Synthetic
ggttgctgttttagcccccca

SEQ ID NO: 38272 - DNA, 20 bp, Artificial Sequence
  Synthetic
atgacgggtttatgcagcgt

SEQ ID NO: 38273 - DNA, 21 bp, Artificial Sequence
  Synthetic
cggtgcggatctataaggtga

SEQ ID NO: 38274 - DNA, 20 bp, Artificial Sequence
  Synthetic
tctaaaggaggccaacgcag

SEQ ID NO: 38275 - DNA, 20 bp, Artificial Sequence
  Synthetic
cttttgggggccagaatctc

SEQ ID NO: 38276 - DNA, 20 bp, Artificial Sequence
  Synthetic
aaccccctaacaccgcctta

SEQ ID NO: 38277 - DNA, 21 bp, Artificial Sequence
  Synthetic
aatacaaacacaatcggggcg

SEQ ID NO: 38278 - DNA, 19 bp, Artificial Sequence
  Synthetic
gcattccgagcctcgtccg

SEQ ID NO: 38279 - DNA, 19 bp, Artificial Sequence
  Synthetic
ccgtcgggcatcatgagcg

SEQ ID NO: 38280 - DNA, 19 bp, Artificial Sequence
  Synthetic
aggtccgcctttgccccct

SEQ ID NO: 38281 - DNA, 23 bp, Artificial Sequence
  Synthetic
taccctatagtgcagaacatcca

SEQ ID NO: 38282 - DNA, 21 bp, Artificial Sequence
  Synthetic
gacagcatgtcagggagtagg

SEQ ID NO: 38283 - DNA, 20 bp, Artificial Sequence
  Synthetic
tgggaaacatggtggacaga

SEQ ID NO: 38284 - DNA, 23 bp, Artificial Sequence
  Synthetic
ttgcctagtgttacgaaactgac

SEQ ID NO: 38285 - DNA, 22 bp, Artificial Sequence
  Synthetic
aattgggtgtcgacatagcaga

SEQ ID NO: 38286 - DNA, 20 bp, Artificial Sequence
  Synthetic
cacatgcctgtgtacccaca

SEQ ID NO: 38287 - DNA, 22 bp, Artificial Sequence
  Synthetic
gagatcttcagacctggaggag

SEQ ID NO: 38288 - DNA, 22 bp, Artificial Sequence
  Synthetic
atcaagcagctccaggcaagaa

SEQ ID NO: 38289 - DNA, 22 bp, Artificial Sequence
  Synthetic
gcctggctagaagcacaagagg

SEQ ID NO: 38290 - DNA, 22 bp, Artificial Sequence
  Synthetic
aaacaccatctttcggaggcgc

SEQ ID NO: 38291 - DNA, 19 bp, Artificial Sequence
  Synthetic
gcgtccaccccggaaggtt

SEQ ID NO: 38292 - DNA, 22 bp, Artificial Sequence
  Synthetic
ctctttccggatccggcgttgc

SEQ ID NO: 38293 - DNA, 19 bp, Artificial Sequence
  Synthetic
cgccaccgcaacaaccagg

SEQ ID NO: 38294 - DNA, 20 bp, Artificial Sequence
  Synthetic
caaggtgtcggcgtggttgg

SEQ ID NO: 38295 - DNA, 19 bp, Artificial Sequence
  Synthetic
tgctggccaacaatccgcc

SEQ ID NO: 38296 - DNA, 22 bp, Artificial Sequence
  Synthetic
tagggtgctaaagttcaccgcc

SEQ ID NO: 38297 - DNA, 19 bp, Artificial Sequence
  Synthetic
gggttcagcagctccagca

SEQ ID NO: 38298 - DNA, 20 bp, Artificial Sequence
  Synthetic
gcgactggtacacggacacc

SEQ ID NO: 38299 - DNA, 18 bp, Artificial Sequence
  Synthetic
gcagcacgcggtccgtaa

SEQ ID NO: 38300 - DNA, 20 bp, Artificial Sequence
  Synthetic
ggcgagcgtatcgtcgaagg

SEQ ID NO: 38301 - DNA, 20 bp, Artificial Sequence
  Synthetic
gttaaactcggcccgctcgt

SEQ ID NO: 38302 - DNA, 19 bp, Artificial Sequence
  Synthetic
agcagggtcgcgacgagct

SEQ ID NO: 38303 - DNA, 22 bp, Artificial Sequence
  Synthetic
tcttgtgtactcacgccctccc

SEQ ID NO: 38304 - DNA, 22 bp, Artificial Sequence
  Synthetic
gttgaaaacctcgttccgggcc

SEQ ID NO: 38305 - DNA, 21 bp, Artificial Sequence
  Synthetic
cgtaagtacgccttcctcccg

SEQ ID NO: 38306 - DNA, 19 bp, Artificial Sequence
  Synthetic
cccgcgacagaaccggagt

SEQ ID NO: 38307 - DNA, 19 bp, Artificial Sequence
  Synthetic
ccctgtgtggggcagtgga

SEQ ID NO: 38308 - DNA, 20 bp, Artificial Sequence
  Synthetic
agggcctccaggaagaccag

SEQ ID NO: 38309 - DNA, 19 bp, Artificial Sequence
  Synthetic
cgggccgccaaaaccccaa

SEQ ID NO: 38310 - DNA, 19 bp, Artificial Sequence
  Synthetic
cgtagctggcgttgtgggt

SEQ ID NO: 38311 - DNA, 21 bp, Artificial Sequence
  Synthetic
tggacgtttgggaacacaggc

SEQ ID NO: 38312 - DNA, 22 bp, Artificial Sequence
  Synthetic
atctgctgtaccgaaccaccca

SEQ ID NO: 38313 - DNA, 22 bp, Artificial Sequence
  Synthetic
ctgtagtacagcgcggtgttgg

SEQ ID NO: 38314 - DNA, 19 bp, Artificial Sequence
  Synthetic
cgggttcggctggttcgac

SEQ ID NO: 38315 - DNA, 19 bp, Artificial Sequence
  Synthetic
cggaacgcagccaaaggcc

SEQ ID NO: 38316 - DNA, 19 bp, Artificial Sequence
  Synthetic
ggacaacctggccgtcgag

SEQ ID NO: 38317 - DNA, 19 bp, Artificial Sequence
  Synthetic
ggtgcagctcgcgtttcgg

SEQ ID NO: 38318 - DNA, 19 bp, Artificial Sequence
  Synthetic
gttcctgtcggccggtgct

SEQ ID NO: 38319 - DNA, 20 bp, Artificial Sequence
  Synthetic
ggttcaaacccctggtgcgg

SEQ ID NO: 38320 - DNA, 18 bp, Artificial Sequence
  Synthetic
aacagagcacgcgcccca

SEQ ID NO: 38321 - DNA, 20 bp, Artificial Sequence
  Synthetic
tgggcctggatctggagtcg

SEQ ID NO: 38322 - DNA, 20 bp, Artificial Sequence
  Synthetic
gcgagctcggcttctaccgc

SEQ ID NO: 38323 - DNA, 19 bp, Artificial Sequence
  Synthetic
ccgtgacgtaccaggccag

SEQ ID NO: 38324 - DNA, 22 bp, Artificial Sequence
  Synthetic
tgaacatggtcaacaaacgcgc

SEQ ID NO: 38325 - DNA, 21 bp, Artificial Sequence
  Synthetic
ccctcctcacaaactgcctgc

SEQ ID NO: 38326 - DNA, 20 bp, Artificial Sequence
  Synthetic
ggggtggcgagggtgatcca

SEQ ID NO: 38327 - DNA, 21 bp, Artificial Sequence
  Synthetic
caacgccctggagcactttgg

SEQ ID NO: 38328 - DNA, 18 bp, Artificial Sequence
  Synthetic
tcgtgagtcccgcgcaca

SEQ ID NO: 38329 - DNA, 20 bp, Artificial Sequence
  Synthetic
ccttcttgtaccaccgcccg

SEQ ID NO: 38330 - DNA, 21 bp, Artificial Sequence
  Synthetic
ctgcacacgaccaaaacggac

SEQ ID NO: 38331 - DNA, 18 bp, Artificial Sequence
  Synthetic
tcccccacccaccacaca

SEQ ID NO: 38332 - DNA, 22 bp, Artificial Sequence
  Synthetic
gtcgtgtcgtgttgtgtcgtgg

SEQ ID NO: 38333 - DNA, 20 bp, Artificial Sequence
  Synthetic
gggaaaactctggcagcgca

SEQ ID NO: 38334 - DNA, 19 bp, Artificial Sequence
  Synthetic
ggagccacgagggaccgta

SEQ ID NO: 38335 - DNA, 19 bp, Artificial Sequence
  Synthetic
gggattacgggccgcacgt

SEQ ID NO: 38336 - DNA, 21 bp, Artificial Sequence
  Synthetic
ttttggaccagctgaccgacc

SEQ ID NO: 38337 - DNA, 20 bp, Artificial Sequence
  Synthetic
tctagcacacccacgggtct

SEQ ID NO: 38338 - DNA, 22 bp, Artificial Sequence
  Synthetic
gccgtctgccgcactttatagg

SEQ ID NO: 38339 - DNA, 21 bp, Artificial Sequence
  Synthetic
accttgacctcgcttgtcacg

SEQ ID NO: 38340 - DNA, 25 bp, Artificial Sequence
  Synthetic
tgaattatcacgtatggtacagtgg

SEQ ID NO: 38341 - DNA, 20 bp, Artificial Sequence
  Synthetic
gaaaacagctggcggggaat

SEQ ID NO: 38342 - DNA, 20 bp, Artificial Sequence
  Synthetic
atgcgaccctcacgttttgg

SEQ ID NO: 38343 - DNA, 21 bp, Artificial Sequence
  Synthetic
cgagacgacgcagaaacgagg

SEQ ID NO: 38344 - DNA, 25 bp, Artificial Sequence
  Synthetic
aacaactgtataagacatgcaaagc

SEQ ID NO: 38345 - DNA, 21 bp, Artificial Sequence
  Synthetic
ttgaatcaggggggccttcac

SEQ ID NO: 38346 - DNA, 21 bp, Artificial Sequence
  Synthetic
tgtgaccagcactcctgaacg

SEQ ID NO: 38347 - DNA, 22 bp, Artificial Sequence
  Synthetic
aggttgagcattgcatttgacc

SEQ ID NO: 38348 - DNA, 25 bp, Artificial Sequence
  Synthetic
ttctacactgcagagaaacaaatcc

SEQ ID NO: 38349 - DNA, 22 bp, Artificial Sequence
  Synthetic
ttgttattggaacgcctccggt

SEQ ID NO: 38350 - DNA, 25 bp, Artificial Sequence
  Synthetic
attagattttgtgtagtctgcagcc

SEQ ID NO: 38351 - DNA, 20 bp, Artificial Sequence
  Synthetic
tggtagaggaactggaggca

SEQ ID NO: 38352 - DNA, 23 bp, Artificial Sequence
  Synthetic
aatatttgagcgtgatgtggagg

SEQ ID NO: 38353 - DNA, 22 bp, Artificial Sequence
  Synthetic
tacaggcagatgatgatttgcg

SEQ ID NO: 38354 - DNA, 24 bp, Artificial Sequence
  Synthetic
taatttgtgttttgcttgctgtcg

SEQ ID NO: 38355 - DNA, 23 bp, Artificial Sequence
  Synthetic
aaattgtacagcttgctccaaac

SEQ ID NO: 38356 - DNA, 21 bp, Artificial Sequence
  Synthetic
ggaaattccctggcactgttc

SEQ ID NO: 38357 - DNA, 21 bp, Artificial Sequence
  Synthetic
ctaatggcgccgatacaactg

SEQ ID NO: 38358 - DNA, 20 bp, Artificial Sequence
  Synthetic
cagatgatgcagctgtggca

SEQ ID NO: 38359 - DNA, 20 bp, Artificial Sequence
  Synthetic
agaatggaggagacgcaaga

SEQ ID NO: 38360 - DNA, 21 bp, Artificial Sequence
  Synthetic
acatcctgcagtaaccagtgg

SEQ ID NO: 38361 - DNA, 23 bp, Artificial Sequence
  Synthetic
atcacagtctggtcaggttactc

SEQ ID NO: 38362 - DNA, 25 bp, Artificial Sequence
  Synthetic
ctgatattatcaggttgggtaggcc

SEQ ID NO: 38363 - DNA, 20 bp, Artificial Sequence
  Synthetic
gttgcagcaagacatgtcca

SEQ ID NO: 38364 - DNA, 21 bp, Artificial Sequence
  Synthetic
gtcgttatgtatcgcctccac

SEQ ID NO: 38365 - DNA, 22 bp, Artificial Sequence
  Synthetic
gaccgaatgcgttccttcattg

SEQ ID NO: 38366 - DNA, 20 bp, Artificial Sequence
  Synthetic
accccagagcaccaatggta

SEQ ID NO: 38367 - DNA, 20 bp, Artificial Sequence
  Synthetic
ggaggaggagcgagaacctt

SEQ ID NO: 38368 - DNA, 22 bp, Artificial Sequence
  Synthetic
actctcggagaatctgtcccgt

SEQ ID NO: 38369 - DNA, 20 bp, Artificial Sequence
  Synthetic
tatacctggggggtctgggt

SEQ ID NO: 38370 - DNA, 21 bp, Artificial Sequence
  Synthetic
gagatgccataccagagggaa

SEQ ID NO: 38371 - DNA, 25 bp, Artificial Sequence
  Synthetic
ccgttttgtgtataaaaggtccagc

SEQ ID NO: 38372 - DNA, 24 bp, Artificial Sequence
  Synthetic
cagaccaaatgtccctattgatcc

SEQ ID NO: 38373 - DNA, 24 bp, Artificial Sequence
  Synthetic
aaacgtttacgaactgtagatgct

SEQ ID NO: 38374 - DNA, 25 bp, Artificial Sequence
  Synthetic
acattttcaaagtaaagacgacagc

SEQ ID NO: 38375 - DNA, 22 bp, Artificial Sequence
  Synthetic
gggaagcaacgatgtatcatca

SEQ ID NO: 38376 - DNA, 24 bp, Artificial Sequence
  Synthetic
agtgatagggttcaacaaatcacc

SEQ ID NO: 38377 - DNA, 20 bp, Artificial Sequence
  Synthetic
acccttccaggatctggtca

SEQ ID NO: 38378 - DNA, 23 bp, Artificial Sequence
  Synthetic
ccttgccatacgtgtctattgga

SEQ ID NO: 38379 - DNA, 22 bp, Artificial Sequence
  Synthetic
tgagagacccactaacatctgg

SEQ ID NO: 38380 - DNA, 25 bp, Artificial Sequence
  Synthetic
ttagacggtttggatttgatttgga

SEQ ID NO: 38381 - DNA, 23 bp, Artificial Sequence
  Synthetic
cctcgtgaatggacagaaaatcc

SEQ ID NO: 38382 - DNA, 25 bp, Artificial Sequence
  Synthetic
cgctatgactacccaacaaaaacag

SEQ ID NO: 38383 - DNA, 20 bp, Artificial Sequence
  Synthetic
gaagcaaacaacccgctgtg

SEQ ID NO: 38384 - DNA, 20 bp, Artificial Sequence
  Synthetic
ttcctgctgatggatgcctt

SEQ ID NO: 38385 - DNA, 20 bp, Artificial Sequence
  Synthetic
ctcactgcagagccacagaa

SEQ ID NO: 38386 - DNA, 22 bp, Artificial Sequence
  Synthetic
gaacaaatcagaaacatggccc

SEQ ID NO: 38387 - DNA, 20 bp, Artificial Sequence
  Synthetic
ccaggttaaaatacgccgca

SEQ ID NO: 38388 - DNA, 23 bp, Artificial Sequence
  Synthetic
tcgcaaaacaagattcctaccag

SEQ ID NO: 38389 - DNA, 22 bp, Artificial Sequence
  Synthetic
ggaaagcaaccagaagactgat

SEQ ID NO: 38390 - DNA, 20 bp, Artificial Sequence
  Synthetic
gaaactccctggcgttgttc

SEQ ID NO: 38391 - DNA, 20 bp, Artificial Sequence
  Synthetic
caaatgaaaatggcggcgac

SEQ ID NO: 38392 - DNA, 19 bp, Artificial Sequence
  Synthetic
ggaggccgacggacgaaga

SEQ ID NO: 38393 - DNA, 21 bp, Artificial Sequence
  Synthetic
caaggcctagcatatccaggg

SEQ ID NO: 38394 - DNA, 25 bp, Artificial Sequence
  Synthetic
ttacttttagatggctacttggacc

SEQ ID NO: 38395 - DNA, 20 bp, Artificial Sequence
  Synthetic
agtctgcggaaccggtgagt

SEQ ID NO: 38396 - DNA, 20 bp, Artificial Sequence
  Synthetic
gacatccgagcgatcccagc

SEQ ID NO: 38397 - DNA, 20 bp, Artificial Sequence
  Synthetic
tcacccaccctggctgtacc

SEQ ID NO: 38398 - DNA, 20 bp, Artificial Sequence
  Synthetic
gccatcgcctacttcggcat

SEQ ID NO: 38399 - DNA, 20 bp, Artificial Sequence
  Synthetic
ccaacatcacagggccgtct

SEQ ID NO: 38400 - DNA, 21 bp, Artificial Sequence
  Synthetic
cccgccttgccagttaatccc

SEQ ID NO: 38401 - DNA, 19 bp, Artificial Sequence
  Synthetic
gtgtggcacgtgaaggggc

SEQ ID NO: 38402 - DNA, 21 bp, Artificial Sequence
  Synthetic
ccctgtgtccgcgagactagg

SEQ ID NO: 38403 - DNA, 22 bp, Artificial Sequence
  Synthetic
tggacacaaccatgcgatctcc

SEQ ID NO: 38404 - DNA, 22 bp, Artificial Sequence
  Synthetic
catcggcactgtcctagaccag

SEQ ID NO: 38405 - DNA, 21 bp, Artificial Sequence
  Synthetic
gctacacgggcgactttgact

SEQ ID NO: 38406 - DNA, 20 bp, Artificial Sequence
  Synthetic
atccattccacgtggcccag

SEQ ID NO: 38407 - DNA, 19 bp, Artificial Sequence
  Synthetic
ccacggtggccagcatagg

SEQ ID NO: 38408 - DNA, 21 bp, Artificial Sequence
  Synthetic
cgaggatacgtccacgccttg

SEQ ID NO: 38409 - DNA, 22 bp, Artificial Sequence
  Synthetic
gaacgtttccgatcaacgccac

SEQ ID NO: 38410 - DNA, 20 bp, Artificial Sequence
  Synthetic
ttgtgagccagagcctgacg

SEQ ID NO: 38411 - DNA, 22 bp, Artificial Sequence
  Synthetic
gggccagacctgactacaatcc

SEQ ID NO: 38412 - DNA, 22 bp, Artificial Sequence
  Synthetic
ggagacatcgagccagagctgt

SEQ ID NO: 38413 - DNA, 21 bp, Artificial Sequence
  Synthetic
acaatgccttggtgtatgtgg

SEQ ID NO: 38414 - DNA, 25 bp, Artificial Sequence
  Synthetic
tgaaaataggaaacttcagagtcgg

SEQ ID NO: 38415 - DNA, 23 bp, Artificial Sequence
  Synthetic
ttgctgctgtaaatgtgttaggc

SEQ ID NO: 38416 - DNA, 22 bp, Artificial Sequence
  Synthetic
aatttctttttgctgccctggg

SEQ ID NO: 38417 - DNA, 25 bp, Artificial Sequence
  Synthetic
gcgaaaaacaatatgtcagttttgc

SEQ ID NO: 38418 - DNA, 25 bp, Artificial Sequence
  Synthetic
ctatgatcaatcaccaaattgctgg

SEQ ID NO: 38419 - DNA, 20 bp, Artificial Sequence
  Synthetic
ggtccagcggaactgattcc

SEQ ID NO: 38420 - DNA, 20 bp, Artificial Sequence
  Synthetic
tggattttctgggtcaggcg

SEQ ID NO: 38421 - DNA, 20 bp, Artificial Sequence
  Synthetic
tgctggtaccactggagaca

SEQ ID NO: 38422 - DNA, 24 bp, Artificial Sequence
  Synthetic
gatgattggcaattggcatttgtg

SEQ ID NO: 38423 - DNA, 22 bp, Artificial Sequence
  Synthetic
tctcagttattctgctggtgca

SEQ ID NO: 38424 - DNA, 24 bp, Artificial Sequence
  Synthetic
gagactgaaacaccatgtagtcag

SEQ ID NO: 38425 - DNA, 21 bp, Artificial Sequence
  Synthetic
tctgtattgcagcctccaaca

SEQ ID NO: 38426 - DNA, 20 bp, Artificial Sequence
  Synthetic
cagccattaggtgtgggcat

SEQ ID NO: 38427 - DNA, 25 bp, Artificial Sequence
  Synthetic
tacctctgatgcccaaatattcaat

SEQ ID NO: 38428 - DNA, 24 bp, Artificial Sequence
  Synthetic
aggattgaaggccaaaccaaaatt

SEQ ID NO: 38429 - DNA, 20 bp, Artificial Sequence
  Synthetic
ttcctgacctgcactgcttg

SEQ ID NO: 38430 - DNA, 20 bp, Artificial Sequence
  Synthetic
cagttactgcgacgtgaggt

SEQ ID NO: 38431 - DNA, 21 bp, Artificial Sequence
  Synthetic
accggtcgatgtatgtcttgt

SEQ ID NO: 38432 - DNA, 22 bp, Artificial Sequence
  Synthetic
aaccttttgttgcaagtgtgac

SEQ ID NO: 38433 - DNA, 25 bp, Artificial Sequence
  Synthetic
atgtactctgatttccacttcatcg

SEQ ID NO: 38434 - DNA, 20 bp, Artificial Sequence
  Synthetic
ctcggtgagaacatggcacc

SEQ ID NO: 38435 - DNA, 24 bp, Artificial Sequence
  Synthetic
attgtgttcttgaaataggggaca

SEQ ID NO: 38436 - DNA, 22 bp, Artificial Sequence
  Synthetic
gagtcacctaaaggagtggagg

SEQ ID NO: 38437 - DNA, 20 bp, Artificial Sequence
  Synthetic
tgcaccgaatcatgagggaa

SEQ ID NO: 38438 - DNA, 23 bp, Artificial Sequence
  Synthetic
aattgtgcttccttgtggtttgt

SEQ ID NO: 38439 - DNA, 20 bp, Artificial Sequence
  Synthetic
ggaggatttggaggacacct

SEQ ID NO: 38440 - DNA, 22 bp, Artificial Sequence
  Synthetic
agtgatggaaagcctcaacaac

SEQ ID NO: 38441 - DNA, 21 bp, Artificial Sequence
  Synthetic
ggccctacggacgaagaaggt

SEQ ID NO: 38442 - DNA, 25 bp, Artificial Sequence
  Synthetic
agttactgcacctgaatttatcaca

SEQ ID NO: 38443 - DNA, 20 bp, Artificial Sequence
  Synthetic
cttctggcgagactgtggtg

SEQ ID NO: 38444 - DNA, 24 bp, Artificial Sequence
  Synthetic
tgcccagaataagttttaccttcc

SEQ ID NO: 38445 - DNA, 20 bp, Artificial Sequence
  Synthetic
actactgtggccaaacggag

SEQ ID NO: 38446 - DNA, 23 bp, Artificial Sequence
  Synthetic
gatactggtatcctttttggcgc

SEQ ID NO: 38447 - DNA, 24 bp, Artificial Sequence
  Synthetic
ggagattctacatccaaatgtgca

SEQ ID NO: 38448 - DNA, 23 bp, Artificial Sequence
  Synthetic
gggttgcttatgaaagaatgtgc

SEQ ID NO: 38449 - DNA, 21 bp, Artificial Sequence
  Synthetic
catggactccaataccctgga

SEQ ID NO: 38450 - DNA, 21 bp, Artificial Sequence
  Synthetic
gacccaaggtgccttactgaa

SEQ ID NO: 38451 - DNA, 20 bp, Artificial Sequence
  Synthetic
ggccatgggtgtctttcgat

SEQ ID NO: 38452 - DNA, 25 bp, Artificial Sequence
  Synthetic
ttcagcaaacaagagtggataagct

SEQ ID NO: 38453 - DNA, 22 bp, Artificial Sequence
  Synthetic
tacggacacaaataccagcaga

SEQ ID NO: 38454 - DNA, 22 bp, Artificial Sequence
  Synthetic
acagctcagatggctcttcagc

SEQ ID NO: 38455 - DNA, 20 bp, Artificial Sequence
  Synthetic
ctacctgatctgtgcacgga

SEQ ID NO: 38456 - DNA, 25 bp, Artificial Sequence
  Synthetic
acaatttattaataaggtgcctgcg

SEQ ID NO: 38457 - DNA, 21 bp, Artificial Sequence
  Synthetic
acgagcaattaagcgactcag

SEQ ID NO: 38458 - DNA, 23 bp, Artificial Sequence
  Synthetic
gcacagaaaacagtccattaggg

SEQ ID NO: 38459 - DNA, 20 bp, Artificial Sequence
  Synthetic
cacagagggcaacaacagca

SEQ ID NO: 38460 - DNA, 21 bp, Artificial Sequence
  Synthetic
gcaattcctgcgataccaaca

SEQ ID NO: 38461 - DNA, 20 bp, Artificial Sequence
  Synthetic
ccagacgtcggctgctacac

SEQ ID NO: 38462 - DNA, 20 bp, Artificial Sequence
  Synthetic
aggcactgcttgtaaatcgc

SEQ ID NO: 38463 - DNA, 21 bp, Artificial Sequence
  Synthetic
ggacaggaacaggatacacca

SEQ ID NO: 38464 - DNA, 22 bp, Artificial Sequence
  Synthetic
caaacacgagtagacaagctga

SEQ ID NO: 38465 - DNA, 22 bp, Artificial Sequence
  Synthetic
tctgattgtgaatgcacccaat

SEQ ID NO: 38466 - DNA, 22 bp, Artificial Sequence
  Synthetic
agtatggtggaggctatggttt

SEQ ID NO: 38467 - DNA, 22 bp, Artificial Sequence
  Synthetic
cgctatagggcaggcttatccc

SEQ ID NO: 38468 - DNA, 20 bp, Artificial Sequence
  Synthetic
acacagcaggggtcttgggc

SEQ ID NO: 38469 - DNA, 21 bp, Artificial Sequence
  Synthetic
ccattgtgcttactggggcgg

SEQ ID NO: 38470 - DNA, 19 bp, Artificial Sequence
  Synthetic
gggtgtggaggtttggcga

SEQ ID NO: 38471 - DNA, 22 bp, Artificial Sequence
  Synthetic
ttcgcccacttggttgttgagt

SEQ ID NO: 38472 - DNA, 19 bp, Artificial Sequence
  Synthetic
ctcggggtcggtggtgctt

SEQ ID NO: 38473 - DNA, 19 bp, Artificial Sequence
  Synthetic
caagaggtgcgctgcccct

SEQ ID NO: 38474 - DNA, 20 bp, Artificial Sequence
  Synthetic
tggtggcggcttggttttgg

SEQ ID NO: 38475 - DNA, 18 bp, Artificial Sequence
  Synthetic
tgccgcacgagtgttggg

SEQ ID NO: 38476 - DNA, 22 bp, Artificial Sequence
  Synthetic
ggaaccttgcaaatgctcaccg

SEQ ID NO: 38477 - DNA, 22 bp, Artificial Sequence
  Synthetic
gaatgtcgggttcgcttgttgc

SEQ ID NO: 38478 - DNA, 22 bp, Artificial Sequence
  Synthetic
actacaggggcagggaaacaga

SEQ ID NO: 38479 - DNA, 20 bp, Artificial Sequence
  Synthetic
ggagctctctgggcagctgt

SEQ ID NO: 38480 - DNA, 20 bp, Artificial Sequence
  Synthetic
tgggtggatgacctgcaggc

SEQ ID NO: 38481 - DNA, 22 bp, Artificial Sequence
  Synthetic
atcctggagactgagtgtggct

SEQ ID NO: 38482 - DNA, 19 bp, Artificial Sequence
  Synthetic
cggcagggcggtgcatgtt

SEQ ID NO: 38483 - DNA, 21 bp, Artificial Sequence
  Synthetic
agtgtcaagaagggggtcggt

SEQ ID NO: 38484 - DNA, 20 bp, Artificial Sequence
  Synthetic
gaccctgggaagggaacgga

SEQ ID NO: 38485 - DNA, 19 bp, Artificial Sequence
  Synthetic
cgaggtgaggcgggctgtt

SEQ ID NO: 38486 - DNA, 22 bp, Artificial Sequence
  Synthetic
tactcatacgtctggtcggggc

SEQ ID NO: 38487 - DNA, 20 bp, Artificial Sequence
  Synthetic
gaagctgcaatcttcgcggc

SEQ ID NO: 38488 - DNA, 21 bp, Artificial Sequence
  Synthetic
gggaaaaagcgctggtggttg

SEQ ID NO: 38489 - DNA, 20 bp, Artificial Sequence
  Synthetic
tcaacaggagtgtgagcaga

SEQ ID NO: 38490 - DNA, 24 bp, Artificial Sequence
  Synthetic
atacctattgtgttttaaggcggg

SEQ ID NO: 38491 - DNA, 20 bp, Artificial Sequence
  Synthetic
gcgaatgcagtagcttggct

SEQ ID NO: 38492 - DNA, 20 bp, Artificial Sequence
  Synthetic
atcaagaagaggagggcgag

SEQ ID NO: 38493 - DNA, 21 bp, Artificial Sequence
  Synthetic
ccgttgactccacgtccagac

SEQ ID NO: 38494 - DNA, 21 bp, Artificial Sequence
  Synthetic
gcgatcaaggtcaccctccac

SEQ ID NO: 38495 - DNA, 20 bp, Artificial Sequence
  Synthetic
gggcggctaacacactgaaa

SEQ ID NO: 38496 - DNA, 22 bp, Artificial Sequence
  Synthetic
tttagaggttgccccagagcct

SEQ ID NO: 38497 - DNA, 20 bp, Artificial Sequence
  Synthetic
agggaattgggacgtccaca

SEQ ID NO: 38498 - DNA, 24 bp, Artificial Sequence
  Synthetic
acaggggacttttatttacatccc

SEQ ID NO: 38499 - DNA, 21 bp, Artificial Sequence
  Synthetic
ccttgcataggagagcattgg

SEQ ID NO: 38500 - DNA, 21 bp, Artificial Sequence
  Synthetic
taccaatttgcacttgggcag

SEQ ID NO: 38501 - DNA, 23 bp, Artificial Sequence
  Synthetic
ggatgcttaccgacagtattggt

SEQ ID NO: 38502 - DNA, 21 bp, Artificial Sequence
  Synthetic
ttggtggttggactacggcta

SEQ ID NO: 38503 - DNA, 21 bp, Artificial Sequence
  Synthetic
ggcaaccagaccaatcatcaa

SEQ ID NO: 38504 - DNA, 20 bp, Artificial Sequence
  Synthetic
ccgcacctagagcaggagat

SEQ ID NO: 38505 - DNA, 24 bp, Artificial Sequence
  Synthetic
gcaagcagaatttgatccaaatgc

SEQ ID NO: 38506 - DNA, 20 bp, Artificial Sequence
  Synthetic
aagccgtttcgatgtactgc

SEQ ID NO: 38507 - DNA, 25 bp, Artificial Sequence
  Synthetic
ttaaatgttacacctgcagatcctc

SEQ ID NO: 38508 - DNA, 22 bp, Artificial Sequence
  Synthetic
gattgctgtacctaccacctca

SEQ ID NO: 38509 - DNA, 25 bp, Artificial Sequence
  Synthetic
aaacaggttcaaatgtgtattgtgg

SEQ ID NO: 38510 - DNA, 22 bp, Artificial Sequence
  Synthetic
ggaacaggaacaggatacacca

SEQ ID NO: 38511 - DNA, 22 bp, Artificial Sequence
  Synthetic
agtcgttcaacaaacaagggtg

SEQ ID NO: 38512 - DNA, 25 bp, Artificial Sequence
  Synthetic
catagtgaatgcaccaaatcatgag

SEQ ID NO: 38513 - DNA, 24 bp, Artificial Sequence
  Synthetic
attggaatttctagcatggtggag

SEQ ID NO: 38514 - DNA, 21 bp, Artificial Sequence
  Synthetic
tggtggactattgcaagcaac

SEQ ID NO: 38515 - DNA, 23 bp, Artificial Sequence
  Synthetic
acgtgtaagcattgtcattgtcg

SEQ ID NO: 38516 - DNA, 24 bp, Artificial Sequence
  Synthetic
acttttggctatagaccttttggg

SEQ ID NO: 38517 - DNA, 24 bp, Artificial Sequence
  Synthetic
atgtagtttatttaggcaggccaa

SEQ ID NO: 38518 - DNA, 25 bp, Artificial Sequence
  Synthetic
acttaggtccacaagaaaaagatga

SEQ ID NO: 38519 - DNA, 21 bp, Artificial Sequence
  Synthetic
ctggagccagcttttagtcct

SEQ ID NO: 38520 - DNA, 22 bp, Artificial Sequence
  Synthetic
acgacgagaaagagaaccagcc

SEQ ID NO: 38521 - DNA, 24 bp, Artificial Sequence
  Synthetic
taaacccaagcagtagttctgttg

SEQ ID NO: 38522 - DNA, 25 bp, Artificial Sequence
  Synthetic
tatgacccagaatttgaacttcctc

SEQ ID NO: 38523 - DNA, 24 bp, Artificial Sequence
  Synthetic
cagaagcatcttaaatgttcccac

SEQ ID NO: 38524 - DNA, 20 bp, Artificial Sequence
  Synthetic
accatcacgtcctgttgctc

SEQ ID NO: 38525 - DNA, 25 bp, Artificial Sequence
  Synthetic
ccaggttgcattaggatcattaaac

SEQ ID NO: 38526 - DNA, 25 bp, Artificial Sequence
  Synthetic
agttcagtttgaattcacaaatccc

SEQ ID NO: 38527 - DNA, 25 bp, Artificial Sequence
  Synthetic
aaggggtattgaaattcaaaggggt

SEQ ID NO: 38528 - DNA, 25 bp, Artificial Sequence
  Synthetic
caggtttttatcttctttggctacc

SEQ ID NO: 38529 - DNA, 22 bp, Artificial Sequence
  Synthetic
gtttcctttacaaaaccacgcc

SEQ ID NO: 38530 - DNA, 19 bp, Artificial Sequence
  Synthetic
gggaacatcggggcgtacg

SEQ ID NO: 38531 - DNA, 21 bp, Artificial Sequence
  Synthetic
ccctctccaaggttccgttcg

SEQ ID NO: 38532 - DNA, 21 bp, Artificial Sequence
  Synthetic
tgtggcctcacctgaccaacc

SEQ ID NO: 38533 - DNA, 22 bp, Artificial Sequence
  Synthetic
atggtcatggcaagcttggagc

SEQ ID NO: 38534 - DNA, 22 bp, Artificial Sequence
  Synthetic
ctttgtgggaggagaacagccg

SEQ ID NO: 38535 - DNA, 19 bp, Artificial Sequence
  Synthetic
cgccaccccgtcgaccttt

SEQ ID NO: 38536 - DNA, 20 bp, Artificial Sequence
  Synthetic
tacatggcccggtacctgct

SEQ ID NO: 38537 - DNA, 19 bp, Artificial Sequence
  Synthetic
gccgccgagtcccaatgca

SEQ ID NO: 38538 - DNA, 19 bp, Artificial Sequence
  Synthetic
ccgcgaaggagaccgtcga

SEQ ID NO: 38539 - DNA, 22 bp, Artificial Sequence
  Synthetic
ttttgcggcccatttttgcacc

SEQ ID NO: 38540 - DNA, 19 bp, Artificial Sequence
  Synthetic
ggctgcttcgctggatggc

SEQ ID NO: 38541 - DNA, 20 bp, Artificial Sequence
  Synthetic
aacgtcaccagatgcgggtg

SEQ ID NO: 38542 - DNA, 19 bp, Artificial Sequence
  Synthetic
gctgacgtcgtctggggtg

SEQ ID NO: 38543 - DNA, 17 bp, Artificial Sequence
  Synthetic
agcttgcggatgcgcgt

SEQ ID NO: 38544 - DNA, 22 bp, Artificial Sequence
  Synthetic
tgcggttagaaagtcacgacgc

SEQ ID NO: 38545 - DNA, 19 bp, Artificial Sequence
  Synthetic
ggaggtggacgatcgcgca

SEQ ID NO: 38546 - DNA, 21 bp, Artificial Sequence
  Synthetic
ttctgttgtaccgcccctcga

SEQ ID NO: 38547 - DNA, 19 bp, Artificial Sequence
  Synthetic
atctacctcgcggcccagg

SEQ ID NO: 38548 - DNA, 19 bp, Artificial Sequence
  Synthetic
ccggggcttcggggtgaat

SEQ ID NO: 38549 - DNA, 20 bp, Artificial Sequence
  Synthetic
gggaaaccgcaacgtgaggt

SEQ ID NO: 38550 - DNA, 20 bp, Artificial Sequence
  Synthetic
ggcgatgtcggccgacgtaa

SEQ ID NO: 38551 - DNA, 21 bp, Artificial Sequence
  Synthetic
aacccaaacccgggatggagg

SEQ ID NO: 38552 - DNA, 19 bp, Artificial Sequence
  Synthetic
gcctggacgttgcgagcga

SEQ ID NO: 38553 - DNA, 19 bp, Artificial Sequence
  Synthetic
cagcagggcgtcgaactcg

SEQ ID NO: 38554 - DNA, 19 bp, Artificial Sequence
  Synthetic
cagggccgtgcctcccaaa

SEQ ID NO: 38555 - DNA, 21 bp, Artificial Sequence
  Synthetic
ccccaacacgatgtttgtgcc

SEQ ID NO: 38556 - DNA, 21 bp, Artificial Sequence
  Synthetic
cgtctttaacctcccccggga

SEQ ID NO: 38557 - DNA, 19 bp, Artificial Sequence
  Synthetic
tgcggccggctgtatgtgg

SEQ ID NO: 38558 - DNA, 22 bp, Artificial Sequence
  Synthetic
cgcgtactcctcgaagtacacg

SEQ ID NO: 38559 - DNA, 20 bp, Artificial Sequence
  Synthetic
tccacagggtcagctcgtga

SEQ ID NO: 38560 - DNA, 19 bp, Artificial Sequence
  Synthetic
catggtgcagaccgacggg

SEQ ID NO: 38561 - DNA, 20 bp, Artificial Sequence
  Synthetic
ttcagcagaaagcccagcgg

SEQ ID NO: 38562 - DNA, 19 bp, Artificial Sequence
  Synthetic
cgcgtgctgtcgtacctgt

SEQ ID NO: 38563 - DNA, 19 bp, Artificial Sequence
  Synthetic
aggaggccgtgctcctgga

SEQ ID NO: 38564 - DNA, 21 bp, Artificial Sequence
  Synthetic
ttctgccccccatcaaactcg

SEQ ID NO: 38565 - DNA, 20 bp, Artificial Sequence
  Synthetic
cacatacgcgcgctcgaacg

SEQ ID NO: 38566 - DNA, 18 bp, Artificial Sequence
  Synthetic
gcgtgcagctcgcgtttc

SEQ ID NO: 38567 - DNA, 19 bp, Artificial Sequence
  Synthetic
gcggggaagagcaggctgt

SEQ ID NO: 38568 - DNA, 20 bp, Artificial Sequence
  Synthetic
ggcctccaagcgatccagtg

SEQ ID NO: 38569 - DNA, 21 bp, Artificial Sequence
  Synthetic
ggtcacgatagatcgcgccag

SEQ ID NO: 38570 - DNA, 20 bp, Artificial Sequence
  Synthetic
ctatcgagggcgcttggtcg

SEQ ID NO: 38571 - DNA, 20 bp, Artificial Sequence
  Synthetic
caggtgtttaacccgggcca

SEQ ID NO: 38572 - DNA, 18 bp, Artificial Sequence
  Synthetic
aacgcggccagtgtcacg

SEQ ID NO: 38573 - DNA, 20 bp, Artificial Sequence
  Synthetic
gcaggtttttgccctcgcag

SEQ ID NO: 38574 - DNA, 20 bp, Artificial Sequence
  Synthetic
gggtccgcaaaacccactgg

SEQ ID NO: 38575 - DNA, 19 bp, Artificial Sequence
  Synthetic
acgggtcatccagcaggcg

SEQ ID NO: 38576 - DNA, 18 bp, Artificial Sequence
  Synthetic
cagcagtgctttgccgcc

SEQ ID NO: 38577 - DNA, 22 bp, Artificial Sequence
  Synthetic
gctgcaccgatgtatttacgcg

SEQ ID NO: 38578 - DNA, 19 bp, Artificial Sequence
  Synthetic
gcccacaagatggtggccc

SEQ ID NO: 38579 - DNA, 20 bp, Artificial Sequence
  Synthetic
tcgtcggacgaggacatgga

SEQ ID NO: 38580 - DNA, 20 bp, Artificial Sequence
  Synthetic
aaacggactccgcttgcgtg

SEQ ID NO: 38581 - DNA, 20 bp, Artificial Sequence
  Synthetic
gcataggttggggggtggtc

SEQ ID NO: 38582 - DNA, 20 bp, Artificial Sequence
  Synthetic
gctacgccttcgggaatggg

SEQ ID NO: 38583 - DNA, 19 bp, Artificial Sequence
  Synthetic
cgccgcgtttccaggtagg

SEQ ID NO: 38584 - DNA, 19 bp, Artificial Sequence
  Synthetic
cggaaacggatgcgtcggt

SEQ ID NO: 38585 - DNA, 19 bp, Artificial Sequence
  Synthetic
ggcgatgtgggttgctcgt

SEQ ID NO: 38586 - DNA, 18 bp, Artificial Sequence
  Synthetic
tggtggtgtttggggggc

SEQ ID NO: 38587 - DNA, 19 bp, Artificial Sequence
  Synthetic
cgggcttgcgtcgacggaa

SEQ ID NO: 38588 - DNA, 18 bp, Artificial Sequence
  Synthetic
cactcacggtgcggcgaa

SEQ ID NO: 38589 - DNA, 19 bp, Artificial Sequence
  Synthetic
tcccacaccacaccaccca

SEQ ID NO: 38590 - DNA, 19 bp, Artificial Sequence
  Synthetic
ggcagctcctaagcgccgt

SEQ ID NO: 38591 - DNA, 19 bp, Artificial Sequence
  Synthetic
caggcccaggtccacgttg

SEQ ID NO: 38592 - DNA, 19 bp, Artificial Sequence
  Synthetic
ccacacaccccccatgcca

SEQ ID NO: 38593 - DNA, 18 bp, Artificial Sequence
  Synthetic
acccgaaacggccaacgg

SEQ ID NO: 38594 - DNA, 19 bp, Artificial Sequence
  Synthetic
acggaccccttaacgcacg

SEQ ID NO: 38595 - DNA, 22 bp, Artificial Sequence
  Synthetic
ccccggcccccaataaagatcg

SEQ ID NO: 38596 - DNA, 22 bp, Artificial Sequence
  Synthetic
gacctgcttattctcggggagc

SEQ ID NO: 38597 - DNA, 20 bp, Artificial Sequence
  Synthetic
gccatagccgccgaagggac

SEQ ID NO: 38598 - DNA, 19 bp, Artificial Sequence
  Synthetic
taaaggacccggctcgcca

SEQ ID NO: 38599 - DNA, 19 bp, Artificial Sequence
  Synthetic
acacgcgcgtccttcttgt

SEQ ID NO: 38600 - DNA, 23 bp, Artificial Sequence
  Synthetic
caagctgaaccatgcaatcaaag

SEQ ID NO: 38601 - DNA, 25 bp, Artificial Sequence
  Synthetic
atacaacggcataataacagacact

SEQ ID NO: 38602 - DNA, 21 bp, Artificial Sequence
  Synthetic
gtgcagggataattggcatgg

SEQ ID NO: 38603 - DNA, 22 bp, Artificial Sequence
  Synthetic
atccaaatgggtggactggaac

SEQ ID NO: 38604 - DNA, 20 bp, Artificial Sequence
  Synthetic
gcccgtttctcctggctcag

SEQ ID NO: 38605 - DNA, 25 bp, Artificial Sequence
  Synthetic
agttatgtcaacactaatatgggcc

SEQ ID NO: 38606 - DNA, 22 bp, Artificial Sequence
  Synthetic
ccagccttcagagcaaacaccg

SEQ ID NO: 38607 - DNA, 20 bp, Artificial Sequence
  Synthetic
agtacacatcggggagacag

SEQ ID NO: 38608 - DNA, 20 bp, Artificial Sequence
  Synthetic
cacaaattggcgggacaagg

SEQ ID NO: 38609 - DNA, 20 bp, Artificial Sequence
  Synthetic
ttaacggtcctgagtcggtt

SEQ ID NO: 38610 - DNA, 25 bp, Artificial Sequence
  Synthetic
taataaagcttctcccttttgcagc

SEQ ID NO: 38611 - DNA, 22 bp, Artificial Sequence
  Synthetic
aaaaggtgtttgctatgctgca

SEQ ID NO: 38612 - DNA, 20 bp, Artificial Sequence
  Synthetic
gagggcattggaaaggtgtc

SEQ ID NO: 38613 - DNA, 24 bp, Artificial Sequence
  Synthetic
ataccctggctctgtttaatgaac

SEQ ID NO: 38614 - DNA, 25 bp, Artificial Sequence
  Synthetic
tctgaatataaagcaaaggaagcca

SEQ ID NO: 38615 - DNA, 22 bp, Artificial Sequence
  Synthetic
caggctatagaccaattggagc

SEQ ID NO: 38616 - DNA, 25 bp, Artificial Sequence
  Synthetic
cagagagcacatttgtagatatccc

SEQ ID NO: 38617 - DNA, 23 bp, Artificial Sequence
  Synthetic
ggatagatcaggagtgcctttgg

SEQ ID NO: 38618 - DNA, 25 bp, Artificial Sequence
  Synthetic
aatctggttgcaattttactgactc

SEQ ID NO: 38619 - DNA, 21 bp, Artificial Sequence
  Synthetic
gcagaggaggagttttgtccg

SEQ ID NO: 38620 - DNA, 20 bp, Artificial Sequence
  Synthetic
aggaagtggaagaccagcca

SEQ ID NO: 38621 - DNA, 23 bp, Artificial Sequence
  Synthetic
aagtacacctgttaaacctggga

SEQ ID NO: 38622 - DNA, 25 bp, Artificial Sequence
  Synthetic
tgacattgcttatttaagtaggccg

SEQ ID NO: 38623 - DNA, 20 bp, Artificial Sequence
  Synthetic
ctgaggagcagcagacgatt

SEQ ID NO: 38624 - DNA, 23 bp, Artificial Sequence
  Synthetic
taaggtacccaatgtacttcggg

SEQ ID NO: 38625 - DNA, 21 bp, Artificial Sequence
  Synthetic
ctggcagatcgagccctgaga

SEQ ID NO: 38626 - DNA, 21 bp, Artificial Sequence
  Synthetic
actcggctgagtgaaggcagt

SEQ ID NO: 38627 - DNA, 22 bp, Artificial Sequence
  Synthetic
tgagcccccgaactctaaatgc

SEQ ID NO: 38628 - DNA, 24 bp, Artificial Sequence
  Synthetic
gcaaaagtgtgtcagaaagtacaa

SEQ ID NO: 38629 - DNA, 20 bp, Artificial Sequence
  Synthetic
ggctgctggaagtgtggcaa

SEQ ID NO: 38630 - DNA, 25 bp, Artificial Sequence
  Synthetic
accactacatgaagattttaggcag

SEQ ID NO: 38631 - DNA, 21 bp, Artificial Sequence
  Synthetic
agagatcagctgtggaaagga

SEQ ID NO: 38632 - DNA, 23 bp, Artificial Sequence
  Synthetic
catgatgaacaagggatgtcagc

SEQ ID NO: 38633 - DNA, 20 bp, Artificial Sequence
  Synthetic
aaaccctacaacgagccctc

SEQ ID NO: 38634 - DNA, 23 bp, Artificial Sequence
  Synthetic
tagcagggttcaagggaatacca

SEQ ID NO: 38635 - DNA, 25 bp, Artificial Sequence
  Synthetic
atgctatgaggtttagatactgtgc

SEQ ID NO: 38636 - DNA, 20 bp, Artificial Sequence
  Synthetic
cggtttggaggcagatggag

SEQ ID NO: 38637 - DNA, 22 bp, Artificial Sequence
  Synthetic
ggcctgtgaatcaacagtaacc

SEQ ID NO: 38638 - DNA, 21 bp, Artificial Sequence
  Synthetic
atatgacatggcaggagtggg

SEQ ID NO: 38639 - DNA, 21 bp, Artificial Sequence
  Synthetic
atgggtgcgagtggatccaag

SEQ ID NO: 38640 - DNA, 22 bp, Artificial Sequence
  Synthetic
ccagagaaagaatggaaggcaa

SEQ ID NO: 38641 - DNA, 20 bp, Artificial Sequence
  Synthetic
ggctccacgcttgcttgctt

SEQ ID NO: 38642 - DNA, 22 bp, Artificial Sequence
  Synthetic
tggttaaaactgccactcaagg

SEQ ID NO: 38643 - DNA, 23 bp, Artificial Sequence
  Synthetic
tattgcctcaaaaagtgtggtgc

SEQ ID NO: 38644 - DNA, 22 bp, Artificial Sequence
  Synthetic
ctggtttcttggaaggaggatg

SEQ ID NO: 38645 - DNA, 21 bp, Artificial Sequence
  Synthetic
gtcaggctaggcagatggtgc

SEQ ID NO: 38646 - DNA, 21 bp, Artificial Sequence
  Synthetic
cacgtatcactgacagaccgt

SEQ ID NO: 38647 - DNA, 25 bp, Artificial Sequence
  Synthetic
tccatattttttgggtcctgtttcc

SEQ ID NO: 38648 - DNA, 20 bp, Artificial Sequence
  Synthetic
tggattacagttgggtcgcc

SEQ ID NO: 38649 - DNA, 25 bp, Artificial Sequence
  Synthetic
agagacaacggaaaattttatctgc

SEQ ID NO: 38650 - DNA, 22 bp, Artificial Sequence
  Synthetic
gatgtcacagagagttgtccag

SEQ ID NO: 38651 - DNA, 25 bp, Artificial Sequence
  Synthetic
atatgccagacacatgtttacaagg

SEQ ID NO: 38652 - DNA, 22 bp, Artificial Sequence
  Synthetic
taatagacacacctggaggagg

SEQ ID NO: 38653 - DNA, 20 bp, Artificial Sequence
  Synthetic
gttggtcttcccgcccaaat

SEQ ID NO: 38654 - DNA, 24 bp, Artificial Sequence
  Synthetic
cgtcttcagggcattcaaattgac

SEQ ID NO: 38655 - DNA, 23 bp, Artificial Sequence
  Synthetic
gagtagttggcgacagtattcct

SEQ ID NO: 38656 - DNA, 22 bp, Artificial Sequence
  Synthetic
tagctcgagtgaaccattttgc

SEQ ID NO: 38657 - DNA, 21 bp, Artificial Sequence
  Synthetic
cattggcttcactcctggaaa

SEQ ID NO: 38658 - DNA, 22 bp, Artificial Sequence
  Synthetic
aaagcaaccagaaggatgatcc

SEQ ID NO: 38659 - DNA, 22 bp, Artificial Sequence
  Synthetic
aaggtgctgtttcaaaactggg

SEQ ID NO: 38660 - DNA, 22 bp, Artificial Sequence
  Synthetic
aactactaccatttgcagcagc

SEQ ID NO: 38661 - DNA, 23 bp, Artificial Sequence
  Synthetic
ttctaatcctcggcaaagaagac

SEQ ID NO: 38662 - DNA, 22 bp, Artificial Sequence
  Synthetic
cggaattgacaaggaagcaatg

SEQ ID NO: 38663 - DNA, 24 bp, Artificial Sequence
  Synthetic
ggaactgctgcagattacaaaagc

SEQ ID NO: 38664 - DNA, 22 bp, Artificial Sequence
  Synthetic
agctgagagagaatgctgaaga

SEQ ID NO: 38665 - DNA, 25 bp, Artificial Sequence
  Synthetic
ataccaattgtgcaaagattttggg

SEQ ID NO: 38666 - DNA, 24 bp, Artificial Sequence
  Synthetic
cggtcagttaaacttgttgtcagt

SEQ ID NO: 38667 - DNA, 25 bp, Artificial Sequence
  Synthetic
agaacttgcaagcaacattgttagg

SEQ ID NO: 38668 - DNA, 25 bp, Artificial Sequence
  Synthetic
aaagcaactgtcaggcaaaatatgt

SEQ ID NO: 38669 - DNA, 21 bp, Artificial Sequence
  Synthetic
gtttacgcatagaagcagcct

SEQ ID NO: 38670 - DNA, 21 bp, Artificial Sequence
  Synthetic
cgacagtctttgcagccacca

SEQ ID NO: 38671 - DNA, 23 bp, Artificial Sequence
  Synthetic
taatagaccccccatatcccttg

SEQ ID NO: 38672 - DNA, 24 bp, Artificial Sequence
  Synthetic
ataagggttgcatctactacgtcc

SEQ ID NO: 38673 - DNA, 23 bp, Artificial Sequence
  Synthetic
cctcctccacagctgtatctact

SEQ ID NO: 38674 - DNA, 22 bp, Artificial Sequence
  Synthetic
gcacagatgaatatgtgcaacg

SEQ ID NO: 38675 - DNA, 22 bp, Artificial Sequence
  Synthetic
cgccctctggtactttagaaga

SEQ ID NO: 38676 - DNA, 25 bp, Artificial Sequence
  Synthetic
tttacatacataacatacacgccct

SEQ ID NO: 38677 - DNA, 20 bp, Artificial Sequence
  Synthetic
gggatccgccattagtcctt

SEQ ID NO: 38678 - DNA, 23 bp, Artificial Sequence
  Synthetic
aatcagcaacacaaatgaggttg

SEQ ID NO: 38679 - DNA, 21 bp, Artificial Sequence
  Synthetic
cgcagagaacaagtgtatgct

SEQ ID NO: 38680 - DNA, 23 bp, Artificial Sequence
  Synthetic
tcttagatgactgggagttagca

SEQ ID NO: 38681 - DNA, 23 bp, Artificial Sequence
  Synthetic
catttttgaaaccccacagtgac

SEQ ID NO: 38682 - DNA, 23 bp, Artificial Sequence
  Synthetic
gttatcggtcgtttttatggctg

SEQ ID NO: 38683 - DNA, 22 bp, Artificial Sequence
  Synthetic
cagcagaagccatggaagtcgc

SEQ ID NO: 38684 - DNA, 25 bp, Artificial Sequence
  Synthetic
ttaaatacggtttgaaaagagggcc

SEQ ID NO: 38685 - DNA, 20 bp, Artificial Sequence
  Synthetic
cacgtgatgctgaagctcag

SEQ ID NO: 38686 - DNA, 25 bp, Artificial Sequence
  Synthetic
cattagagttgccaaaatcggaaat

SEQ ID NO: 38687 - DNA, 24 bp, Artificial Sequence
  Synthetic
aatgtcttccactagataggagca

SEQ ID NO: 38688 - DNA, 22 bp, Artificial Sequence
  Synthetic
catatcatgacgaaaggggcat

SEQ ID NO: 38689 - DNA, 21 bp, Artificial Sequence
  Synthetic
atgctggtaatgagctggaga

SEQ ID NO: 38690 - DNA, 20 bp, Artificial Sequence
  Synthetic
gccgggattattagccatgc

SEQ ID NO: 38691 - DNA, 20 bp, Artificial Sequence
  Synthetic
tgagtgtcccgggaaaacac

SEQ ID NO: 38692 - DNA, 20 bp, Artificial Sequence
  Synthetic
gtaaacgagctggccatcag

SEQ ID NO: 38693 - DNA, 25 bp, Artificial Sequence
  Synthetic
ggctatgtcaagatgttttgtaagg

SEQ ID NO: 38694 - DNA, 20 bp, Artificial Sequence
  Synthetic
gcaagtgctgtgtgtcctag

SEQ ID NO: 38695 - DNA, 20 bp, Artificial Sequence
  Synthetic
caggattgcatcgttggcat

SEQ ID NO: 38696 - DNA, 25 bp, Artificial Sequence
  Synthetic
aatagtgttactgatgagtgtcgtc

SEQ ID NO: 38697 - DNA, 20 bp, Artificial Sequence
  Synthetic
ttggacatcactgatgctgc

SEQ ID NO: 38698 - DNA, 21 bp, Artificial Sequence
  Synthetic
gctgtggtggtattttggcag

SEQ ID NO: 38699 - DNA, 21 bp, Artificial Sequence
  Synthetic
gttgccaagatgattgaacgc

SEQ ID NO: 38700 - DNA, 21 bp, Artificial Sequence
  Synthetic
acccaagccttacagggtaga

SEQ ID NO: 38701 - DNA, 20 bp, Artificial Sequence
  Synthetic
ttgaaccgtgtgctcagtct

SEQ ID NO: 38702 - DNA, 22 bp, Artificial Sequence
  Synthetic
gtgttttggctttgacaagtgg

SEQ ID NO: 38703 - DNA, 25 bp, Artificial Sequence
  Synthetic
tgcttggtactttcttgctatgttg

SEQ ID NO: 38704 - DNA, 23 bp, Artificial Sequence
  Synthetic
catctggctttgtggagaaatgt

SEQ ID NO: 38705 - DNA, 22 bp, Artificial Sequence
  Synthetic
atgctatgatggttgtgctcaa

SEQ ID NO: 38706 - DNA, 22 bp, Artificial Sequence
  Synthetic
acatggtggcttaaaggtgaaa

SEQ ID NO: 38707 - DNA, 22 bp, Artificial Sequence
  Synthetic
actgctcaagagttattgctgg

SEQ ID NO: 38708 - DNA, 22 bp, Artificial Sequence
  Synthetic
acaggaaggtgttttacgcatt

SEQ ID NO: 38709 - DNA, 25 bp, Artificial Sequence
  Synthetic
aagtgtacacgtattattcctgcac

SEQ ID NO: 38710 - DNA, 25 bp, Artificial Sequence
  Synthetic
aataaaggttcatttgttggtgctg

SEQ ID NO: 38711 - DNA, 25 bp, Artificial Sequence
  Synthetic
agaggatgtttgtacttgttacgat

SEQ ID NO: 38712 - DNA, 24 bp, Artificial Sequence
  Synthetic
aggaactgctgttcttaaaaggtg

SEQ ID NO: 38713 - DNA, 23 bp, Artificial Sequence
  Synthetic
cctaagacagttcgtgagtttgt

SEQ ID NO: 38714 - DNA, 20 bp, Artificial Sequence
  Synthetic
ttcaaacctcagagtggcgg

SEQ ID NO: 38715 - DNA, 25 bp, Artificial Sequence
  Synthetic
tttgtctataccttccaattggacc

SEQ ID NO: 38716 - DNA, 22 bp, Artificial Sequence
  Synthetic
cacaagtggtagtagagtggct

SEQ ID NO: 38717 - DNA, 25 bp, Artificial Sequence
  Synthetic
ttgactaagtacactgaagttcgtg

SEQ ID NO: 38718 - DNA, 21 bp, Artificial Sequence
  Synthetic
acgtattcctaccatggcaga

SEQ ID NO: 38719 - DNA, 21 bp, Artificial Sequence
  Synthetic
acattgcaacttgtgtctgct

SEQ ID NO: 38720 - DNA, 21 bp, Artificial Sequence
  Synthetic
ctggctctacaagacatggga

SEQ ID NO: 38721 - DNA, 25 bp, Artificial Sequence
  Synthetic
tgtaatagaacagtttatggcccca

SEQ ID NO: 38722 - DNA, 20 bp, Artificial Sequence
  Synthetic
gcagtgagctctcccatgag

SEQ ID NO: 38723 - DNA, 20 bp, Artificial Sequence
  Synthetic
ttgtcacccaagctgcattt

SEQ ID NO: 38724 - DNA, 20 bp, Artificial Sequence
  Synthetic
ttggaagtgcaggtgttgtg

SEQ ID NO: 38725 - DNA, 21 bp, Artificial Sequence
  Synthetic
accagtgcgtgatgaagtttc

SEQ ID NO: 38726 - DNA, 20 bp, Artificial Sequence
  Synthetic
ttcggacgtgcatagaccac

SEQ ID NO: 38727 - DNA, 22 bp, Artificial Sequence
  Synthetic
aataggcagcagctagaagagg

SEQ ID NO: 38728 - DNA, 22 bp, Artificial Sequence
  Synthetic
tgtgagtgcaacgcaaaatggg

SEQ ID NO: 38729 - DNA, 20 bp, Artificial Sequence
  Synthetic
gcaggaggcagacacctttg

SEQ ID NO: 38730 - DNA, 24 bp, Artificial Sequence
  Synthetic
aaagccatgccatatacaaagtgg

SEQ ID NO: 38731 - DNA, 21 bp, Artificial Sequence
  Synthetic
ggttacaagctgaggctaggg

SEQ ID NO: 38732 - DNA, 21 bp, Artificial Sequence
  Synthetic
ctttgggggcttgggtatagg

SEQ ID NO: 38733 - DNA, 20 bp, Artificial Sequence
  Synthetic
ctgccaccgatggtacagtt

SEQ ID NO: 38734 - DNA, 20 bp, Artificial Sequence
  Synthetic
agcattacctcctggtgctg

SEQ ID NO: 38735 - DNA, 20 bp, Artificial Sequence
  Synthetic
tttggaggcttcgagggttg

SEQ ID NO: 38736 - DNA, 25 bp, Artificial Sequence
  Synthetic
ggtttattgattctttggctacccg

SEQ ID NO: 38737 - DNA, 20 bp, Artificial Sequence
  Synthetic
tagaagccggccctccttcc

SEQ ID NO: 38738 - DNA, 18 bp, Artificial Sequence
  Synthetic
tttgcagagcaccccggc

SEQ ID NO: 38739 - DNA, 20 bp, Artificial Sequence
  Synthetic
gagacccgagtggcccggat

SEQ ID NO: 38740 - DNA, 21 bp, Artificial Sequence
  Synthetic
tccgtagaagggtcctcgtcc

SEQ ID NO: 38741 - DNA, 21 bp, Artificial Sequence
  Synthetic
cagagggggccaagaacccag

SEQ ID NO: 38742 - DNA, 22 bp, Artificial Sequence
  Synthetic
actctccactcccagtccatgt

SEQ ID NO: 38743 - DNA, 22 bp, Artificial Sequence
  Synthetic
aaagactcgtggtcggaatccg

SEQ ID NO: 38744 - DNA, 19 bp, Artificial Sequence
  Synthetic
tggcccgtccctcttgtcc

SEQ ID NO: 38745 - DNA, 19 bp, Artificial Sequence
  Synthetic
ttctcccgctgggcccagt

SEQ ID NO: 38746 - DNA, 22 bp, Artificial Sequence
  Synthetic
cccgaaatagggccttgccatc

SEQ ID NO: 38747 - DNA, 21 bp, Artificial Sequence
  Synthetic
tatccaaccggcagtggagga

SEQ ID NO: 38748 - DNA, 21 bp, Artificial Sequence
  Synthetic
gcagggatcgcagtctctccc

SEQ ID NO: 38749 - DNA, 20 bp, Artificial Sequence
  Synthetic
gacaaaggggggcactgagg

SEQ ID NO: 38750 - DNA, 20 bp, Artificial Sequence
  Synthetic
gtgcgggcccctgtagatgg

SEQ ID NO: 38751 - DNA, 22 bp, Artificial Sequence
  Synthetic
tatctccgttccagccctgtca

SEQ ID NO: 38752 - DNA, 19 bp, Artificial Sequence
  Synthetic
ggcacgaggtggtgggtct

SEQ ID NO: 38753 - DNA, 19 bp, Artificial Sequence
  Synthetic
accaccgcctcctcctcct

SEQ ID NO: 38754 - DNA, 21 bp, Artificial Sequence
  Synthetic
ccgccgtcgtgctgtatctca

SEQ ID NO: 38755 - DNA, 21 bp, Artificial Sequence
  Synthetic
acctgtttgaccccaaggacg

SEQ ID NO: 38756 - DNA, 21 bp, Artificial Sequence
  Synthetic
tttgaaggaggcctgcaacgc

SEQ ID NO: 38757 - DNA, 20 bp, Artificial Sequence
  Synthetic
agcaacaccgcactggagag

SEQ ID NO: 38758 - DNA, 20 bp, Artificial Sequence
  Synthetic
gacccaggcgacgagatcca

SEQ ID NO: 38759 - DNA, 22 bp, Artificial Sequence
  Synthetic
tgctcagccaggtaagtctccc

SEQ ID NO: 38760 - DNA, 20 bp, Artificial Sequence
  Synthetic
atggacgcagcgtggagttg

SEQ ID NO: 38761 - DNA, 21 bp, Artificial Sequence
  Synthetic
gttgtggtcttcatcgggcgc

SEQ ID NO: 38762 - DNA, 21 bp, Artificial Sequence
  Synthetic
gcaatctcggctgtttgtact

SEQ ID NO: 38763 - DNA, 21 bp, Artificial Sequence
  Synthetic
gtgaccgtctggctcgtttgc

SEQ ID NO: 38764 - DNA, 22 bp, Artificial Sequence
  Synthetic
tttgtcaatccatggcaggccc

SEQ ID NO: 38765 - DNA, 22 bp, Artificial Sequence
  Synthetic
acgctaggatgtgatgagggca

SEQ ID NO: 38766 - DNA, 19 bp, Artificial Sequence
  Synthetic
gccaccggaaacagctgcc

SEQ ID NO: 38767 - DNA, 21 bp, Artificial Sequence
  Synthetic
cctcaggggccaagcaaaacc

SEQ ID NO: 38768 - DNA, 22 bp, Artificial Sequence
  Synthetic
gccagagactcccgagtagagc

SEQ ID NO: 38769 - DNA, 22 bp, Artificial Sequence
  Synthetic
aaaggcgctatagacggttggg

SEQ ID NO: 38770 - DNA, 20 bp, Artificial Sequence
  Synthetic
acggtgaccttcgacagccc

SEQ ID NO: 38771 - DNA, 21 bp, Artificial Sequence
  Synthetic
tgcaaaaagtaagcctgcgcg

SEQ ID NO: 38772 - DNA, 22 bp, Artificial Sequence
  Synthetic
tacgtcctcgtgagtctgctgg

SEQ ID NO: 38773 - DNA, 21 bp, Artificial Sequence
  Synthetic
gctttggcagaccacctgtgc

SEQ ID NO: 38774 - DNA, 19 bp, Artificial Sequence
  Synthetic
accgccacgggaatctcca

SEQ ID NO: 38775 - DNA, 19 bp, Artificial Sequence
  Synthetic
cgcagtgacgctcttcgca

SEQ ID NO: 38776 - DNA, 19 bp, Artificial Sequence
  Synthetic
ggagctctgccgggttgac

SEQ ID NO: 38777 - DNA, 20 bp, Artificial Sequence
  Synthetic
ctgggaccgtttggacaccc

SEQ ID NO: 38778 - DNA, 19 bp, Artificial Sequence
  Synthetic
ccactcttgcctcggcgct

SEQ ID NO: 38779 - DNA, 19 bp, Artificial Sequence
  Synthetic
cgatgccaccccctatgcc

SEQ ID NO: 38780 - DNA, 20 bp, Artificial Sequence
  Synthetic
ttccatgacagtcccgttgg

SEQ ID NO: 38781 - DNA, 19 bp, Artificial Sequence
  Synthetic
ggggccatgctcagcagct

SEQ ID NO: 38782 - DNA, 21 bp, Artificial Sequence
  Synthetic
ccctgggtagtcacgttcagc

SEQ ID NO: 38783 - DNA, 21 bp, Artificial Sequence
  Synthetic
ggctaacctcagcgcgtactc

SEQ ID NO: 38784 - DNA, 21 bp, Artificial Sequence
  Synthetic
tactaaactcgcgcccatggg

SEQ ID NO: 38785 - DNA, 19 bp, Artificial Sequence
  Synthetic
ggtgggacaggtgtgccca

SEQ ID NO: 38786 - DNA, 21 bp, Artificial Sequence
  Synthetic
tcaagagccagctccctctga

SEQ ID NO: 38787 - DNA, 21 bp, Artificial Sequence
  Synthetic
gggtcactggcttatgcgtgg

SEQ ID NO: 38788 - DNA, 20 bp, Artificial Sequence
  Synthetic
actcgtcctggctggtgacg

SEQ ID NO: 38789 - DNA, 20 bp, Artificial Sequence
  Synthetic
gaatcttcgccagccccccg

SEQ ID NO: 38790 - DNA, 22 bp, Artificial Sequence
  Synthetic
gttgaaaagcagagctccccca

SEQ ID NO: 38791 - DNA, 19 bp, Artificial Sequence
  Synthetic
caaacaggctccgggtggt

SEQ ID NO: 38792 - DNA, 19 bp, Artificial Sequence
  Synthetic
gtcctttggcgcggatcct

SEQ ID NO: 38793 - DNA, 19 bp, Artificial Sequence
  Synthetic
gatgaggccggtgatgcgg

SEQ ID NO: 38794 - DNA, 21 bp, Artificial Sequence
  Synthetic
cagggtctcgctctgttgcgc

SEQ ID NO: 38795 - DNA, 19 bp, Artificial Sequence
  Synthetic
tgtagaggcgcgggtctgg

SEQ ID NO: 38796 - DNA, 19 bp, Artificial Sequence
  Synthetic
cgagacagccgctccagca

SEQ ID NO: 38797 - DNA, 18 bp, Artificial Sequence
  Synthetic
gtcggcaaacaggggcca

SEQ ID NO: 38798 - DNA, 19 bp, Artificial Sequence
  Synthetic
ggctggcaaaggcaggtct

SEQ ID NO: 38799 - DNA, 19 bp, Artificial Sequence
  Synthetic
gctaagggtcggcgggtga

SEQ ID NO: 38800 - DNA, 25 bp, Artificial Sequence
  Synthetic
tttgcaatgtgtattttgtaagcgt

SEQ ID NO: 38801 - DNA, 23 bp, Artificial Sequence
  Synthetic
gatagtgaggctgaagaagagga

SEQ ID NO: 38802 - DNA, 21 bp, Artificial Sequence
  Synthetic
aggatgaatcaggccgatctg

SEQ ID NO: 38803 - DNA, 20 bp, Artificial Sequence
  Synthetic
tcgctctccaccatctcttc

SEQ ID NO: 38804 - DNA, 22 bp, Artificial Sequence
  Synthetic
tactaactagagcccgccattt

SEQ ID NO: 38805 - DNA, 21 bp, Artificial Sequence
  Synthetic
gtcagtacaacgatcgccttt

SEQ ID NO: 38806 - DNA, 22 bp, Artificial Sequence
  Synthetic
agtgctcgagaagaatgtgaca

SEQ ID NO: 38807 - DNA, 20 bp, Artificial Sequence
  Synthetic
gtccggcatcatcacctcaa

SEQ ID NO: 38808 - DNA, 21 bp, Artificial Sequence
  Synthetic
cagttcactggtgcttttggt

SEQ ID NO: 38809 - DNA, 25 bp, Artificial Sequence
  Synthetic
cgtctgcacagttagaatttacaca

SEQ ID NO: 38810 - DNA, 22 bp, Artificial Sequence
  Synthetic
ccagcaagagagtgaggaaagc

SEQ ID NO: 38811 - DNA, 22 bp, Artificial Sequence
  Synthetic
atatgcaaagctggctgaaaca

SEQ ID NO: 38812 - DNA, 23 bp, Artificial Sequence
  Synthetic
tctgagtgatcaagaagacgagg

SEQ ID NO: 38813 - DNA, 23 bp, Artificial Sequence
  Synthetic
gctaccagtgaacagaaagctaa

SEQ ID NO: 38814 - DNA, 19 bp, Artificial Sequence
  Synthetic
cccacgaccaggtcccagt

SEQ ID NO: 38815 - DNA, 20 bp, Artificial Sequence
  Synthetic
ctgacccaagccctcctatg

SEQ ID NO: 38816 - DNA, 21 bp, Artificial Sequence
  Synthetic
tcgggttagtagactaggccg

SEQ ID NO: 38817 - DNA, 22 bp, Artificial Sequence
  Synthetic
actcggtggactcgttatttgg

SEQ ID NO: 38818 - DNA, 22 bp, Artificial Sequence
  Synthetic
ggaacaaaaccaaaatcacggc

SEQ ID NO: 38819 - DNA, 20 bp, Artificial Sequence
  Synthetic
tttgagcaagtttggggcct

SEQ ID NO: 38820 - DNA, 20 bp, Artificial Sequence
  Synthetic
aagggttgattcgtgctgtc

SEQ ID NO: 38821 - DNA, 20 bp, Artificial Sequence
  Synthetic
gctcatgataagcggcagtc

SEQ ID NO: 38822 - DNA, 21 bp, Artificial Sequence
  Synthetic
gagcgtctctcttatctggga

SEQ ID NO: 38823 - DNA, 20 bp, Artificial Sequence
  Synthetic
atttctttggtatgcggggc

SEQ ID NO: 38824 - DNA, 24 bp, Artificial Sequence
  Synthetic
ttatcaacgtaggagttgggaagc

SEQ ID NO: 38825 - DNA, 22 bp, Artificial Sequence
  Synthetic
aacgcttccaagacaagagatc

SEQ ID NO: 38826 - DNA, 22 bp, Artificial Sequence
  Synthetic
gccattgcctcatcgatactgt

SEQ ID NO: 38827 - DNA, 21 bp, Artificial Sequence
  Synthetic
catttgcacacctacccagag

SEQ ID NO: 38828 - DNA, 20 bp, Artificial Sequence
  Synthetic
ctagctgccctcttggatgc

SEQ ID NO: 38829 - DNA, 22 bp, Artificial Sequence
  Synthetic
cattcggaaaaatcactcccca

SEQ ID NO: 38830 - DNA, 22 bp, Artificial Sequence
  Synthetic
acactttgattctgcctgttcc

SEQ ID NO: 38831 - DNA, 20 bp, Artificial Sequence
  Synthetic
cgactacggtgactacagct

SEQ ID NO: 38832 - DNA, 22 bp, Artificial Sequence
  Synthetic
agcccacaaccaaatacacatt

SEQ ID NO: 38833 - DNA, 22 bp, Artificial Sequence
  Synthetic
ttttacgcacaatgaacccaga

SEQ ID NO: 38834 - DNA, 20 bp, Artificial Sequence
  Synthetic
tttccctctgccctgatgtt

SEQ ID NO: 38835 - DNA, 25 bp, Artificial Sequence
  Synthetic
aatctcagaaatgctagaaagcctt

SEQ ID NO: 38836 - DNA, 20 bp, Artificial Sequence
  Synthetic
tttctgagcctccacgcatt

SEQ ID NO: 38837 - DNA, 25 bp, Artificial Sequence
  Synthetic
aactcttctatttcagaatcagcca

SEQ ID NO: 38838 - DNA, 22 bp, Artificial Sequence
  Synthetic
aaagataaaggcccctcacaac

SEQ ID NO: 38839 - DNA, 22 bp, Artificial Sequence
  Synthetic
gcctgagtcaataagacaccca

SEQ ID NO: 38840 - DNA, 22 bp, Artificial Sequence
  Synthetic
ggaactccaggagctagtatcg

SEQ ID NO: 38841 - DNA, 22 bp, Artificial Sequence
  Synthetic
cgcatcaatgccatcaaaagca

SEQ ID NO: 38842 - DNA, 23 bp, Artificial Sequence
  Synthetic
actgagctgcaactaataaacga

SEQ ID NO: 38843 - DNA, 24 bp, Artificial Sequence
  Synthetic
tccttttccatgacttgtttcaca

SEQ ID NO: 38844 - DNA, 21 bp, Artificial Sequence
  Synthetic
cacagtctatcgagtggacgt

SEQ ID NO: 38845 - DNA, 20 bp, Artificial Sequence
  Synthetic
tcatgcagtgcttgggctag

SEQ ID NO: 38846 - DNA, 21 bp, Artificial Sequence
  Synthetic
cttagatcacaacgcgatggt

SEQ ID NO: 38847 - DNA, 20 bp, Artificial Sequence
  Synthetic
agcccgtttatgctgttcag

SEQ ID NO: 38848 - DNA, 22 bp, Artificial Sequence
  Synthetic
tggctcaatttccaagcaaacg

SEQ ID NO: 38849 - DNA, 21 bp, Artificial Sequence
  Synthetic
aaccggagcaacctctttacg

SEQ ID NO: 38850 - DNA, 20 bp, Artificial Sequence
  Synthetic
ctcccacagaagggtagggt

SEQ ID NO: 38851 - DNA, 22 bp, Artificial Sequence
  Synthetic
tccatcattgcttggatgttgc

SEQ ID NO: 38852 - DNA, 23 bp, Artificial Sequence
  Synthetic
aagtaggaagatttgaactcgcc

SEQ ID NO: 38853 - DNA, 25 bp, Artificial Sequence
  Synthetic
atccgtgtcaataaatttgcgattg

SEQ ID NO: 38854 - DNA, 21 bp, Artificial Sequence
  Synthetic
atcctctttccagagtctgca

SEQ ID NO: 38855 - DNA, 22 bp, Artificial Sequence
  Synthetic
gccttcatctgagaaaagctga

SEQ ID NO: 38856 - DNA, 24 bp, Artificial Sequence
  Synthetic
actttcagggattaactctggaac

SEQ ID NO: 38857 - DNA, 22 bp, Artificial Sequence
  Synthetic
gcaaacgtcctagttgctatgc

SEQ ID NO: 38858 - DNA, 25 bp, Artificial Sequence
  Synthetic
acatatcatcgaacaaatcattcgc

SEQ ID NO: 38859 - DNA, 20 bp, Artificial Sequence
  Synthetic
ttgccaatgccgttctcatc

SEQ ID NO: 38860 - DNA, 22 bp, Artificial Sequence
  Synthetic
ctatgggattcggatacaacgc

SEQ ID NO: 38861 - DNA, 21 bp, Artificial Sequence
  Synthetic
ccgcaagacaaccattcaact

SEQ ID NO: 38862 - DNA, 23 bp, Artificial Sequence
  Synthetic
agctcatgacgatccataacagt

SEQ ID NO: 38863 - DNA, 21 bp, Artificial Sequence
  Synthetic
gtgcaatctgaccaacaagcc

SEQ ID NO: 38864 - DNA, 21 bp, Artificial Sequence
  Synthetic
acgtaaacctattgcacgcac

SEQ ID NO: 38865 - DNA, 22 bp, Artificial Sequence
  Synthetic
aatagccccatcgtcataacca

SEQ ID NO: 38866 - DNA, 21 bp, Artificial Sequence
  Synthetic
gcgataggctttcctgaaggg

SEQ ID NO: 38867 - DNA, 20 bp, Artificial Sequence
  Synthetic
ccacgttcatcaactcgtgc

SEQ ID NO: 38868 - DNA, 25 bp, Artificial Sequence
  Synthetic
agatttctatgccttttctggtcat

SEQ ID NO: 38869 - DNA, 21 bp, Artificial Sequence
  Synthetic
tctcgaggaggatttcaaggg

SEQ ID NO: 38870 - DNA, 21 bp, Artificial Sequence
  Synthetic
ggggagagcagcaggttttac

SEQ ID NO: 38871 - DNA, 20 bp, Artificial Sequence
  Synthetic
gaggttccgaggtgaagtct

SEQ ID NO: 38872 - DNA, 21 bp, Artificial Sequence
  Synthetic
tttttggcatcagcaggagtt

SEQ ID NO: 38873 - DNA, 22 bp, Artificial Sequence
  Synthetic
tttttgctccacccaatccttg

SEQ ID NO: 38874 - DNA, 22 bp, Artificial Sequence
  Synthetic
tcatcaaggtggccattcttac

SEQ ID NO: 38875 - DNA, 22 bp, Artificial Sequence
  Synthetic
tgatctcttgaatggcagacgt

SEQ ID NO: 38876 - DNA, 21 bp, Artificial Sequence
  Synthetic
ggtggagcaagccttcttaaa

SEQ ID NO: 38877 - DNA, 20 bp, Artificial Sequence
  Synthetic
agggaaacggcagcaaatcc

SEQ ID NO: 38878 - DNA, 20 bp, Artificial Sequence
  Synthetic
ttgcgccgataataaacggg

SEQ ID NO: 38879 - DNA, 21 bp, Artificial Sequence
  Synthetic
ttttcttgattcctgggcctg

SEQ ID NO: 38880 - DNA, 24 bp, Artificial Sequence
  Synthetic
agaaacacgatgattgtagcaact

SEQ ID NO: 38881 - DNA, 21 bp, Artificial Sequence
  Synthetic
aatcagaggctgcaagtacca

SEQ ID NO: 38882 - DNA, 23 bp, Artificial Sequence
  Synthetic
acagaacgatatgaaaacgcgtt

SEQ ID NO: 38883 - DNA, 24 bp, Artificial Sequence
  Synthetic
ttacggatctaactttgttggagg

SEQ ID NO: 38884 - DNA, 20 bp, Artificial Sequence
  Synthetic
cagcagaaaaagcagggctg

SEQ ID NO: 38885 - DNA, 24 bp, Artificial Sequence
  Synthetic
tttgcctgaagatctggaaagttc

SEQ ID NO: 38886 - DNA, 21 bp, Artificial Sequence
  Synthetic
catcgcgatcatttcaaacgc

SEQ ID NO: 38887 - DNA, 20 bp, Artificial Sequence
  Synthetic
tagatcaggctggttcgctc

SEQ ID NO: 38888 - DNA, 20 bp, Artificial Sequence
  Synthetic
agaattgtttggggggctcc

SEQ ID NO: 38889 - DNA, 20 bp, Artificial Sequence
  Synthetic
gcgaagatcccccagcttta

SEQ ID NO: 38890 - DNA, 21 bp, Artificial Sequence
  Synthetic
ccaggatcttcgatcatgcct

SEQ ID NO: 38891 - DNA, 20 bp, Artificial Sequence
  Synthetic
taaacagtccgtcttcgcca

SEQ ID NO: 38892 - DNA, 25 bp, Artificial Sequence
  Synthetic
aaacacaggctattgttatccttga

SEQ ID NO: 38893 - DNA, 23 bp, Artificial Sequence
  Synthetic
actcccatttctatccaagggat

SEQ ID NO: 38894 - DNA, 20 bp, Artificial Sequence
  Synthetic
gggttgacgcgaatacaagg

SEQ ID NO: 38895 - DNA, 22 bp, Artificial Sequence
  Synthetic
aaaaagctctcggttgctaact

SEQ ID NO: 38896 - DNA, 20 bp, Artificial Sequence
  Synthetic
ggcgctcttattgtcgagga

SEQ ID NO: 38897 - DNA, 21 bp, Artificial Sequence
  Synthetic
tcttcttctatgcctggtgct

SEQ ID NO: 38898 - DNA, 20 bp, Artificial Sequence
  Synthetic
taccagcatggagagcgtgt

SEQ ID NO: 38899 - DNA, 20 bp, Artificial Sequence
  Synthetic
agctgggctgactcacatga

SEQ ID NO: 38900 - DNA, 22 bp, Artificial Sequence
  Synthetic
cactaatcaacagagggcctct

SEQ ID NO: 38901 - DNA, 23 bp, Artificial Sequence
  Synthetic
cattcatatcatgctcccccttg

SEQ ID NO: 38902 - DNA, 25 bp, Artificial Sequence
  Synthetic
atgagggaagaatatcgaaaggaac

SEQ ID NO: 38903 - DNA, 25 bp, Artificial Sequence
  Synthetic
ccacggaagaaaaaagaatgtttga

SEQ ID NO: 38904 - DNA, 21 bp, Artificial Sequence
  Synthetic
agacaccccaacaatgcaatg

SEQ ID NO: 38905 - DNA, 21 bp, Artificial Sequence
  Synthetic
tatcacaatcagggtgggtga

SEQ ID NO: 38906 - DNA, 20 bp, Artificial Sequence
  Synthetic
agcagcttgggcttagcaat

SEQ ID NO: 38907 - DNA, 22 bp, Artificial Sequence
  Synthetic
tacaacaggatgggaacagtga

SEQ ID NO: 38908 - DNA, 23 bp, Artificial Sequence
  Synthetic
gtcagaaaatcaggaggaggagc

SEQ ID NO: 38909 - DNA, 20 bp, Artificial Sequence
  Synthetic
ggacagcggacttgagcttt

SEQ ID NO: 38910 - DNA, 25 bp, Artificial Sequence
  Synthetic
taacaacgaaattttgtttgctcct

SEQ ID NO: 38911 - DNA, 21 bp, Artificial Sequence
  Synthetic
aggagatcacgatcgcggtca

SEQ ID NO: 38912 - DNA, 25 bp, Artificial Sequence
  Synthetic
taaggtatacttacccccttcaaca

SEQ ID NO: 38913 - DNA, 23 bp, Artificial Sequence
  Synthetic
cttaccatgtgctgaaaagcaac

SEQ ID NO: 38914 - DNA, 20 bp, Artificial Sequence
  Synthetic
atatgtttgtgcgcggtggt

SEQ ID NO: 38915 - DNA, 21 bp, Artificial Sequence
  Synthetic
acgtgttgtatcctaggcagt

SEQ ID NO: 38916 - DNA, 23 bp, Artificial Sequence
  Synthetic
ggtgctacttcaagatgctttgc

SEQ ID NO: 38917 - DNA, 20 bp, Artificial Sequence
  Synthetic
tgcaccacttgtggtcatgt

SEQ ID NO: 38918 - DNA, 24 bp, Artificial Sequence
  Synthetic
cagatgtgtggcataaacaattgc

SEQ ID NO: 38919 - DNA, 23 bp, Artificial Sequence
  Synthetic
tgatgatcatgttggactcttgg

SEQ ID NO: 38920 - DNA, 21 bp, Artificial Sequence
  Synthetic
gccttgtgttgctagtgaaca

SEQ ID NO: 38921 - DNA, 23 bp, Artificial Sequence
  Synthetic
ggtggttatgttgctgattttgc

SEQ ID NO: 38922 - DNA, 20 bp, Artificial Sequence
  Synthetic
ctgatgcgagaacacagggt

SEQ ID NO: 38923 - DNA, 24 bp, Artificial Sequence
  Synthetic
taatgtcacgaagcataagtgtga

SEQ ID NO: 38924 - DNA, 22 bp, Artificial Sequence
  Synthetic
atggcttgaatttcgttctggc

SEQ ID NO: 38925 - DNA, 25 bp, Artificial Sequence
  Synthetic
tgccaaagaaaccaaagaaatcaac

SEQ ID NO: 38926 - DNA, 22 bp, Artificial Sequence
  Synthetic
ctttctgctgatggagtgcagt

SEQ ID NO: 38927 - DNA, 23 bp, Artificial Sequence
  Synthetic
gtgtctttggaaacactgttggc

SEQ ID NO: 38928 - DNA, 25 bp, Artificial Sequence
  Synthetic
tgctgtgaatgtcttgtatttcaca

SEQ ID NO: 38929 - DNA, 23 bp, Artificial Sequence
  Synthetic
cgtcttgcttaattgcttgcaac

SEQ ID NO: 38930 - DNA, 25 bp, Artificial Sequence
  Synthetic
cgttttagtggttctgctaatcaac

SEQ ID NO: 38931 - DNA, 22 bp, Artificial Sequence
  Synthetic
ccaggatgtggtgttgctatag

SEQ ID NO: 38932 - DNA, 25 bp, Artificial Sequence
  Synthetic
accttccatatcctaatcctagtcg

SEQ ID NO: 38933 - DNA, 21 bp, Artificial Sequence
  Synthetic
cgtggtctgctcttctcaaac

SEQ ID NO: 38934 - DNA, 20 bp, Artificial Sequence
  Synthetic
gcaaaaggcaaccgaggaag

SEQ ID NO: 38935 - DNA, 25 bp, Artificial Sequence
  Synthetic
gagatggttacagctttaaaaaggc

SEQ ID NO: 38936 - DNA, 24 bp, Artificial Sequence
  Synthetic
agaactggttactatggttgttgg

SEQ ID NO: 38937 - DNA, 25 bp, Artificial Sequence
  Synthetic
ttatgtacctttgaaatctgccacg

SEQ ID NO: 38938 - DNA, 22 bp, Artificial Sequence
  Synthetic
gttgaattatttgccaagcgca

SEQ ID NO: 38939 - DNA, 21 bp, Artificial Sequence
  Synthetic
accgcgtgctgaattaaatgg

SEQ ID NO: 38940 - DNA, 25 bp, Artificial Sequence
  Synthetic
gaattatgggaagccagttactttg

SEQ ID NO: 38941 - DNA, 25 bp, Artificial Sequence
  Synthetic
aaaagtgttgatgtcgctattcaag

SEQ ID NO: 38942 - DNA, 22 bp, Artificial Sequence
  Synthetic
tcggtgctgaaaagaaagatgg

SEQ ID NO: 38943 - DNA, 20 bp, Artificial Sequence
  Synthetic
ttgttgattcgcggtggaac

SEQ ID NO: 38944 - DNA, 25 bp, Artificial Sequence
  Synthetic
ttgccagtataatatgtgcgagtac

SEQ ID NO: 38945 - DNA, 25 bp, Artificial Sequence
  Synthetic
tttactcgctttcaatcaagatggt

SEQ ID NO: 38946 - DNA, 25 bp, Artificial Sequence
  Synthetic
gatgtagtttatgcacaacactgtt

SEQ ID NO: 38947 - DNA, 20 bp, Artificial Sequence
  Synthetic
tgtacttgccgaccacaagc

SEQ ID NO: 38948 - DNA, 24 bp, Artificial Sequence
  Synthetic
ctgctctcagaaaatcagatcagt

SEQ ID NO: 38949 - DNA, 24 bp, Artificial Sequence
  Synthetic
gccgtaatcaaggtagattttgtg

SEQ ID NO: 38950 - DNA, 21 bp, Artificial Sequence
  Synthetic
tcacaataatacgcggccatc

SEQ ID NO: 38951 - DNA, 22 bp, Artificial Sequence
  Synthetic
tggaaatcgttctggtaatggc

SEQ ID NO: 38952 - DNA, 22 bp, Artificial Sequence
  Synthetic
gctgacattgtcgatcgggacc

SEQ ID NO: 38953 - DNA, 25 bp, Artificial Sequence
  Synthetic
tctctatcagaatggatgtcttgct

SEQ ID NO: 38954 - DNA, 20 bp, Artificial Sequence
  Synthetic
atggaccaggcaatcatgga

SEQ ID NO: 38955 - DNA, 22 bp, Artificial Sequence
  Synthetic
ccctaagaggaagaggcagcac

SEQ ID NO: 38956 - DNA, 21 bp, Artificial Sequence
  Synthetic
gcattagaatggaccaggcag

SEQ ID NO: 38957 - DNA, 21 bp, Artificial Sequence
  Synthetic
gtctgcggaaccggtgagtac

SEQ ID NO: 38958 - DNA, 19 bp, Artificial Sequence
  Synthetic
gaggcgtcgcaagagccct

SEQ ID NO: 38959 - DNA, 21 bp, Artificial Sequence
  Synthetic
gttcgacataatggccggggc

SEQ ID NO: 38960 - DNA, 22 bp, Artificial Sequence
  Synthetic
agaccttgtgacattgtcccgg

SEQ ID NO: 38961 - DNA, 21 bp, Artificial Sequence
  Synthetic
ggtgctcgtggatgaactcca

SEQ ID NO: 38962 - DNA, 22 bp, Artificial Sequence
  Synthetic
tatcggctggtacctggtagct

SEQ ID NO: 38963 - DNA, 20 bp, Artificial Sequence
  Synthetic
gatacagcggcttgcggaga

SEQ ID NO: 38964 - DNA, 20 bp, Artificial Sequence
  Synthetic
ccaaacatcccgcgctccaa

SEQ ID NO: 38965 - DNA, 22 bp, Artificial Sequence
  Synthetic
gctgtgtgcaccagaggtgtag

SEQ ID NO: 38966 - DNA, 22 bp, Artificial Sequence
  Synthetic
agatgtggaagtgtctcgtgcg

SEQ ID NO: 38967 - DNA, 19 bp, Artificial Sequence
  Synthetic
cccatttggcagggcccca

SEQ ID NO: 38968 - DNA, 22 bp, Artificial Sequence
  Synthetic
agtggatgaacaggctcatcgc

SEQ ID NO: 38969 - DNA, 20 bp, Artificial Sequence
  Synthetic
ggggggacggtgtgatgtca

SEQ ID NO: 38970 - DNA, 22 bp, Artificial Sequence
  Synthetic
ggatggagtgagacttcaccgc

SEQ ID NO: 38971 - DNA, 22 bp, Artificial Sequence
  Synthetic
gaacgaggtgttttgcgtggac

SEQ ID NO: 38972 - DNA, 21 bp, Artificial Sequence
  Synthetic
ctgcggaggccctatgttcaa

SEQ ID NO: 38973 - DNA, 22 bp, Artificial Sequence
  Synthetic
gaccaggtattctgctccaccc

SEQ ID NO: 38974 - DNA, 22 bp, Artificial Sequence
  Synthetic
ggagaagaacccagcacttagg

SEQ ID NO: 38975 - DNA, 21 bp, Artificial Sequence
  Synthetic
cagcacacagattggtggaat

SEQ ID NO: 38976 - DNA, 22 bp, Artificial Sequence
  Synthetic
gaagagcaacagccatactcag

SEQ ID NO: 38977 - DNA, 25 bp, Artificial Sequence
  Synthetic
aacttactcatcgtcaatgatgtgg

SEQ ID NO: 38978 - DNA, 25 bp, Artificial Sequence
  Synthetic
taataaaacttcttcccttcgcagc

SEQ ID NO: 38979 - DNA, 21 bp, Artificial Sequence
  Synthetic
acacagtggcaggtccttccg

SEQ ID NO: 38980 - DNA, 21 bp, Artificial Sequence
  Synthetic
caaggccttctccggatctgc

SEQ ID NO: 38981 - DNA, 20 bp, Artificial Sequence
  Synthetic
gctcctcaaggttcccgctc

SEQ ID NO: 38982 - DNA, 20 bp, Artificial Sequence
  Synthetic
agcagtgccccagagcttcc

SEQ ID NO: 38983 - DNA, 22 bp, Artificial Sequence
  Synthetic
ggatgccacatccatcttgggc

SEQ ID NO: 38984 - DNA, 20 bp, Artificial Sequence
  Synthetic
cgaccagcggcgatgttgtc

SEQ ID NO: 38985 - DNA, 21 bp, Artificial Sequence
  Synthetic
tgcttggtatgagctcacgcc

SEQ ID NO: 38986 - DNA, 20 bp, Artificial Sequence
  Synthetic
ctccacggaggacctggtca

SEQ ID NO: 38987 - DNA, 19 bp, Artificial Sequence
  Synthetic
agctcctgaggcgactgca

SEQ ID NO: 38988 - DNA, 20 bp, Artificial Sequence
  Synthetic
tacaccacgggcccctgtac

SEQ ID NO: 38989 - DNA, 20 bp, Artificial Sequence
  Synthetic
gccgtgttgacgtccatgct

SEQ ID NO: 38990 - DNA, 19 bp, Artificial Sequence
  Synthetic
ggagcctggggatccggat

SEQ ID NO: 38991 - DNA, 22 bp, Artificial Sequence
  Synthetic
atccaagtttggctatggggca

SEQ ID NO: 38992 - DNA, 19 bp, Artificial Sequence
  Synthetic
cctggccgtgatgggaagc

SEQ ID NO: 38993 - DNA, 25 bp, Artificial Sequence
  Synthetic
agaaattgtggaatacctttggagg

SEQ ID NO: 38994 - DNA, 23 bp, Artificial Sequence
  Synthetic
agggaagaaaaagacagacatcg

SEQ ID NO: 38995 - DNA, 25 bp, Artificial Sequence
  Synthetic
tgtacaaagtgtagtttaccactgc

SEQ ID NO: 38996 - DNA, 20 bp, Artificial Sequence
  Synthetic
tcggctgtttgagctaccgg

SEQ ID NO: 38997 - DNA, 20 bp, Artificial Sequence
  Synthetic
gtacggtacaaacgtgccaa

SEQ ID NO: 38998 - DNA, 21 bp, Artificial Sequence
  Synthetic
gatcctgaagacgaggaggag

SEQ ID NO: 38999 - DNA, 22 bp, Artificial Sequence
  Synthetic
tgtgtatatggggaaacaggca

SEQ ID NO: 39000 - DNA, 20 bp, Artificial Sequence
  Synthetic
gaacgagcgggtggacaagt

SEQ ID NO: 39001 - DNA, 20 bp, Artificial Sequence
  Synthetic
acacctgccagtgagaatgt

SEQ ID NO: 39002 - DNA, 25 bp, Artificial Sequence
  Synthetic
tttactattatgcaggcacttcacg

SEQ ID NO: 39003 - DNA, 20 bp, Artificial Sequence
  Synthetic
taactttgccaccgtccact

SEQ ID NO: 39004 - DNA, 21 bp, Artificial Sequence
  Synthetic
cgatttcggtacaagatggcc

SEQ ID NO: 39005 - DNA, 22 bp, Artificial Sequence
  Synthetic
ctggcactgtacaacaaacagg

SEQ ID NO: 39006 - DNA, 22 bp, Artificial Sequence
  Synthetic
gatcccagagatcccagaccga

SEQ ID NO: 39007 - DNA, 25 bp, Artificial Sequence
  Synthetic
tagaacctgctaacgcaatagaagt

SEQ ID NO: 39008 - DNA, 21 bp, Artificial Sequence
  Synthetic
tggtgtatcgtttcctgtgca

SEQ ID NO: 39009 - DNA, 21 bp, Artificial Sequence
  Synthetic
cacttggggccgaataacctt

SEQ ID NO: 39010 - DNA, 23 bp, Artificial Sequence
  Synthetic
tgcttgagagagaactagttgcc

SEQ ID NO: 39011 - DNA, 25 bp, Artificial Sequence
  Synthetic
ctgaacctttaaaatcatgtctggc

SEQ ID NO: 39012 - DNA, 24 bp, Artificial Sequence
  Synthetic
accaaagaactggtacaaaacact

SEQ ID NO: 39013 - DNA, 20 bp, Artificial Sequence
  Synthetic
ccagtgacgtgttggttgtc

SEQ ID NO: 39014 - DNA, 24 bp, Artificial Sequence
  Synthetic
tggtgttattcctgaaaatcctgt

SEQ ID NO: 39015 - DNA, 23 bp, Artificial Sequence
  Synthetic
tgctgattttgcttgcaagtttg

SEQ ID NO: 39016 - DNA, 25 bp, Artificial Sequence
  Synthetic
gttttccatgtgcaggtagaaaagt

SEQ ID NO: 39017 - DNA, 20 bp, Artificial Sequence
  Synthetic
catggtggtggagttgcaaa

SEQ ID NO: 39018 - DNA, 20 bp, Artificial Sequence
  Synthetic
tgaatttcgtgctggcagac

SEQ ID NO: 39019 - DNA, 24 bp, Artificial Sequence
  Synthetic
tgatgttgttgcagctaacatgtt

SEQ ID NO: 39020 - DNA, 22 bp, Artificial Sequence
  Synthetic
cctgtagctactggtgatgttg

SEQ ID NO: 39021 - DNA, 24 bp, Artificial Sequence
  Synthetic
actattgttggtggtgtaattcgt

SEQ ID NO: 39022 - DNA, 25 bp, Artificial Sequence
  Synthetic
tactgttttagctgcgtataatggc

SEQ ID NO: 39023 - DNA, 23 bp, Artificial Sequence
  Synthetic
agtaaagttgtttccgctttgca

SEQ ID NO: 39024 - DNA, 21 bp, Artificial Sequence
  Synthetic
acgtgtagagcatccagatgt

SEQ ID NO: 39025 - DNA, 20 bp, Artificial Sequence
  Synthetic
cagggtttggtgtggcagtt

SEQ ID NO: 39026 - DNA, 21 bp, Artificial Sequence
  Synthetic
catctgctagtgctctgcttg

SEQ ID NO: 39027 - DNA, 20 bp, Artificial Sequence
  Synthetic
cgcactgtagcaggtgtttc

SEQ ID NO: 39028 - DNA, 23 bp, Artificial Sequence
  Synthetic
ggcaactgaagaggcttttaaac

SEQ ID NO: 39029 - DNA, 25 bp, Artificial Sequence
  Synthetic
aatgaaacgttattgcactgttcaa

SEQ ID NO: 39030 - DNA, 24 bp, Artificial Sequence
  Synthetic
actggtgtggattttgtagttgaa

SEQ ID NO: 39031 - DNA, 25 bp, Artificial Sequence
  Synthetic
tatgagaaaagatggtgacgatgtt

SEQ ID NO: 39032 - DNA, 24 bp, Artificial Sequence
  Synthetic
taaagaagtagctccaggttctgc

SEQ ID NO: 39033 - DNA, 20 bp, Artificial Sequence
  Synthetic
actcgaccacactgactggt

SEQ ID NO: 39034 - DNA, 25 bp, Artificial Sequence
  Synthetic
atttgaaatctcaggaactatgcgt

SEQ ID NO: 39035 - DNA, 21 bp, Artificial Sequence
  Synthetic
cggtccaaattcctcctgatg

SEQ ID NO: 39036 - DNA, 25 bp, Artificial Sequence
  Synthetic
cattgtagagccactgagtacataa

SEQ ID NO: 39037 - DNA, 21 bp, Artificial Sequence
  Synthetic
tgcactgaactcaaactcagc

SEQ ID NO: 39038 - DNA, 22 bp, Artificial Sequence
  Synthetic
taagtcctgcttgcctgcttgt

SEQ ID NO: 39039 - DNA, 21 bp, Artificial Sequence
  Synthetic
actctgcatttgacctgtccc

SEQ ID NO: 39040 - DNA, 19 bp, Artificial Sequence
  Synthetic
aggactcccaccccgagtc

SEQ ID NO: 39041 - DNA, 24 bp, Artificial Sequence
  Synthetic
cacaaggtgctgactgtatacctg

SEQ ID NO: 39042 - DNA, 22 bp, Artificial Sequence
  Synthetic
agagacgctacctgtagatgtt

SEQ ID NO: 39043 - DNA, 23 bp, Artificial Sequence
  Synthetic
cacctcaggtgctatatgatcca

SEQ ID NO: 39044 - DNA, 25 bp, Artificial Sequence
  Synthetic
ggtgaaactaacactataacaacgc

SEQ ID NO: 39045 - DNA, 25 bp, Artificial Sequence
  Synthetic
aatgtgaagaaggacaaaaaggaga

SEQ ID NO: 39046 - DNA, 23 bp, Artificial Sequence
  Synthetic
acaatttgctaggcatttgtggg

SEQ ID NO: 39047 - DNA, 25 bp, Artificial Sequence
  Synthetic
tagaggatgcttacagatatttgcg

SEQ ID NO: 39048 - DNA, 24 bp, Artificial Sequence
  Synthetic
aagtggaacgaaaactgtgaaacg

SEQ ID NO: 39049 - DNA, 22 bp, Artificial Sequence
  Synthetic
gggcatatgaacaccgttttcg

SEQ ID NO: 39050 - DNA, 25 bp, Artificial Sequence
  Synthetic
atttgagattacaggaactatgcgc

SEQ ID NO: 39051 - DNA, 25 bp, Artificial Sequence
  Synthetic
ggagaccttaaacagtatgacagtg

SEQ ID NO: 39052 - DNA, 23 bp, Artificial Sequence
  Synthetic
agtgtacataaatacggccttgc

SEQ ID NO: 39053 - DNA, 20 bp, Artificial Sequence
  Synthetic
tcttgaggactgcgataggc

SEQ ID NO: 39054 - DNA, 20 bp, Artificial Sequence
  Synthetic
ttgggaaagtgtgcaggacc

SEQ ID NO: 39055 - DNA, 21 bp, Artificial Sequence
  Synthetic
ggctccgaagagaccaaaagg

SEQ ID NO: 39056 - DNA, 25 bp, Artificial Sequence
  Synthetic
tgaaaatggaccaagccataatgga

SEQ ID NO: 39057 - DNA, 21 bp, Artificial Sequence
  Synthetic
tccatgatgagaatgggggac

SEQ ID NO: 39058 - DNA, 23 bp, Artificial Sequence
  Synthetic
ggtcacacaaagaacaataggga

SEQ ID NO: 39059 - DNA, 21 bp, Artificial Sequence
  Synthetic
aggccagttggaatttccagc

SEQ ID NO: 39060 - DNA, 22 bp, Artificial Sequence
  Synthetic
actaccagacctatgcaacaca

SEQ ID NO: 39061 - DNA, 21 bp, Artificial Sequence
  Synthetic
gcacacagcacagaaaacagt

SEQ ID NO: 39062 - DNA, 25 bp, Artificial Sequence
  Synthetic
aatgatacagtgggcgtttgataat

SEQ ID NO: 39063 - DNA, 23 bp, Artificial Sequence
  Synthetic
accaggaagaggaggatacagaa

SEQ ID NO: 39064 - DNA, 20 bp, Artificial Sequence
  Synthetic
caccgtataccgaagccacc

SEQ ID NO: 39065 - DNA, 21 bp, Artificial Sequence
  Synthetic
tgcacacatttgcaacacagg

SEQ ID NO: 39066 - DNA, 20 bp, Artificial Sequence
  Synthetic
cctgtgttggcatggaggta

SEQ ID NO: 39067 - DNA, 22 bp, Artificial Sequence
  Synthetic
ggaacattgggctaagggtact

SEQ ID NO: 39068 - DNA, 20 bp, Artificial Sequence
  Synthetic
acgccatttttggaacaggg

SEQ ID NO: 39069 - DNA, 23 bp, Artificial Sequence
  Synthetic
cagatgaatgcaggttctatgct

SEQ ID NO: 39070 - DNA, 20 bp, Artificial Sequence
  Synthetic
gagaagaaccccgcactcag

SEQ ID NO: 39071 - DNA, 23 bp, Artificial Sequence
  Synthetic
aaaacaaggtttctcccagtagc

SEQ ID NO: 39072 - DNA, 23 bp, Artificial Sequence
  Synthetic
gcacacagattggaggagtaagg

SEQ ID NO: 39073 - DNA, 21 bp, Artificial Sequence
  Synthetic
ggcaaccaggagattgatcca

SEQ ID NO: 39074 - DNA, 25 bp, Artificial Sequence
  Synthetic
gtgctagtcaacacttatcaatgga

SEQ ID NO: 39075 - DNA, 24 bp, Artificial Sequence
  Synthetic
ggatgcaattttcctcattgactg

SEQ ID NO: 39076 - DNA, 24 bp, Artificial Sequence
  Synthetic
tcttacacgagttggaagattgca

SEQ ID NO: 39077 - DNA, 20 bp, Artificial Sequence
  Synthetic
tcttaagcgagcgaccgaat

SEQ ID NO: 39078 - DNA, 20 bp, Artificial Sequence
  Synthetic
caaagcaacgccagcgaaat

SEQ ID NO: 39079 - DNA, 24 bp, Artificial Sequence
  Synthetic
aagccaaaactgctattatgatgc

SEQ ID NO: 39080 - DNA, 22 bp, Artificial Sequence
  Synthetic
cgggtccacaattaggaaatgc

SEQ ID NO: 39081 - DNA, 22 bp, Artificial Sequence
  Synthetic
agggtactgtagtacgtccggg

SEQ ID NO: 39082 - DNA, 20 bp, Artificial Sequence
  Synthetic
tgcagcctttaggtcagcat

SEQ ID NO: 39083 - DNA, 20 bp, Artificial Sequence
  Synthetic
atgtgcagatgctaggcagg

SEQ ID NO: 39084 - DNA, 25 bp, Artificial Sequence
  Synthetic
acatgtagaggaatttgagattgct

SEQ ID NO: 39085 - DNA, 20 bp, Artificial Sequence
  Synthetic
tcgtgtagagacccctaccc

SEQ ID NO: 39086 - DNA, 22 bp, Artificial Sequence
  Synthetic
actaccacctattccgtttgct

SEQ ID NO: 39087 - DNA, 22 bp, Artificial Sequence
  Synthetic
agctcctcaaaacaatcctccg

SEQ ID NO: 39088 - DNA, 22 bp, Artificial Sequence
  Synthetic
ccaaaagacgcagagtacccga

SEQ ID NO: 39089 - DNA, 20 bp, Artificial Sequence
  Synthetic
caacacgggcaagggaatta

SEQ ID NO: 39090 - DNA, 25 bp, Artificial Sequence
  Synthetic
aacaaaaggaacaatgaaaacacga

SEQ ID NO: 39091 - DNA, 21 bp, Artificial Sequence
  Synthetic
acaattcctccaggtgtagct

SEQ ID NO: 39092 - DNA, 20 bp, Artificial Sequence
  Synthetic
tgcagacagctggacaattg

SEQ ID NO: 39093 - DNA, 25 bp, Artificial Sequence
  Synthetic
ggatattgctaaaccttgtgatcct

SEQ ID NO: 39094 - DNA, 22 bp, Artificial Sequence
  Synthetic
gacacttaccaaccgtaactgg

SEQ ID NO: 39095 - DNA, 20 bp, Artificial Sequence
  Synthetic
tagaagccggccctccttcc

SEQ ID NO: 39096 - DNA, 19 bp, Artificial Sequence
  Synthetic
cgtcgctgactccgccatc

SEQ ID NO: 39097 - DNA, 22 bp, Artificial Sequence
  Synthetic
actttgagccactaagcccccg

SEQ ID NO: 39098 - DNA, 20 bp, Artificial Sequence
  Synthetic
gctcatccccacattccagg

SEQ ID NO: 39099 - DNA, 22 bp, Artificial Sequence
  Synthetic
gtgcattcacggcatctggggt

SEQ ID NO: 39100 - DNA, 19 bp, Artificial Sequence
  Synthetic
aggcaccggacacgcgaga

SEQ ID NO: 39101 - DNA, 22 bp, Artificial Sequence
  Synthetic
gagttacaccagcgactgcacc

SEQ ID NO: 39102 - DNA, 19 bp, Artificial Sequence
  Synthetic
accggtgtctggcccggat

SEQ ID NO: 39103 - DNA, 20 bp, Artificial Sequence
  Synthetic
ccgggcttgtagggggctga

SEQ ID NO: 39104 - DNA, 19 bp, Artificial Sequence
  Synthetic
ccaggaaggcggcagcgta

SEQ ID NO: 39105 - DNA, 19 bp, Artificial Sequence
  Synthetic
cgccatcagggtctggctc

SEQ ID NO: 39106 - DNA, 18 bp, Artificial Sequence
  Synthetic
tgcggccaggtgctcatg

SEQ ID NO: 39107 - DNA, 19 bp, Artificial Sequence
  Synthetic
ctcccggtctctgcgtcgt

SEQ ID NO: 39108 - DNA, 18 bp, Artificial Sequence
  Synthetic
acgtgacccaggccctct

SEQ ID NO: 39109 - DNA, 19 bp, Artificial Sequence
  Synthetic
agggcgaggccatgaacgc

SEQ ID NO: 39110 - DNA, 21 bp, Artificial Sequence
  Synthetic
gagggaccaggtgggtggtgt

SEQ ID NO: 39111 - DNA, 20 bp, Artificial Sequence
  Synthetic
cacgatcttgggacgcagcc

SEQ ID NO: 39112 - DNA, 20 bp, Artificial Sequence
  Synthetic
gcatcgaggatggcctccgc

SEQ ID NO: 39113 - DNA, 19 bp, Artificial Sequence
  Synthetic
ctccgcctgagccgcttac

SEQ ID NO: 39114 - DNA, 19 bp, Artificial Sequence
  Synthetic
cggctggtgttgggctggt

SEQ ID NO: 39115 - DNA, 20 bp, Artificial Sequence
  Synthetic
gacagtgcgtcacagatgtc

SEQ ID NO: 39116 - DNA, 21 bp, Artificial Sequence
  Synthetic
gagaggcacccccatcattcc

SEQ ID NO: 39117 - DNA, 19 bp, Artificial Sequence
  Synthetic
cctccatgacggccacgca

SEQ ID NO: 39118 - DNA, 22 bp, Artificial Sequence
  Synthetic
aacgtccaagttgcattggctg

SEQ ID NO: 39119 - DNA, 21 bp, Artificial Sequence
  Synthetic
tgaaagagccagggggagagg

SEQ ID NO: 39120 - DNA, 21 bp, Artificial Sequence
  Synthetic
attagcctgggcatgcgtgaa

SEQ ID NO: 39121 - DNA, 20 bp, Artificial Sequence
  Synthetic
gaactcggcggcaatgtcgg

SEQ ID NO: 39122 - DNA, 21 bp, Artificial Sequence
  Synthetic
tctgggagaggttctgtgcgg

SEQ ID NO: 39123 - DNA, 22 bp, Artificial Sequence
  Synthetic
taaccgccataacgccatctgc

SEQ ID NO: 39124 - DNA, 21 bp, Artificial Sequence
  Synthetic
cgtgtaggagaacccgggtga

SEQ ID NO: 39125 - DNA, 21 bp, Artificial Sequence
  Synthetic
agatgaggccctgctcatcct

SEQ ID NO: 39126 - DNA, 20 bp, Artificial Sequence
  Synthetic
agagggcccacatccaaggg

SEQ ID NO: 39127 - DNA, 19 bp, Artificial Sequence
  Synthetic
cggccgtctgaccgagaac

SEQ ID NO: 39128 - DNA, 22 bp, Artificial Sequence
  Synthetic
aagctctgccataaccgtgtcg

SEQ ID NO: 39129 - DNA, 22 bp, Artificial Sequence
  Synthetic
tcatgggtctcaatcagggtgc

SEQ ID NO: 39130 - DNA, 20 bp, Artificial Sequence
  Synthetic
ggacgcctagcctcctccct

SEQ ID NO: 39131 - DNA, 20 bp, Artificial Sequence
  Synthetic
cgtcgtggccctcgtctcct

SEQ ID NO: 39132 - DNA, 22 bp, Artificial Sequence
  Synthetic
actgccaccatatctcgagtgc

SEQ ID NO: 39133 - DNA, 19 bp, Artificial Sequence
  Synthetic
ttccgtgcctcgggcctca

SEQ ID NO: 39134 - DNA, 22 bp, Artificial Sequence
  Synthetic
cgcaccatccgggatattctgg

SEQ ID NO: 39135 - DNA, 20 bp, Artificial Sequence
  Synthetic
gatagaccccgcccgactgc

SEQ ID NO: 39136 - DNA, 19 bp, Artificial Sequence
  Synthetic
tcccacttgcgggcagact

SEQ ID NO: 39137 - DNA, 22 bp, Artificial Sequence
  Synthetic
gctcagtctaaggagcccacca

SEQ ID NO: 39138 - DNA, 19 bp, Artificial Sequence
  Synthetic
ggggccatggtggagagca

SEQ ID NO: 39139 - DNA, 21 bp, Artificial Sequence
  Synthetic
tggtagaagcacagggggggc

SEQ ID NO: 39140 - DNA, 19 bp, Artificial Sequence
  Synthetic
aagagcccgctctcctccg

SEQ ID NO: 39141 - DNA, 22 bp, Artificial Sequence
  Synthetic
gacgaaggcccgtctgtagagg

SEQ ID NO: 39142 - DNA, 20 bp, Artificial Sequence
  Synthetic
cccctctgccgtggaagggt

SEQ ID NO: 39143 - DNA, 19 bp, Artificial Sequence
  Synthetic
caggccgcgctgtccacaa

SEQ ID NO: 39144 - DNA, 21 bp, Artificial Sequence
  Synthetic
ttccgctgtagagtcgctcct

SEQ ID NO: 39145 - DNA, 19 bp, Artificial Sequence
  Synthetic
ccgatgtcggctgtcctgc

SEQ ID NO: 39146 - DNA, 21 bp, Artificial Sequence
  Synthetic
aaccctgacaaaggcccccca

SEQ ID NO: 39147 - DNA, 21 bp, Artificial Sequence
  Synthetic
cacagaaccagcacagcaggc

SEQ ID NO: 39148 - DNA, 23 bp, Artificial Sequence
  Synthetic
tatgtgcgtttggtgtgtattgc

SEQ ID NO: 39149 - DNA, 20 bp, Artificial Sequence
  Synthetic
ctatgccaattccagcagcc

SEQ ID NO: 39150 - DNA, 22 bp, Artificial Sequence
  Synthetic
agcaggaattactcatcttgcc

SEQ ID NO: 39151 - DNA, 20 bp, Artificial Sequence
  Synthetic
caacaggcctccaccaccac

SEQ ID NO: 39152 - DNA, 20 bp, Artificial Sequence
  Synthetic
tccattgcacctcccagttc

SEQ ID NO: 39153 - DNA, 25 bp, Artificial Sequence
  Synthetic
taccaatatagagtgtttcgtgtgc

SEQ ID NO: 39154 - DNA, 20 bp, Artificial Sequence
  Synthetic
gagccattggtgatcgcatg

SEQ ID NO: 39155 - DNA, 24 bp, Artificial Sequence
  Synthetic
ggccataacctgtcagaaaaacag

SEQ ID NO: 39156 - DNA, 24 bp, Artificial Sequence
  Synthetic
gctgactatgttcgcctaagtacg

SEQ ID NO: 39157 - DNA, 20 bp, Artificial Sequence
  Synthetic
tttgcctttgtaccgggagt

SEQ ID NO: 39158 - DNA, 22 bp, Artificial Sequence
  Synthetic
aacctttttgggttgacacctg

SEQ ID NO: 39159 - DNA, 22 bp, Artificial Sequence
  Synthetic
gagactcagaagtgttgctgtt

SEQ ID NO: 39160 - DNA, 22 bp, Artificial Sequence
  Synthetic
ttggcatttgaaaatccacgtg

SEQ ID NO: 39161 - DNA, 20 bp, Artificial Sequence
  Synthetic
ggctgcagcaatctggaact

SEQ ID NO: 39162 - DNA, 21 bp, Artificial Sequence
  Synthetic
ggaggaggttgtatcgtttgc

SEQ ID NO: 39163 - DNA, 21 bp, Artificial Sequence
  Synthetic
catgcatggccaacgaccaac

SEQ ID NO: 39164 - DNA, 21 bp, Artificial Sequence
  Synthetic
tatagtgtgtccgctctgcgc

SEQ ID NO: 39165 - DNA, 21 bp, Artificial Sequence
  Synthetic
atgacgaggcctttgtgcagg

SEQ ID NO: 39166 - DNA, 20 bp, Artificial Sequence
  Synthetic
cggaggaggaggagcgacaa

SEQ ID NO: 39167 - DNA, 20 bp, Artificial Sequence
  Synthetic
caaacagttgtggggcacag

SEQ ID NO: 39168 - DNA, 25 bp, Artificial Sequence
  Synthetic
agaagtgcaaagatatcagaggagg

SEQ ID NO: 39169 - DNA, 24 bp, Artificial Sequence
  Synthetic
gcttatagatgatgttacccccca

SEQ ID NO: 39170 - DNA, 20 bp, Artificial Sequence
  Synthetic
caaaggttgtgggctcggtt

SEQ ID NO: 39171 - DNA, 20 bp, Artificial Sequence
  Synthetic
ccatgtggaccatgcaggac

SEQ ID NO: 39172 - DNA, 20 bp, Artificial Sequence
  Synthetic
tggcacgtgacaacacaggg

SEQ ID NO: 39173 - DNA, 23 bp, Artificial Sequence
  Synthetic
ccaccaatgaaaaatcagccttt

SEQ ID NO: 39174 - DNA, 21 bp, Artificial Sequence
  Synthetic
cagatgtgcaggtgttatccc

SEQ ID NO: 39175 - DNA, 22 bp, Artificial Sequence
  Synthetic
ctgttgtggatgttggccctcc

SEQ ID NO: 39176 - DNA, 20 bp, Artificial Sequence
  Synthetic
cctcctttaggcgagcactg

SEQ ID NO: 39177 - DNA, 23 bp, Artificial Sequence
  Synthetic
aggcacttttataacagagcagg

SEQ ID NO: 39178 - DNA, 20 bp, Artificial Sequence
  Synthetic
ttgtgccacacaaacaccct

SEQ ID NO: 39179 - DNA, 22 bp, Artificial Sequence
  Synthetic
catggcgttttgttggcactgt

SEQ ID NO: 39180 - DNA, 20 bp, Artificial Sequence
  Synthetic
tcccgggagagccatagtgg

SEQ ID NO: 39181 - DNA, 20 bp, Artificial Sequence
  Synthetic
ggcgtgagagtcctggagga

SEQ ID NO: 39182 - DNA, 22 bp, Artificial Sequence
  Synthetic
cttctctatgcagggagcgtgg

SEQ ID NO: 39183 - DNA, 20 bp, Artificial Sequence
  Synthetic
ctgttgtgccccacggactg

SEQ ID NO: 39184 - DNA, 20 bp, Artificial Sequence
  Synthetic
ccgccttgtcgactggtctt

SEQ ID NO: 39185 - DNA, 21 bp, Artificial Sequence
  Synthetic
actgctcctagcattgcccca

SEQ ID NO: 39186 - DNA, 20 bp, Artificial Sequence
  Synthetic
tgccgtacttcgtcagggct

SEQ ID NO: 39187 - DNA, 22 bp, Artificial Sequence
  Synthetic
tccaaggggtggagtcttctcg

SEQ ID NO: 39188 - DNA, 22 bp, Artificial Sequence
  Synthetic
tgagggggacttagtagggtgg

SEQ ID NO: 39189 - DNA, 21 bp, Artificial Sequence
  Synthetic
ccgactggcagtggaaagagc

SEQ ID NO: 39190 - DNA, 20 bp, Artificial Sequence
  Synthetic
ccggtttgcctgtgtgccaa

SEQ ID NO: 39191 - DNA, 21 bp, Artificial Sequence
  Synthetic
attctgtctccgggtgccttg

SEQ ID NO: 39192 - DNA, 20 bp, Artificial Sequence
  Synthetic
aaggtcgccatctggagggt

SEQ ID NO: 39193 - DNA, 19 bp, Artificial Sequence
  Synthetic
cccccatccgaggcaagct

SEQ ID NO: 39194 - DNA, 21 bp, Artificial Sequence
  Synthetic
caccgcttgtggaatcgtgga

SEQ ID NO: 39195 - DNA, 21 bp, Artificial Sequence
  Synthetic
aggaggcttgccagttaaccc

SEQ ID NO: 39196 - DNA, 22 bp, Artificial Sequence
  Synthetic
tatgcggcgatgacttggttgt

SEQ ID NO: 39197 - DNA, 20 bp, Artificial Sequence
  Synthetic
gcgcgccgaagtgattttgc

SEQ ID NO: 39198 - DNA, 19 bp, Artificial Sequence
  Synthetic
ccgtcttcgcggcggatga

SEQ ID NO: 39199 - DNA, 19 bp, Artificial Sequence
  Synthetic
cgacgtgggcgtggaggat

SEQ ID NO: 39200 - DNA, 19 bp, Artificial Sequence
  Synthetic
aaggcttggcggcatctgc

SEQ ID NO: 39201 - DNA, 19 bp, Artificial Sequence
  Synthetic
ccttgggtgtggcagtgcc

SEQ ID NO: 39202 - DNA, 19 bp, Artificial Sequence
  Synthetic
gcgcgactggggcatttcg

SEQ ID NO: 39203 - DNA, 22 bp, Artificial Sequence
  Synthetic
aacacgcgattttgcacctcct

SEQ ID NO: 39204 - DNA, 19 bp, Artificial Sequence
  Synthetic
gacgcctccaaagccgacc

SEQ ID NO: 39205 - DNA, 18 bp, Artificial Sequence
  Synthetic
cggcagtgctgtggtcga

SEQ ID NO: 39206 - DNA, 21 bp, Artificial Sequence
  Synthetic
cggtgtagccgtcgttggaac

SEQ ID NO: 39207 - DNA, 22 bp, Artificial Sequence
  Synthetic
ggcaggcatgacgatgatttgc

SEQ ID NO: 39208 - DNA, 19 bp, Artificial Sequence
  Synthetic
ctgccggcgaaatctggct

SEQ ID NO: 39209 - DNA, 20 bp, Artificial Sequence
  Synthetic
gtttgggcgaactcatgccg

SEQ ID NO: 39210 - DNA, 21 bp, Artificial Sequence
  Synthetic
caaaccgccacgctttcagac

SEQ ID NO: 39211 - DNA, 22 bp, Artificial Sequence
  Synthetic
actcggatagctttggttcgcg

SEQ ID NO: 39212 - DNA, 22 bp, Artificial Sequence
  Synthetic
acccacacgctgttttcatcgc

SEQ ID NO: 39213 - DNA, 22 bp, Artificial Sequence
  Synthetic
tcttccgatgccgtctgaaagc

SEQ ID NO: 39214 - DNA, 20 bp, Artificial Sequence
  Synthetic
ggacgagtcggatgcccagt

SEQ ID NO: 39215 - DNA, 20 bp, Artificial Sequence
  Synthetic
tgcccgtaaaccgcatcctc

SEQ ID NO: 39216 - DNA, 19 bp, Artificial Sequence
  Synthetic
gccagttgcgggatagccg

SEQ ID NO: 39217 - DNA, 18 bp, Artificial Sequence
  Synthetic
gctcaaacggcggcggtt

SEQ ID NO: 39218 - DNA, 21 bp, Artificial Sequence
  Synthetic
cggactgttcgacctgttcgg

SEQ ID NO: 39219 - DNA, 19 bp, Artificial Sequence
  Synthetic
gcaggctgcctttgtcggc

SEQ ID NO: 39220 - DNA, 21 bp, Artificial Sequence
  Synthetic
tcgaaatagaggcggtcgctg

SEQ ID NO: 39221 - DNA, 19 bp, Artificial Sequence
  Synthetic
agccgaaatgcagggcgat

SEQ ID NO: 39222 - DNA, 22 bp, Artificial Sequence
  Synthetic
tgaagtaggcgagccaagatgc

SEQ ID NO: 39223 - DNA, 21 bp, Artificial Sequence
  Synthetic
cgaacgcagcttgaattccgc

SEQ ID NO: 39224 - DNA, 20 bp, Artificial Sequence
  Synthetic
atcaccgccggtatcgacct

SEQ ID NO: 39225 - DNA, 22 bp, Artificial Sequence
  Synthetic
ctggaattgctggaagggacgg

SEQ ID NO: 39226 - DNA, 20 bp, Artificial Sequence
  Synthetic
ccggcagcgacggtaaaacc

SEQ ID NO: 39227 - DNA, 18 bp, Artificial Sequence
  Synthetic
gcgcgccgacaaaaccgt

SEQ ID NO: 39228 - DNA, 21 bp, Artificial Sequence
  Synthetic
caaatggcggcagagttggac

SEQ ID NO: 39229 - DNA, 20 bp, Artificial Sequence
  Synthetic
ttttgccgcgtttgcccatc

SEQ ID NO: 39230 - DNA, 19 bp, Artificial Sequence
  Synthetic
gccgcgtatcagggcttcg

SEQ ID NO: 39231 - DNA, 22 bp, Artificial Sequence
  Synthetic
cagacgatttactgggcggaca

SEQ ID NO: 39232 - DNA, 20 bp, Artificial Sequence
  Synthetic
cgtcggtcaacacgttgccg

SEQ ID NO: 39233 - DNA, 22 bp, Artificial Sequence
  Synthetic
gtctcgtcggcggtcatgatgc

SEQ ID NO: 39234 - DNA, 19 bp, Artificial Sequence
  Synthetic
gtaaaccggacggcggcgt

SEQ ID NO: 39235 - DNA, 20 bp, Artificial Sequence
  Synthetic
gcagaatggcgagtttgggc

SEQ ID NO: 39236 - DNA, 18 bp, Artificial Sequence
  Synthetic
cgatgcgcccgatgtcgt

SEQ ID NO: 39237 - DNA, 22 bp, Artificial Sequence
  Synthetic
tttcttgtccggaccgatgacg

SEQ ID NO: 39238 - DNA, 22 bp, Artificial Sequence
  Synthetic
actcggcttgtcgtcatggaac

SEQ ID NO: 39239 - DNA, 21 bp, Artificial Sequence
  Synthetic
ggcgtgtccgaaggtgtgtcc

SEQ ID NO: 39240 - DNA, 21 bp, Artificial Sequence
  Synthetic
accgtgtttgcatgggtgtct

SEQ ID NO: 39241 - DNA, 21 bp, Artificial Sequence
  Synthetic
gcgaaactgtcggaacttgcg

SEQ ID NO: 39242 - DNA, 20 bp, Artificial Sequence
  Synthetic
ctgatgtagcgtccgcccaa

SEQ ID NO: 39243 - DNA, 19 bp, Artificial Sequence
  Synthetic
gactgccgacttcgcccca

SEQ ID NO: 39244 - DNA, 20 bp, Artificial Sequence
  Synthetic
gccccaggctggtaaaaccg

SEQ ID NO: 39245 - DNA, 19 bp, Artificial Sequence
  Synthetic
caggctgctgcgttcggca

SEQ ID NO: 39246 - DNA, 19 bp, Artificial Sequence
  Synthetic
gcgaaacgcacgtcggagg

SEQ ID NO: 39247 - DNA, 18 bp, Artificial Sequence
  Synthetic
ccgccgccgagtttcact

SEQ ID NO: 39248 - DNA, 18 bp, Artificial Sequence
  Synthetic
acgccgccctgatggtga

SEQ ID NO: 39249 - DNA, 19 bp, Artificial Sequence
  Synthetic
ccatgaacgggctgtcgcg

SEQ ID NO: 39250 - DNA, 18 bp, Artificial Sequence
  Synthetic
tttcgggcaggtggcggt

SEQ ID NO: 39251 - DNA, 21 bp, Artificial Sequence
  Synthetic
ccctgttccaaaaggcgtggc

SEQ ID NO: 39252 - DNA, 18 bp, Artificial Sequence
  Synthetic
gcttcgctgcggctggtt

SEQ ID NO: 39253 - DNA, 18 bp, Artificial Sequence
  Synthetic
gggtcgtttgccggagca

SEQ ID NO: 39254 - DNA, 21 bp, Artificial Sequence
  Synthetic
gctggggcggacattgtttca

SEQ ID NO: 39255 - DNA, 20 bp, Artificial Sequence
  Synthetic
ccttcgcggctcatagtgcg

SEQ ID NO: 39256 - DNA, 19 bp, Artificial Sequence
  Synthetic
cgccggtggacgacaggat

SEQ ID NO: 39257 - DNA, 19 bp, Artificial Sequence
  Synthetic
ggcgagtttggcgcgggaa

SEQ ID NO: 39258 - DNA, 21 bp, Artificial Sequence
  Synthetic
ttaagttgaacagcgggccgc

SEQ ID NO: 39259 - DNA, 21 bp, Artificial Sequence
  Synthetic
ccgatgaaggcggcatcgttg

SEQ ID NO: 39260 - DNA, 18 bp, Artificial Sequence
  Synthetic
ccgctggttgccgccatt

SEQ ID NO: 39261 - DNA, 22 bp, Artificial Sequence
  Synthetic
aatacacggccttgcaggtcaa

SEQ ID NO: 39262 - DNA, 19 bp, Artificial Sequence
  Synthetic
cagcgacgctttcacgtgc

SEQ ID NO: 39263 - DNA, 22 bp, Artificial Sequence
  Synthetic
tgggtcatgaagcgtgtgtacc

SEQ ID NO: 39264 - DNA, 18 bp, Artificial Sequence
  Synthetic
gcgtggtaaacggcggga

SEQ ID NO: 39265 - DNA, 22 bp, Artificial Sequence
  Synthetic
tttggggttgcggtgttttcag

SEQ ID NO: 39266 - DNA, 19 bp, Artificial Sequence
  Synthetic
cgaggcagtgcagtacggc

SEQ ID NO: 39267 - DNA, 21 bp, Artificial Sequence
  Synthetic
gccaatcggcggatgtgatgg

SEQ ID NO: 39268 - DNA, 20 bp, Artificial Sequence
  Synthetic
ctgtgttgtgctcggcggag

SEQ ID NO: 39269 - DNA, 19 bp, Artificial Sequence
  Synthetic
gccggtttgcctgtcgtcc

SEQ ID NO: 39270 - DNA, 22 bp, Artificial Sequence
  Synthetic
atcggagaggctgtgccattgt

SEQ ID NO: 39271 - DNA, 20 bp, Artificial Sequence
  Synthetic
gcagtcatggcttgtgcggt

SEQ ID NO: 39272 - DNA, 19 bp, Artificial Sequence
  Synthetic
ccaggcggtctgggcgttt

SEQ ID NO: 39273 - DNA, 24 bp, Artificial Sequence
  Synthetic
atcggcatcattatttacctgtcg

SEQ ID NO: 39274 - DNA, 19 bp, Artificial Sequence
  Synthetic
cggctttggcatcgacggc

SEQ ID NO: 39275 - DNA, 18 bp, Artificial Sequence
  Synthetic
acacagggcgcggatgtc

SEQ ID NO: 39276 - DNA, 19 bp, Artificial Sequence
  Synthetic
cgagcagggtttcggcggt

SEQ ID NO: 39277 - DNA, 18 bp, Artificial Sequence
  Synthetic
ttgccgttgccgagaccg

SEQ ID NO: 39278 - DNA, 22 bp, Artificial Sequence
  Synthetic
tcagcttgaggaagacgagtgc

SEQ ID NO: 39279 - DNA, 19 bp, Artificial Sequence
  Synthetic
cgttgatggtggaggcggg

SEQ ID NO: 39280 - DNA, 21 bp, Artificial Sequence
  Synthetic
cgttcgaaatcgcgtccgagc

SEQ ID NO: 39281 - DNA, 22 bp, Artificial Sequence
  Synthetic
ccagccagttgagcatatgccg

SEQ ID NO: 39282 - DNA, 21 bp, Artificial Sequence
  Synthetic
ggacggtgtttcggcaaacag

SEQ ID NO: 39283 - DNA, 19 bp, Artificial Sequence
  Synthetic
aaggtcggtgtgcagcgtc

SEQ ID NO: 39284 - DNA, 22 bp, Artificial Sequence
  Synthetic
catggtgcagccgacaatctgg

SEQ ID NO: 39285 - DNA, 20 bp, Artificial Sequence
  Synthetic
aacggcggcagcgaaatgtt

SEQ ID NO: 39286 - DNA, 19 bp, Artificial Sequence
  Synthetic
cggttcgagcaggagcagg

SEQ ID NO: 39287 - DNA, 19 bp, Artificial Sequence
  Synthetic
catcgccgtcgaaaccgcc

SEQ ID NO: 39288 - DNA, 22 bp, Artificial Sequence
  Synthetic
ttgtccgtttgtctgtgtggcg

SEQ ID NO: 39289 - DNA, 22 bp, Artificial Sequence
  Synthetic
agccgctgatgacgctttacct

SEQ ID NO: 39290 - DNA, 19 bp, Artificial Sequence
  Synthetic
gaagcgggcgacaacgttg

SEQ ID NO: 39291 - DNA, 20 bp, Artificial Sequence
  Synthetic
gatgcgccttaccgatgccg

SEQ ID NO: 39292 - DNA, 19 bp, Artificial Sequence
  Synthetic
cgccgacgttttcaggggt

SEQ ID NO: 39293 - DNA, 18 bp, Artificial Sequence
  Synthetic
ggcaggggtttgtgccgt

SEQ ID NO: 39294 - DNA, 19 bp, Artificial Sequence
  Synthetic
atacggtcaacgcgcaggc

SEQ ID NO: 39295 - DNA, 21 bp, Artificial Sequence
  Synthetic
acgcactctgtttccgcaggc

SEQ ID NO: 39296 - DNA, 20 bp, Artificial Sequence
  Synthetic
ttgttgacatctgcaacgct

SEQ ID NO: 39297 - DNA, 21 bp, Artificial Sequence
  Synthetic
cgtatgcaggctgttggacgg

SEQ ID NO: 39298 - DNA, 19 bp, Artificial Sequence
  Synthetic
ggcggctcctgtcgtccaa

SEQ ID NO: 39299 - DNA, 22 bp, Artificial Sequence
  Synthetic
acaggatgagttgtttggcggc

SEQ ID NO: 39300 - DNA, 22 bp, Artificial Sequence
  Synthetic
gttgtcgatcgccaaaaccagc

SEQ ID NO: 39301 - DNA, 21 bp, Artificial Sequence
  Synthetic
agaactgtgccgtgtatgcgg

SEQ ID NO: 39302 - DNA, 18 bp, Artificial Sequence
  Synthetic
ttgccgccatcacgagcg

SEQ ID NO: 39303 - DNA, 19 bp, Artificial Sequence
  Synthetic
cgtgcctacgcccatcagg

SEQ ID NO: 39304 - DNA, 21 bp, Artificial Sequence
  Synthetic
tgatgacctgccggtaaagga

SEQ ID NO: 39305 - DNA, 22 bp, Artificial Sequence
  Synthetic
ttttcaatgccgacggtagcga

SEQ ID NO: 39306 - DNA, 21 bp, Artificial Sequence
  Synthetic
gtgcggaattcggctacaacg

SEQ ID NO: 39307 - DNA, 18 bp, Artificial Sequence
  Synthetic
ccgcgttgaccttgccga

SEQ ID NO: 39308 - DNA, 18 bp, Artificial Sequence
  Synthetic
cgcgccgctgtttcagga

SEQ ID NO: 39309 - DNA, 20 bp, Artificial Sequence
  Synthetic
gtagggaagctaaccgcacg

SEQ ID NO: 39310 - DNA, 20 bp, Artificial Sequence
  Synthetic
acggcgggcgggattttctg

SEQ ID NO: 39311 - DNA, 19 bp, Artificial Sequence
  Synthetic
gctgccgcatcggatgtga

SEQ ID NO: 39312 - DNA, 20 bp, Artificial Sequence
  Synthetic
gcgcgtttggtgttggcaaa

SEQ ID NO: 39313 - DNA, 21 bp, Artificial Sequence
  Synthetic
tagtcgacaccgtgcacgagc

SEQ ID NO: 39314 - DNA, 20 bp, Artificial Sequence
  Synthetic
tcgcccaaacagtttcacaa

SEQ ID NO: 39315 - DNA, 19 bp, Artificial Sequence
  Synthetic
tctccgccgttaccgctgc

SEQ ID NO: 39316 - DNA, 22 bp, Artificial Sequence
  Synthetic
aaggtaatagtgctggtgcgcg

SEQ ID NO: 39317 - DNA, 19 bp, Artificial Sequence
  Synthetic
tgcggcaagccttcgatca

SEQ ID NO: 39318 - DNA, 20 bp, Artificial Sequence
  Synthetic
ggcgcaaaccgtgttcttcg

SEQ ID NO: 39319 - DNA, 21 bp, Artificial Sequence
  Synthetic
ttgagtacgccgataccgctg

SEQ ID NO: 39320 - DNA, 18 bp, Artificial Sequence
  Synthetic
atatccacgcggcggctg

SEQ ID NO: 39321 - DNA, 19 bp, Artificial Sequence
  Synthetic
gggacagtaccgcgatgcc

SEQ ID NO: 39322 - DNA, 19 bp, Artificial Sequence
  Synthetic
atttgtcgggcggactcgg

SEQ ID NO: 39323 - DNA, 19 bp, Artificial Sequence
  Synthetic
ctgcaacagggtggcggct

SEQ ID NO: 39324 - DNA, 19 bp, Artificial Sequence
  Synthetic
gcccgccgtgttggtcgat

SEQ ID NO: 39325 - DNA, 22 bp, Artificial Sequence
  Synthetic
ctgttgggcgaaatcgacgagt

SEQ ID NO: 39326 - DNA, 19 bp, Artificial Sequence
  Synthetic
agacaaagtggcacgccgc

SEQ ID NO: 39327 - DNA, 18 bp, Artificial Sequence
  Synthetic
aaaccggtgctgacggcg

SEQ ID NO: 39328 - DNA, 19 bp, Artificial Sequence
  Synthetic
cgttacccgagccgccgat

SEQ ID NO: 39329 - DNA, 21 bp, Artificial Sequence
  Synthetic
gtttcaagccgcgcaggattt

SEQ ID NO: 39330 - DNA, 22 bp, Artificial Sequence
  Synthetic
aaaaggtggtcgggaatcaggg

SEQ ID NO: 39331 - DNA, 21 bp, Artificial Sequence
  Synthetic
ctggtgatgatgggcgggaaa

SEQ ID NO: 39332 - DNA, 19 bp, Artificial Sequence
  Synthetic
gcggacaacggcgaagtgc

SEQ ID NO: 39333 - DNA, 19 bp, Artificial Sequence
  Synthetic
agtcgatgacggcgaggca

SEQ ID NO: 39334 - DNA, 21 bp, Artificial Sequence
  Synthetic
gtctgtccagcgtgcaaacga

SEQ ID NO: 39335 - DNA, 19 bp, Artificial Sequence
  Synthetic
ccccgcaatccgtgtttgc

SEQ ID NO: 39336 - DNA, 19 bp, Artificial Sequence
  Synthetic
ggcggctgccgaattggac

SEQ ID NO: 39337 - DNA, 21 bp, Artificial Sequence
  Synthetic
ggcggatttttcttgctttcg

SEQ ID NO: 39338 - DNA, 18 bp, Artificial Sequence
  Synthetic
ccaaagtcgccgccgctt

SEQ ID NO: 39339 - DNA, 21 bp, Artificial Sequence
  Synthetic
ggaaaccaaagccaatccgcc

SEQ ID NO: 39340 - DNA, 20 bp, Artificial Sequence
  Synthetic
acgtttttgaccgtcccggc

SEQ ID NO: 39341 - DNA, 21 bp, Artificial Sequence
  Synthetic
gcattcaggtgccgctcttcc

SEQ ID NO: 39342 - DNA, 22 bp, Artificial Sequence
  Synthetic
tgcccgctatgaatttgccagc

SEQ ID NO: 39343 - DNA, 18 bp, Artificial Sequence
  Synthetic
gcgccaaacggcaaggtg

SEQ ID NO: 39344 - DNA, 19 bp, Artificial Sequence
  Synthetic
caacagggcggtcaggagc

SEQ ID NO: 39345 - DNA, 19 bp, Artificial Sequence
  Synthetic
gctggacgcgcttcaaggc

SEQ ID NO: 39346 - DNA, 19 bp, Artificial Sequence
  Synthetic
gcgaggggcccctgcattt

SEQ ID NO: 39347 - DNA, 18 bp, Artificial Sequence
  Synthetic
cgcgcgggccatccaaat

SEQ ID NO: 39348 - DNA, 22 bp, Artificial Sequence
  Synthetic
ggcaacctgataggctgggaag

SEQ ID NO: 39349 - DNA, 21 bp, Artificial Sequence
  Synthetic
atcgttgaccctgttgccgtg

SEQ ID NO: 39350 - DNA, 20 bp, Artificial Sequence
  Synthetic
cgcggttgcctatgcttggt

SEQ ID NO: 39351 - DNA, 19 bp, Artificial Sequence
  Synthetic
gtcaggcaggcgttcggca

SEQ ID NO: 39352 - DNA, 22 bp, Artificial Sequence
  Synthetic
accgtgtgttttttgatgccgg

SEQ ID NO: 39353 - DNA, 20 bp, Artificial Sequence
  Synthetic
cgacggctgcaaggtcaacc

SEQ ID NO: 39354 - DNA, 19 bp, Artificial Sequence
  Synthetic
ggcggcaacacgttcgaac

SEQ ID NO: 39355 - DNA, 21 bp, Artificial Sequence
  Synthetic
cggcgaatttctggcatacgc

SEQ ID NO: 39356 - DNA, 18 bp, Artificial Sequence
  Synthetic
cgtgggcatcaacggcga

SEQ ID NO: 39357 - DNA, 21 bp, Artificial Sequence
  Synthetic
atcgggcaggcgtaaaccaag

SEQ ID NO: 39358 - DNA, 19 bp, Artificial Sequence
  Synthetic
cgcggtcgaacacgccgaa

SEQ ID NO: 39359 - DNA, 18 bp, Artificial Sequence
  Synthetic
tgacaggccggctgaacg

SEQ ID NO: 39360 - DNA, 18 bp, Artificial Sequence
  Synthetic
ggcggcaaagggggcaaa

SEQ ID NO: 39361 - DNA, 19 bp, Artificial Sequence
  Synthetic
cacgaacggacgcaggcga

SEQ ID NO: 39362 - DNA, 19 bp, Artificial Sequence
  Synthetic
cgaccacaaccacgacgcg

SEQ ID NO: 39363 - DNA, 22 bp, Artificial Sequence
  Synthetic
ttcttcatcgacggctttggct

SEQ ID NO: 39364 - DNA, 22 bp, Artificial Sequence
  Synthetic
tttgccgaacaggtaagacgcg

SEQ ID NO: 39365 - DNA, 19 bp, Artificial Sequence
  Synthetic
cggaatccccgccaccatc

SEQ ID NO: 39366 - DNA, 20 bp, Artificial Sequence
  Synthetic
atgccgaaaagctgtttgcc

SEQ ID NO: 39367 - DNA, 22 bp, Artificial Sequence
  Synthetic
aagtgtacgccgccgatgatgt

SEQ ID NO: 39368 - DNA, 18 bp, Artificial Sequence
  Synthetic
ccatcgaagccggcgaca

SEQ ID NO: 39369 - DNA, 21 bp, Artificial Sequence
  Synthetic
attggtgtacccaacgcggcc

SEQ ID NO: 39370 - DNA, 20 bp, Artificial Sequence
  Synthetic
gggacgaaggggatttccgc

SEQ ID NO: 39371 - DNA, 21 bp, Artificial Sequence
  Synthetic
tattgaccgaagttcccgccc

SEQ ID NO: 39372 - DNA, 21 bp, Artificial Sequence
  Synthetic
cgtcgcagcccatttcgatgg

SEQ ID NO: 39373 - DNA, 18 bp, Artificial Sequence
  Synthetic
agccgcgcgcgtgcatat

SEQ ID NO: 39374 - DNA, 19 bp, Artificial Sequence
  Synthetic
aggaatccggccgctggga

SEQ ID NO: 39375 - DNA, 21 bp, Artificial Sequence
  Synthetic
gcgcgacgacgtgattatcgt

SEQ ID NO: 39376 - DNA, 18 bp, Artificial Sequence
  Synthetic
gcgcaacgtgaacggcgt

SEQ ID NO: 39377 - DNA, 18 bp, Artificial Sequence
  Synthetic
gcgcgtcgttgatgccgt

SEQ ID NO: 39378 - DNA, 20 bp, Artificial Sequence
  Synthetic
taaggtggctttcgtccgcc

SEQ ID NO: 39379 - DNA, 20 bp, Artificial Sequence
  Synthetic
gacggaaagtgaaccgccgc

SEQ ID NO: 39380 - DNA, 19 bp, Artificial Sequence
  Synthetic
ctgttggtcagccgcgcca

SEQ ID NO: 39381 - DNA, 20 bp, Artificial Sequence
  Synthetic
gcccgaacatggtggaaggc

SEQ ID NO: 39382 - DNA, 20 bp, Artificial Sequence
  Synthetic
atacgtgtcggcgcagtgtt

SEQ ID NO: 39383 - DNA, 20 bp, Artificial Sequence
  Synthetic
gatgaaatccctgggcgctt

SEQ ID NO: 39384 - DNA, 22 bp, Artificial Sequence
  Synthetic
actacttcagcggtaatcacct

SEQ ID NO: 39385 - DNA, 19 bp, Artificial Sequence
  Synthetic
tgcggacaaggggatcggg

SEQ ID NO: 39386 - DNA, 22 bp, Artificial Sequence
  Synthetic
tcccatgaaaacaggctgtcgg

SEQ ID NO: 39387 - DNA, 19 bp, Artificial Sequence
  Synthetic
aaacctgcgccgagttcgt

SEQ ID NO: 39388 - DNA, 19 bp, Artificial Sequence
  Synthetic
ccgcccatcaccgccacaa

SEQ ID NO: 39389 - DNA, 19 bp, Artificial Sequence
  Synthetic
atctgccacaacgccgaca

SEQ ID NO: 39390 - DNA, 22 bp, Artificial Sequence
  Synthetic
tacgcagcaagggattgaaggg

SEQ ID NO: 39391 - DNA, 22 bp, Artificial Sequence
  Synthetic
gatgagggagttcatcagggcg

SEQ ID NO: 39392 - DNA, 22 bp, Artificial Sequence
  Synthetic
gacagacagcatttcgatggcg

SEQ ID NO: 39393 - DNA, 20 bp, Artificial Sequence
  Synthetic
agtgtggggaaacgggtcgg

SEQ ID NO: 39394 - DNA, 19 bp, Artificial Sequence
  Synthetic
tgggttcgagcgaggcgga

SEQ ID NO: 39395 - DNA, 22 bp, Artificial Sequence
  Synthetic
aagtccggttgccaaaggatcg

SEQ ID NO: 39396 - DNA, 20 bp, Artificial Sequence
  Synthetic
taggcggctaaatgttcggg

SEQ ID NO: 39397 - DNA, 21 bp, Artificial Sequence
  Synthetic
cgcgttgatgatgtcgaaggc

SEQ ID NO: 39398 - DNA, 19 bp, Artificial Sequence
  Synthetic
gcgcgcaccagcagggatt

SEQ ID NO: 39399 - DNA, 22 bp, Artificial Sequence
  Synthetic
aacaccatcagggtcggaatgc

SEQ ID NO: 39400 - DNA, 18 bp, Artificial Sequence
  Synthetic
tcgtttatccggccgccg

SEQ ID NO: 39401 - DNA, 18 bp, Artificial Sequence
  Synthetic
attcccgtcgtcagcggc

SEQ ID NO: 39402 - DNA, 22 bp, Artificial Sequence
  Synthetic
ctatcaggtcggcgcgattcac

SEQ ID NO: 39403 - DNA, 20 bp, Artificial Sequence
  Synthetic
cctacggcgtggtgatggtc

SEQ ID NO: 39404 - DNA, 21 bp, Artificial Sequence
  Synthetic
ggcagcaacgcctttatcgtg

SEQ ID NO: 39405 - DNA, 18 bp, Artificial Sequence
  Synthetic
aaatcctgcctgccgcgt

SEQ ID NO: 39406 - DNA, 18 bp, Artificial Sequence
  Synthetic
cggcaagggcttcgtcca

SEQ ID NO: 39407 - DNA, 20 bp, Artificial Sequence
  Synthetic
gggtggtcagggtttgctcg

SEQ ID NO: 39408 - DNA, 21 bp, Artificial Sequence
  Synthetic
ccgtagtcgtccaatgcccaa

SEQ ID NO: 39409 - DNA, 20 bp, Artificial Sequence
  Synthetic
aaccatttcgggcgacgtgc

SEQ ID NO: 39410 - DNA, 19 bp, Artificial Sequence
  Synthetic
ggaggctgatgagcgcgga

SEQ ID NO: 39411 - DNA, 18 bp, Artificial Sequence
  Synthetic
cggcgatgcgctgcacta

SEQ ID NO: 39412 - DNA, 23 bp, Artificial Sequence
  Synthetic
aatagcgaccaatcaacaactga

SEQ ID NO: 39413 - DNA, 19 bp, Artificial Sequence
  Synthetic
ggcagcctgaatgcggagg

SEQ ID NO: 39414 - DNA, 19 bp, Artificial Sequence
  Synthetic
ggagtggcaacgccgggaa

SEQ ID NO: 39415 - DNA, 19 bp, Artificial Sequence
  Synthetic
ttgaagccgcggtcttgca

SEQ ID NO: 39416 - DNA, 19 bp, Artificial Sequence
  Synthetic
atgatgcggcagccttcgc

SEQ ID NO: 39417 - DNA, 19 bp, Artificial Sequence
  Synthetic
atcgggttcgcaatgccgt

SEQ ID NO: 39418 - DNA, 22 bp, Artificial Sequence
  Synthetic
caaagtccacccggaaaccacg

SEQ ID NO: 39419 - DNA, 20 bp, Artificial Sequence
  Synthetic
aggtttcgcaggattggcgg

SEQ ID NO: 39420 - DNA, 19 bp, Artificial Sequence
  Synthetic
aacacggcttcgcccaagg

SEQ ID NO: 39421 - DNA, 21 bp, Artificial Sequence
  Synthetic
ttttccgttgtaccgccggag

SEQ ID NO: 39422 - DNA, 21 bp, Artificial Sequence
  Synthetic
gatatgggggacagccacgtc

SEQ ID NO: 39423 - DNA, 20 bp, Artificial Sequence
  Synthetic
gggtcagcggaagaagtcgc

SEQ ID NO: 39424 - DNA, 22 bp, Artificial Sequence
  Synthetic
ccaaggcattttgcagggcttt

SEQ ID NO: 39425 - DNA, 20 bp, Artificial Sequence
  Synthetic
tccatcgcgccttcttcgtc

SEQ ID NO: 39426 - DNA, 18 bp, Artificial Sequence
  Synthetic
ggcggcgattttgcccga

SEQ ID NO: 39427 - DNA, 20 bp, Artificial Sequence
  Synthetic
aatccgggacaagcgtaagg

SEQ ID NO: 39428 - DNA, 20 bp, Artificial Sequence
  Synthetic
gactgtcgaagccgcagcat

SEQ ID NO: 39429 - DNA, 22 bp, Artificial Sequence
  Synthetic
ttggcttttgcttttttgcgcg

SEQ ID NO: 39430 - DNA, 20 bp, Artificial Sequence
  Synthetic
gccgcttcgtaaatcccttg

SEQ ID NO: 39431 - DNA, 21 bp, Artificial Sequence
  Synthetic
cggcatgtgtactgtaagcag

SEQ ID NO: 39432 - DNA, 23 bp, Artificial Sequence
  Synthetic
aatgcaaaaatcaaggctgatcc

SEQ ID NO: 39433 - DNA, 21 bp, Artificial Sequence
  Synthetic
cttcacggtctgcatcagtag

SEQ ID NO: 39434 - DNA, 20 bp, Artificial Sequence
  Synthetic
gcttgctacaggacgcagat

SEQ ID NO: 39435 - DNA, 23 bp, Artificial Sequence
  Synthetic
tcaacagcagatttcaacttcga

SEQ ID NO: 39436 - DNA, 20 bp, Artificial Sequence
  Synthetic
ggcgaccatgccgtacaagg

SEQ ID NO: 39437 - DNA, 19 bp, Artificial Sequence
  Synthetic
catcgccaaagccctcgcc

SEQ ID NO: 39438 - DNA, 22 bp, Artificial Sequence
  Synthetic
aagacaaaaccgacagcaccga

SEQ ID NO: 39439 - DNA, 19 bp, Artificial Sequence
  Synthetic
aaccgtccgcatcgaaccg

SEQ ID NO: 39440 - DNA, 22 bp, Artificial Sequence
  Synthetic
tttttgggacgcatccaaagcc

SEQ ID NO: 39441 - DNA, 22 bp, Artificial Sequence
  Synthetic
cgccgtttggacttgattgacg

SEQ ID NO: 39442 - DNA, 21 bp, Artificial Sequence
  Synthetic
cggttcgtatttggcgaccca

SEQ ID NO: 39443 - DNA, 19 bp, Artificial Sequence
  Synthetic
gcgcgcgcgtgtttgaaag

SEQ ID NO: 39444 - DNA, 22 bp, Artificial Sequence
  Synthetic
tgaatcgtggtttcgatggcgg

SEQ ID NO: 39445 - DNA, 20 bp, Artificial Sequence
  Synthetic
ggacgcggtggtcgttttgc

SEQ ID NO: 39446 - DNA, 20 bp, Artificial Sequence
  Synthetic
gccctgtctttcacggcagg

SEQ ID NO: 39447 - DNA, 19 bp, Artificial Sequence
  Synthetic
tacctacccttgccgccgc

SEQ ID NO: 39448 - DNA, 21 bp, Artificial Sequence
  Synthetic
ggcggtatcgtgttcggtacg

SEQ ID NO: 39449 - DNA, 18 bp, Artificial Sequence
  Synthetic
cggcgttgcccatgctgt

SEQ ID NO: 39450 - DNA, 19 bp, Artificial Sequence
  Synthetic
ttcaaaccggccagacgcg

SEQ ID NO: 39451 - DNA, 20 bp, Artificial Sequence
  Synthetic
ggtagatgtctgccagcgcg

SEQ ID NO: 39452 - DNA, 20 bp, Artificial Sequence
  Synthetic
cattcgcgccgacaatggct

SEQ ID NO: 39453 - DNA, 18 bp, Artificial Sequence
  Synthetic
ctcgaaatcgcccgggct

SEQ ID NO: 39454 - DNA, 20 bp, Artificial Sequence
  Synthetic
aacgccccttcatccgcttc

SEQ ID NO: 39455 - DNA, 22 bp, Artificial Sequence
  Synthetic
tccatcggtgcaatattcggca

SEQ ID NO: 39456 - DNA, 22 bp, Artificial Sequence
  Synthetic
cagcctgaccttatccctgctg

SEQ ID NO: 39457 - DNA, 19 bp, Artificial Sequence
  Synthetic
caaggcatcgccctgctcc

SEQ ID NO: 39458 - DNA, 22 bp, Artificial Sequence
  Synthetic
tgtcgaacttggttgccgatgt

SEQ ID NO: 39459 - DNA, 20 bp, Artificial Sequence
  Synthetic
caaagctgcgccatcccact

SEQ ID NO: 39460 - DNA, 20 bp, Artificial Sequence
  Synthetic
gcggtttgcaaggccgaaga

SEQ ID NO: 39461 - DNA, 20 bp, Artificial Sequence
  Synthetic
cgccgcctcactctacctgc

SEQ ID NO: 39462 - DNA, 22 bp, Artificial Sequence
  Synthetic
cgccttcggcttctataccgac

SEQ ID NO: 39463 - DNA, 20 bp, Artificial Sequence
  Synthetic
gccacgcttttgagctgctg

SEQ ID NO: 39464 - DNA, 22 bp, Artificial Sequence
  Synthetic
ttggatgcgaaccatatccccg

SEQ ID NO: 39465 - DNA, 21 bp, Artificial Sequence
  Synthetic
ctgtttgggtttcggttggcg

SEQ ID NO: 39466 - DNA, 22 bp, Artificial Sequence
  Synthetic
tctgcgattttggggctttcga

SEQ ID NO: 39467 - DNA, 20 bp, Artificial Sequence
  Synthetic
atacttcgccgacgacgctg

SEQ ID NO: 39468 - DNA, 19 bp, Artificial Sequence
  Synthetic
ccgagtgcgcgccatttgc

SEQ ID NO: 39469 - DNA, 21 bp, Artificial Sequence
  Synthetic
catcctcgccattttgcccga

SEQ ID NO: 39470 - DNA, 20 bp, Artificial Sequence
  Synthetic
gaacaggaatttcacgccgc

SEQ ID NO: 39471 - DNA, 18 bp, Artificial Sequence
  Synthetic
gcttctgcggcggcaatc

SEQ ID NO: 39472 - DNA, 22 bp, Artificial Sequence
  Synthetic
cattcgggggcgtttttttcgg

SEQ ID NO: 39473 - DNA, 22 bp, Artificial Sequence
  Synthetic
tgcccttcgaactctacaccgc

SEQ ID NO: 39474 - DNA, 18 bp, Artificial Sequence
  Synthetic
tgcctatgccggcggcta

SEQ ID NO: 39475 - DNA, 19 bp, Artificial Sequence
  Synthetic
gtatgcgccgcctgacacg

SEQ ID NO: 39476 - DNA, 19 bp, Artificial Sequence
  Synthetic
ggcgacattgcccttgcac

SEQ ID NO: 39477 - DNA, 18 bp, Artificial Sequence
  Synthetic
acctcgttgccttgcgcg

SEQ ID NO: 39478 - DNA, 22 bp, Artificial Sequence
  Synthetic
ggcgcgatgtgttctaatacgc

SEQ ID NO: 39479 - DNA, 18 bp, Artificial Sequence
  Synthetic
tcacccccatcggcacca

SEQ ID NO: 39480 - DNA, 21 bp, Artificial Sequence
  Synthetic
cctacctgcgccaagtgttcg

SEQ ID NO: 39481 - DNA, 20 bp, Artificial Sequence
  Synthetic
ggccatctgcgttccagcat

SEQ ID NO: 39482 - DNA, 18 bp, Artificial Sequence
  Synthetic
aagccgcaacagccgcct

SEQ ID NO: 39483 - DNA, 21 bp, Artificial Sequence
  Synthetic
tttggactaccttcccgccgc

SEQ ID NO: 39484 - DNA, 22 bp, Artificial Sequence
  Synthetic
ttcatcttccatcgtcagcggc

SEQ ID NO: 39485 - DNA, 18 bp, Artificial Sequence
  Synthetic
tgcggacagtttcggcgc

SEQ ID NO: 39486 - DNA, 25 bp, Artificial Sequence
  Synthetic
ggaaggtcgtgatttttaacgattc

SEQ ID NO: 39487 - DNA, 22 bp, Artificial Sequence
  Synthetic
acaaacaaactggcgaaccacg

SEQ ID NO: 39488 - DNA, 21 bp, Artificial Sequence
  Synthetic
tggacaaggcgaacaagaaga

SEQ ID NO: 39489 - DNA, 21 bp, Artificial Sequence
  Synthetic
aaaccacctactctgctgaca

SEQ ID NO: 39490 - DNA, 22 bp, Artificial Sequence
  Synthetic
gcaaaaccagcttttgagcgcg

SEQ ID NO: 39491 - DNA, 19 bp, Artificial Sequence
  Synthetic
ttgaagcgcgcgctgaaac

SEQ ID NO: 39492 - DNA, 22 bp, Artificial Sequence
  Synthetic
taccgtcaacgactacctcgcc

SEQ ID NO: 39493 - DNA, 20 bp, Artificial Sequence
  Synthetic
aaagcacattgacgcgggca

SEQ ID NO: 39494 - DNA, 24 bp, Artificial Sequence
  Synthetic
ctttgtttttattggcttccacgc

SEQ ID NO: 39495 - DNA, 22 bp, Artificial Sequence
  Synthetic
tggcgatttcatgcagacaggc

SEQ ID NO: 39496 - DNA, 19 bp, Artificial Sequence
  Synthetic
ataccgcaagctggaggcg

SEQ ID NO: 39497 - DNA, 22 bp, Artificial Sequence
  Synthetic
acactacccggaaggtgtgacc

SEQ ID NO: 39498 - DNA, 19 bp, Artificial Sequence
  Synthetic
tagcggtagccggcgtcca

SEQ ID NO: 39499 - DNA, 20 bp, Artificial Sequence
  Synthetic
gcaggagcggcattgtacgg

SEQ ID NO: 39500 - DNA, 22 bp, Artificial Sequence
  Synthetic
gcattggtttgaccttgacggc

SEQ ID NO: 39501 - DNA, 19 bp, Artificial Sequence
  Synthetic
aggccatgaacggacccgc

SEQ ID NO: 39502 - DNA, 19 bp, Artificial Sequence
  Synthetic
ccgtagaacagggcggcag

SEQ ID NO: 39503 - DNA, 21 bp, Artificial Sequence
  Synthetic
gtaggtctcggtgtcatcgcc

SEQ ID NO: 39504 - DNA, 21 bp, Artificial Sequence
  Synthetic
caacgccaaagcccaagtcct

SEQ ID NO: 39505 - DNA, 21 bp, Artificial Sequence
  Synthetic
ccaaagccgagccgaaactgc

SEQ ID NO: 39506 - DNA, 19 bp, Artificial Sequence
  Synthetic
gacggcggcaaacacatcg

SEQ ID NO: 39507 - DNA, 21 bp, Artificial Sequence
  Synthetic
gttttcgccacaccgcgtatc

SEQ ID NO: 39508 - DNA, 20 bp, Artificial Sequence
  Synthetic
ccgacaggctcatccccacg

SEQ ID NO: 39509 - DNA, 18 bp, Artificial Sequence
  Synthetic
aacgccgcttccgcatcc

SEQ ID NO: 39510 - DNA, 19 bp, Artificial Sequence
  Synthetic
cggtaggccgcgacaaacg

SEQ ID NO: 39511 - DNA, 19 bp, Artificial Sequence
  Synthetic
gcagaagcgggcgacatcc

SEQ ID NO: 39512 - DNA, 22 bp, Artificial Sequence
  Synthetic
gaaatcagccttcagcgcatcg

SEQ ID NO: 39513 - DNA, 18 bp, Artificial Sequence
  Synthetic
gcgcaccgtttccgcatc

SEQ ID NO: 39514 - DNA, 22 bp, Artificial Sequence
  Synthetic
tccgacaaacgcccgtattcct

SEQ ID NO: 39515 - DNA, 19 bp, Artificial Sequence
  Synthetic
gtttcggacacggcggcga

SEQ ID NO: 39516 - DNA, 20 bp, Artificial Sequence
  Synthetic
caccgtatcggggcgtttgc

SEQ ID NO: 39517 - DNA, 21 bp, Artificial Sequence
  Synthetic
taatgtccgcgcatatccgcc

SEQ ID NO: 39518 - DNA, 21 bp, Artificial Sequence
  Synthetic
cccgtacccaaatactcgccc

SEQ ID NO: 39519 - DNA, 22 bp, Artificial Sequence
  Synthetic
cagccgtatgttttgcaggtcg

SEQ ID NO: 39520 - DNA, 21 bp, Artificial Sequence
  Synthetic
atcgcgctagacatcccaacc

SEQ ID NO: 39521 - DNA, 19 bp, Artificial Sequence
  Synthetic
gcagccttgccgccgtcat

SEQ ID NO: 39522 - DNA, 18 bp, Artificial Sequence
  Synthetic
attgcgacaacggcgccg

SEQ ID NO: 39523 - DNA, 23 bp, Artificial Sequence
  Synthetic
atcaactatcctgctatcgtccc

SEQ ID NO: 39524 - DNA, 18 bp, Artificial Sequence
  Synthetic
ccgatgccgtgcgccaat

SEQ ID NO: 39525 - DNA, 21 bp, Artificial Sequence
  Synthetic
ggccggcaaacgccaaaacac

SEQ ID NO: 39526 - DNA, 22 bp, Artificial Sequence
  Synthetic
tttgaaaaggtcaacgcgctgg

SEQ ID NO: 39527 - DNA, 22 bp, Artificial Sequence
  Synthetic
ggatggtcatcatacaggcgcg

SEQ ID NO: 39528 - DNA, 20 bp, Artificial Sequence
  Synthetic
cgaaaacatcggggcggtca

SEQ ID NO: 39529 - DNA, 20 bp, Artificial Sequence
  Synthetic
tgaggttttcgagggccccg

SEQ ID NO: 39530 - DNA, 22 bp, Artificial Sequence
  Synthetic
aagaacttttcggcggcgaagc

SEQ ID NO: 39531 - DNA, 20 bp, Artificial Sequence
  Synthetic
cttcacgccttccttgcagt

SEQ ID NO: 39532 - DNA, 21 bp, Artificial Sequence
  Synthetic
ccgtcaaacttccaacgccca

SEQ ID NO: 39533 - DNA, 18 bp, Artificial Sequence
  Synthetic
catcggcagccaaggcca

SEQ ID NO: 39534 - DNA, 19 bp, Artificial Sequence
  Synthetic
cgattttgcccgaacgcgc

SEQ ID NO: 39535 - DNA, 19 bp, Artificial Sequence
  Synthetic
ccgaaagcgggcttgaccg

SEQ ID NO: 39536 - DNA, 19 bp, Artificial Sequence
  Synthetic
gggcggcttgtccaacgct

SEQ ID NO: 39537 - DNA, 18 bp, Artificial Sequence
  Synthetic
agccgactgcgccgttac

SEQ ID NO: 39538 - DNA, 19 bp, Artificial Sequence
  Synthetic
cgcgccggattcgatgcct

SEQ ID NO: 39539 - DNA, 19 bp, Artificial Sequence
  Synthetic
ttcgccgccttctttgccg

SEQ ID NO: 39540 - DNA, 21 bp, Artificial Sequence
  Synthetic
ttaccaaccccatcgccatcg

SEQ ID NO: 39541 - DNA, 17 bp, Artificial Sequence
  Synthetic
acggcttcgcacgcgat

SEQ ID NO: 39542 - DNA, 21 bp, Artificial Sequence
  Synthetic
cgaccaaccgtttctgtgccg

SEQ ID NO: 39543 - DNA, 19 bp, Artificial Sequence
  Synthetic
gcctgcccgccgtcaaaga

SEQ ID NO: 39544 - DNA, 20 bp, Artificial Sequence
  Synthetic
ccgcgcctccccatctacct

SEQ ID NO: 39545 - DNA, 22 bp, Artificial Sequence
  Synthetic
cataggccgtctgaaaggcagc

SEQ ID NO: 39546 - DNA, 22 bp, Artificial Sequence
  Synthetic
gcagcttcctctctgatacgcc

SEQ ID NO: 39547 - DNA, 18 bp, Artificial Sequence
  Synthetic
cctgcaccagcgcgacaa

SEQ ID NO: 39548 - DNA, 20 bp, Artificial Sequence
  Synthetic
aatgcacttcctccccgacg

SEQ ID NO: 39549 - DNA, 20 bp, Artificial Sequence
  Synthetic
aatcggcggattcgtcacgg

SEQ ID NO: 39550 - DNA, 21 bp, Artificial Sequence
  Synthetic
tgttgtcgatgccttggtcgt

SEQ ID NO: 39551 - DNA, 22 bp, Artificial Sequence
  Synthetic
gttgaccgcattcatcagcacg

SEQ ID NO: 39552 - DNA, 19 bp, Artificial Sequence
  Synthetic
gtgttccgcccggtgtgga

SEQ ID NO: 39553 - DNA, 21 bp, Artificial Sequence
  Synthetic
ggtcactacggcgtactcggc

SEQ ID NO: 39554 - DNA, 22 bp, Artificial Sequence
  Synthetic
ggtggcgatggatttgttcagc

SEQ ID NO: 39555 - DNA, 21 bp, Artificial Sequence
  Synthetic
ccatccttttgaggggcacga

SEQ ID NO: 39556 - DNA, 19 bp, Artificial Sequence
  Synthetic
accgccctgccctgacctt

SEQ ID NO: 39557 - DNA, 22 bp, Artificial Sequence
  Synthetic
cgccgttacggacattcctacg

SEQ ID NO: 39558 - DNA, 22 bp, Artificial Sequence
  Synthetic
gacaaaactgcccccatctccg

SEQ ID NO: 39559 - DNA, 19 bp, Artificial Sequence
  Synthetic
cgtcggtttgggcgacgct

SEQ ID NO: 39560 - DNA, 20 bp, Artificial Sequence
  Synthetic
cgcacaaatcgaagccgacg

SEQ ID NO: 39561 - DNA, 22 bp, Artificial Sequence
  Synthetic
gctgcctgaagtttcagacggc

SEQ ID NO: 39562 - DNA, 21 bp, Artificial Sequence
  Synthetic
ataccgagtttcagcgccgtg

SEQ ID NO: 39563 - DNA, 20 bp, Artificial Sequence
  Synthetic
ctaccgccgtatcaggggct

SEQ ID NO: 39564 - DNA, 21 bp, Artificial Sequence
  Synthetic
atacaccggcaaaagcacccg

SEQ ID NO: 39565 - DNA, 25 bp, Artificial Sequence
  Synthetic
tcaacttcaaacaaactgtctttcc

SEQ ID NO: 39566 - DNA, 21 bp, Artificial Sequence
  Synthetic
ccggcataggttacgaatgtc

SEQ ID NO: 39567 - DNA, 19 bp, Artificial Sequence
  Synthetic
cttgcgcgtccctgccgaa

SEQ ID NO: 39568 - DNA, 21 bp, Artificial Sequence
  Synthetic
cgtcaaagttcggacggcaac

SEQ ID NO: 39569 - DNA, 21 bp, Artificial Sequence
  Synthetic
ttcggtttcaagtagcgcgca

SEQ ID NO: 39570 - DNA, 21 bp, Artificial Sequence
  Synthetic
gaagtacaggtggtgcagcgt

SEQ ID NO: 39571 - DNA, 19 bp, Artificial Sequence
  Synthetic
catacgccgcacaacccgc

SEQ ID NO: 39572 - DNA, 19 bp, Artificial Sequence
  Synthetic
cgcccgagcctgcccaatt

SEQ ID NO: 39573 - DNA, 18 bp, Artificial Sequence
  Synthetic
gcccgtgccaaggcagaa

SEQ ID NO: 39574 - DNA, 21 bp, Artificial Sequence
  Synthetic
ggacgtggagcagatcgaggg

SEQ ID NO: 39575 - DNA, 19 bp, Artificial Sequence
  Synthetic
cgctgtcgcgcaacagggt

SEQ ID NO: 39576 - DNA, 20 bp, Artificial Sequence
  Synthetic
cagcatgagcgcccatttcg

SEQ ID NO: 39577 - DNA, 20 bp, Artificial Sequence
  Synthetic
gcatttccccgttcggaggc

SEQ ID NO: 39578 - DNA, 21 bp, Artificial Sequence
  Synthetic
ccgatgtctgcaatgccaacg

SEQ ID NO: 39579 - DNA, 19 bp, Artificial Sequence
  Synthetic
ggaaacgggcgatggacgg

SEQ ID NO: 39580 - DNA, 22 bp, Artificial Sequence
  Synthetic
ggacaatgccgagcctgaaacg

SEQ ID NO: 39581 - DNA, 21 bp, Artificial Sequence
  Synthetic
tttgattaacaggcaacccgt

SEQ ID NO: 39582 - DNA, 20 bp, Artificial Sequence
  Synthetic
ccagcgcaccgttttcaagc

SEQ ID NO: 39583 - DNA, 19 bp, Artificial Sequence
  Synthetic
gctgccgtacagacgtgcc

SEQ ID NO: 39584 - DNA, 20 bp, Artificial Sequence
  Synthetic
aaccggtttgggtacgctgc

SEQ ID NO: 39585 - DNA, 21 bp, Artificial Sequence
  Synthetic
cacgcacctttgttcctgcct

SEQ ID NO: 39586 - DNA, 18 bp, Artificial Sequence
  Synthetic
gcaccgcgtgggcaaagt

SEQ ID NO: 39587 - DNA, 16 bp, Artificial Sequence
  Synthetic
ttgccgccgcagcctt

SEQ ID NO: 39588 - DNA, 19 bp, Artificial Sequence
  Synthetic
cgcttcatcgccgccctga

SEQ ID NO: 39589 - DNA, 18 bp, Artificial Sequence
  Synthetic
ccctcgtgcgcgaacaca

SEQ ID NO: 39590 - DNA, 21 bp, Artificial Sequence
  Synthetic
gagctgcactatcggcaggag

SEQ ID NO: 39591 - DNA, 22 bp, Artificial Sequence
  Synthetic
gccgaacaacaaatgctgcacc

SEQ ID NO: 39592 - DNA, 18 bp, Artificial Sequence
  Synthetic
acgggtcagggaaacgcg

SEQ ID NO: 39593 - DNA, 20 bp, Artificial Sequence
  Synthetic
gtcggtgcgggtgtacatgc

SEQ ID NO: 39594 - DNA, 20 bp, Artificial Sequence
  Synthetic
cggcaagttcttggacggca

SEQ ID NO: 39595 - DNA, 18 bp, Artificial Sequence
  Synthetic
gcacgatttgcgctccgc

SEQ ID NO: 39596 - DNA, 21 bp, Artificial Sequence
  Synthetic
gcccgattttcccgactgacg

SEQ ID NO: 39597 - DNA, 22 bp, Artificial Sequence
  Synthetic
gcagccgcgcaagtttttcaat

SEQ ID NO: 39598 - DNA, 21 bp, Artificial Sequence
  Synthetic
cattcccgactgccgttcagc

SEQ ID NO: 39599 - DNA, 20 bp, Artificial Sequence
  Synthetic
cgccttactcaaacggcggc

SEQ ID NO: 39600 - DNA, 19 bp, Artificial Sequence
  Synthetic
gaccgccgacatcgaagca

SEQ ID NO: 39601 - DNA, 17 bp, Artificial Sequence
  Synthetic
aaagccgcgccgttgca

SEQ ID NO: 39602 - DNA, 21 bp, Artificial Sequence
  Synthetic
ccgacctgcccgccattaacc

SEQ ID NO: 39603 - DNA, 22 bp, Artificial Sequence
  Synthetic
cctcctaaaccgacactaccgc

SEQ ID NO: 39604 - DNA, 22 bp, Artificial Sequence
  Synthetic
aaccattttttgaaccgccgcc

SEQ ID NO: 39605 - DNA, 21 bp, Artificial Sequence
  Synthetic
gcgcataaacaggaacacgcc

SEQ ID NO: 39606 - DNA, 19 bp, Artificial Sequence
  Synthetic
ggctcgaagggttcggcag

SEQ ID NO: 39607 - DNA, 18 bp, Artificial Sequence
  Synthetic
tgtgcggcggcaactgtc

SEQ ID NO: 39608 - DNA, 21 bp, Artificial Sequence
  Synthetic
cgcgcatttctccgtccaaac

SEQ ID NO: 39609 - DNA, 21 bp, Artificial Sequence
  Synthetic
ccgtgtccaactcgacaagca

SEQ ID NO: 39610 - DNA, 22 bp, Artificial Sequence
  Synthetic
caacgttaccgccgtacaaacc

SEQ ID NO: 39611 - DNA, 20 bp, Artificial Sequence
  Synthetic
gacgtaaagggcggctttgc

SEQ ID NO: 39612 - DNA, 19 bp, Artificial Sequence
  Synthetic
cccggcatggagctttggg

SEQ ID NO: 39613 - DNA, 20 bp, Artificial Sequence
  Synthetic
gtccgacaaacttgccggca

SEQ ID NO: 39614 - DNA, 19 bp, Artificial Sequence
  Synthetic
caactcctgtgcacgcgcc

SEQ ID NO: 39615 - DNA, 22 bp, Artificial Sequence
  Synthetic
ggcagctcgacaaacacgatgt

SEQ ID NO: 39616 - DNA, 22 bp, Artificial Sequence
  Synthetic
cgcttcggcaatattcgaacgc

SEQ ID NO: 39617 - DNA, 19 bp, Artificial Sequence
  Synthetic
ggcggcgacattctgccga

SEQ ID NO: 39618 - DNA, 18 bp, Artificial Sequence
  Synthetic
actcggcaatccgcgcct

SEQ ID NO: 39619 - DNA, 20 bp, Artificial Sequence
  Synthetic
cgtccatcacggttgtcggc

SEQ ID NO: 39620 - DNA, 19 bp, Artificial Sequence
  Synthetic
gcaaaacctgcccgcctcc

SEQ ID NO: 39621 - DNA, 19 bp, Artificial Sequence
  Synthetic
caccgaaccgggagacgct

SEQ ID NO: 39622 - DNA, 20 bp, Artificial Sequence
  Synthetic
catggttacgccgaccagct

SEQ ID NO: 39623 - DNA, 19 bp, Artificial Sequence
  Synthetic
agggcgaacacgaggctca

SEQ ID NO: 39624 - DNA, 19 bp, Artificial Sequence
  Synthetic
ggtttgggtggcggcctga

SEQ ID NO: 39625 - DNA, 22 bp, Artificial Sequence
  Synthetic
gatgtgttcgcggcggatttgc

SEQ ID NO: 39626 - DNA, 18 bp, Artificial Sequence
  Synthetic
ctgctgctgcgcctgcaa

SEQ ID NO: 39627 - DNA, 19 bp, Artificial Sequence
  Synthetic
agcgttgagcgtggcttgg

SEQ ID NO: 39628 - DNA, 21 bp, Artificial Sequence
  Synthetic
ttggaaattcggcggcaaacc

SEQ ID NO: 39629 - DNA, 21 bp, Artificial Sequence
  Synthetic
tgattctggcgttgcagtccg

SEQ ID NO: 39630 - DNA, 20 bp, Artificial Sequence
  Synthetic
gcaaacctgcccgaaaacgc

SEQ ID NO: 39631 - DNA, 20 bp, Artificial Sequence
  Synthetic
cgatttgccgcaaacccctg

SEQ ID NO: 39632 - DNA, 19 bp, Artificial Sequence
  Synthetic
ccgctaccacgccgaagtc

SEQ ID NO: 39633 - DNA, 21 bp, Artificial Sequence
  Synthetic
ttcttgatgggcgtcttgcgt

SEQ ID NO: 39634 - DNA, 19 bp, Artificial Sequence
  Synthetic
gaaggcatcggaagcggca

SEQ ID NO: 39635 - DNA, 20 bp, Artificial Sequence
  Synthetic
cacgtttttcttggcggcgg

SEQ ID NO: 39636 - DNA, 20 bp, Artificial Sequence
  Synthetic
aaggtatcggctgcaacggc

SEQ ID NO: 39637 - DNA, 18 bp, Artificial Sequence
  Synthetic
acgactgccgcgctttca

SEQ ID NO: 39638 - DNA, 22 bp, Artificial Sequence
  Synthetic
tgcccgcttctttgagtatcgg

SEQ ID NO: 39639 - DNA, 24 bp, Artificial Sequence
  Synthetic
tggttttgttttggtaatggcaac

SEQ ID NO: 39640 - DNA, 22 bp, Artificial Sequence
  Synthetic
tgattaaccaaatcaacgccgc

SEQ ID NO: 39641 - DNA, 24 bp, Artificial Sequence
  Synthetic
cgatgtagaagagcctgaattacc

SEQ ID NO: 39642 - DNA, 22 bp, Artificial Sequence
  Synthetic
ttcatgaaacagaaatccgcca

SEQ ID NO: 39643 - DNA, 20 bp, Artificial Sequence
  Synthetic
tttttggaaagcctgccgaa

SEQ ID NO: 39644 - DNA, 19 bp, Artificial Sequence
  Synthetic
ctgaggcttgaccccgtcg

SEQ ID NO: 39645 - DNA, 20 bp, Artificial Sequence
  Synthetic
gatcgcctggcaatcctgtc

SEQ ID NO: 39646 - DNA, 21 bp, Artificial Sequence
  Synthetic
gcagaaaatgcctgctgaccg

SEQ ID NO: 39647 - DNA, 19 bp, Artificial Sequence
  Synthetic
cggatatggccgtcgcaca

SEQ ID NO: 39648 - DNA, 20 bp, Artificial Sequence
  Synthetic
gcagtgcgcccaatccattg

SEQ ID NO: 39649 - DNA, 21 bp, Artificial Sequence
  Synthetic
atatccggcatagggcttgcc

SEQ ID NO: 39650 - DNA, 19 bp, Artificial Sequence
  Synthetic
gaaggaaaccgcgcctcgt

SEQ ID NO: 39651 - DNA, 19 bp, Artificial Sequence
  Synthetic
gccggtgtgcagctcgaca

SEQ ID NO: 39652 - DNA, 22 bp, Artificial Sequence
  Synthetic
agttcctgactgccgtaccacg

SEQ ID NO: 39653 - DNA, 20 bp, Artificial Sequence
  Synthetic
ggccccagataggcgatggt

SEQ ID NO: 39654 - DNA, 19 bp, Artificial Sequence
  Synthetic
gcgagttgggacgggttgg

SEQ ID NO: 39655 - DNA, 20 bp, Artificial Sequence
  Synthetic
cgcatagcggcacaaaagcc

SEQ ID NO: 39656 - DNA, 19 bp, Artificial Sequence
  Synthetic
cgtaggcctcggcgtcatc

SEQ ID NO: 39657 - DNA, 19 bp, Artificial Sequence
  Synthetic
ggttgctacggcccgctga

SEQ ID NO: 39658 - DNA, 21 bp, Artificial Sequence
  Synthetic
aagggtcggtcaatggttcgc

SEQ ID NO: 39659 - DNA, 18 bp, Artificial Sequence
  Synthetic
cgctgatgttggcggggt

SEQ ID NO: 39660 - DNA, 19 bp, Artificial Sequence
  Synthetic
tgcggcaaggttgaccagc

SEQ ID NO: 39661 - DNA, 21 bp, Artificial Sequence
  Synthetic
gccttcccaatagggcggacg

SEQ ID NO: 39662 - DNA, 18 bp, Artificial Sequence
  Synthetic
agccctttcgccgccaaa

SEQ ID NO: 39663 - DNA, 18 bp, Artificial Sequence
  Synthetic
ccagcgcatcaacgtgcg

SEQ ID NO: 39664 - DNA, 19 bp, Artificial Sequence
  Synthetic
tgaccgacgcaatccacgg

SEQ ID NO: 39665 - DNA, 20 bp, Artificial Sequence
  Synthetic
cgacgccttcaaagccgagc

SEQ ID NO: 39666 - DNA, 19 bp, Artificial Sequence
  Synthetic
ccctgcgggtctttccacg

SEQ ID NO: 39667 - DNA, 22 bp, Artificial Sequence
  Synthetic
gccttatctttcaacgcgtcgc

SEQ ID NO: 39668 - DNA, 19 bp, Artificial Sequence
  Synthetic
gcgcggtcagcctgcgtat

SEQ ID NO: 39669 - DNA, 19 bp, Artificial Sequence
  Synthetic
cgtaggcgggcgtattggc

SEQ ID NO: 39670 - DNA, 18 bp, Artificial Sequence
  Synthetic
aacgggctgcttgtcggc

SEQ ID NO: 39671 - DNA, 25 bp, Artificial Sequence
  Synthetic
tctaacaatatcgccatatttgggc

SEQ ID NO: 39672 - DNA, 22 bp, Artificial Sequence
  Synthetic
cttcctgctgcatcagttcggc

SEQ ID NO: 39673 - DNA, 19 bp, Artificial Sequence
  Synthetic
gctactcgcgcgcccaaca

SEQ ID NO: 39674 - DNA, 22 bp, Artificial Sequence
  Synthetic
actacgcaaacgaagccgaaca

SEQ ID NO: 39675 - DNA, 22 bp, Artificial Sequence
  Synthetic
gtttccctcatgcacgaagccg

SEQ ID NO: 39676 - DNA, 22 bp, Artificial Sequence
  Synthetic
gcgacaatcccgtcctgattgc

SEQ ID NO: 39677 - DNA, 22 bp, Artificial Sequence
  Synthetic
aaacccacgaagcctcattggg

SEQ ID NO: 39678 - DNA, 18 bp, Artificial Sequence
  Synthetic
gcttgcctgcggcgcaat

SEQ ID NO: 39679 - DNA, 18 bp, Artificial Sequence
  Synthetic
acgccctgaacactgccg

SEQ ID NO: 39680 - DNA, 21 bp, Artificial Sequence
  Synthetic
cgataacaccgtcttcgcggc

SEQ ID NO: 39681 - DNA, 21 bp, Artificial Sequence
  Synthetic
gggcaaaccggcaatcgaatg

SEQ ID NO: 39682 - DNA, 19 bp, Artificial Sequence
  Synthetic
ctgcctgtcccaatgcggc

SEQ ID NO: 39683 - DNA, 19 bp, Artificial Sequence
  Synthetic
gttgcggcggtattgcagc

SEQ ID NO: 39684 - DNA, 22 bp, Artificial Sequence
  Synthetic
aacgatctcgacgtggaaaccc

SEQ ID NO: 39685 - DNA, 21 bp, Artificial Sequence
  Synthetic
aaacaatcccaccgtggtcgc

SEQ ID NO: 39686 - DNA, 21 bp, Artificial Sequence
  Synthetic
gtcgcaagaactcagccgcct

SEQ ID NO: 39687 - DNA, 19 bp, Artificial Sequence
  Synthetic
cacccgccttcggcttcga

SEQ ID NO: 39688 - DNA, 22 bp, Artificial Sequence
  Synthetic
agaaggattatctcgcgctcgc

SEQ ID NO: 39689 - DNA, 19 bp, Artificial Sequence
  Synthetic
gggcaggtggcgcaattcc

SEQ ID NO: 39690 - DNA, 19 bp, Artificial Sequence
  Synthetic
ccggacttgcccatacccg

SEQ ID NO: 39691 - DNA, 22 bp, Artificial Sequence
  Synthetic
cgctcgaaaccctcgtttcaga

SEQ ID NO: 39692 - DNA, 20 bp, Artificial Sequence
  Synthetic
gacagtgcgctggatgcaac

SEQ ID NO: 39693 - DNA, 22 bp, Artificial Sequence
  Synthetic
aaaacccagcctatcccgacac

SEQ ID NO: 39694 - DNA, 21 bp, Artificial Sequence
  Synthetic
ccgtgcagacggttactgggc

SEQ ID NO: 39695 - DNA, 18 bp, Artificial Sequence
  Synthetic
acctgccgctgctgacca

SEQ ID NO: 39696 - DNA, 22 bp, Artificial Sequence
  Synthetic
tttcgccaaatcggacggatcg

SEQ ID NO: 39697 - DNA, 20 bp, Artificial Sequence
  Synthetic
tgccgtacatcgccgaaagc

SEQ ID NO: 39698 - DNA, 20 bp, Artificial Sequence
  Synthetic
aaacgggcgattgcaaaccg

SEQ ID NO: 39699 - DNA, 19 bp, Artificial Sequence
  Synthetic
aaaccgtccgccgtatcgc

SEQ ID NO: 39700 - DNA, 18 bp, Artificial Sequence
  Synthetic
ttgcgcgtccctgccgaa

SEQ ID NO: 39701 - DNA, 19 bp, Artificial Sequence
  Synthetic
gacgcgcggtcatcaggga

SEQ ID NO: 39702 - DNA, 18 bp, Artificial Sequence
  Synthetic
tgaagggaacacgggcgc

SEQ ID NO: 39703 - DNA, 21 bp, Artificial Sequence
  Synthetic
aagaatttccgcaacatcgcc

SEQ ID NO: 39704 - DNA, 21 bp, Artificial Sequence
  Synthetic
cgtcttggtgttccgcatcgg

SEQ ID NO: 39705 - DNA, 21 bp, Artificial Sequence
  Synthetic
gcgttgcccaagtcgtatcgt

SEQ ID NO: 39706 - DNA, 20 bp, Artificial Sequence
  Synthetic
gagctgccgtccgataaccg

SEQ ID NO: 39707 - DNA, 18 bp, Artificial Sequence
  Synthetic
gttccgccgcaatgccga

SEQ ID NO: 39708 - DNA, 18 bp, Artificial Sequence
  Synthetic
ttcgcacccgtccgcaaa

SEQ ID NO: 39709 - DNA, 20 bp, Artificial Sequence
  Synthetic
cgaacggcgaagaaatgcgc

SEQ ID NO: 39710 - DNA, 19 bp, Artificial Sequence
  Synthetic
cacccgaaccgccgagcat

SEQ ID NO: 39711 - DNA, 22 bp, Artificial Sequence
  Synthetic
gtccgcaccggcaaaatcaaac

SEQ ID NO: 39712 - DNA, 20 bp, Artificial Sequence
  Synthetic
caggttgccttccacccttc

SEQ ID NO: 39713 - DNA, 19 bp, Artificial Sequence
  Synthetic
cctgctcactcagggcgac

SEQ ID NO: 39714 - DNA, 21 bp, Artificial Sequence
  Synthetic
tgcatcggttatcagccgctt

SEQ ID NO: 39715 - DNA, 22 bp, Artificial Sequence
  Synthetic
gcgaaggcgagatatggtttgc

SEQ ID NO: 39716 - DNA, 22 bp, Artificial Sequence
  Synthetic
acttgattttgcgccaaaccgg

SEQ ID NO: 39717 - DNA, 20 bp, Artificial Sequence
  Synthetic
cgaagccatcggcacactcg

SEQ ID NO: 39718 - DNA, 21 bp, Artificial Sequence
  Synthetic
agccggcatcaaactcatcca

SEQ ID NO: 39719 - DNA, 20 bp, Artificial Sequence
  Synthetic
gcttgttcagaccgcgcagg

SEQ ID NO: 39720 - DNA, 19 bp, Artificial Sequence
  Synthetic
gcatcagggcgtgggacag

SEQ ID NO: 39721 - DNA, 18 bp, Artificial Sequence
  Synthetic
cgcccttgtttgccgcct

SEQ ID NO: 39722 - DNA, 21 bp, Artificial Sequence
  Synthetic
gggaaccattacgccgtcggc

SEQ ID NO: 39723 - DNA, 19 bp, Artificial Sequence
  Synthetic
ttgccttttgcggtgcggc

SEQ ID NO: 39724 - DNA, 19 bp, Artificial Sequence
  Synthetic
ttcgccggtctgctgatcg

SEQ ID NO: 39725 - DNA, 19 bp, Artificial Sequence
  Synthetic
ccttctgcgacacgcccgt

SEQ ID NO: 39726 - DNA, 20 bp, Artificial Sequence
  Synthetic
cacgcccgaaaccgaaaccg

SEQ ID NO: 39727 - DNA, 20 bp, Artificial Sequence
  Synthetic
cgagagcatcgtcgggttgt

SEQ ID NO: 39728 - DNA, 21 bp, Artificial Sequence
  Synthetic
catgtgcgcgtaaccaacacc

SEQ ID NO: 39729 - DNA, 19 bp, Artificial Sequence
  Synthetic
gcgtttgccgcgtccaacg

SEQ ID NO: 39730 - DNA, 22 bp, Artificial Sequence
  Synthetic
tcgtgcagcttcatcgtcaaca

SEQ ID NO: 39731 - DNA, 22 bp, Artificial Sequence
  Synthetic
ccgaacaccccttttcagacgg

SEQ ID NO: 39732 - DNA, 19 bp, Artificial Sequence
  Synthetic
accgcgcccgccataaacg

SEQ ID NO: 39733 - DNA, 19 bp, Artificial Sequence
  Synthetic
cacaagtccgccggcaaca

SEQ ID NO: 39734 - DNA, 22 bp, Artificial Sequence
  Synthetic
tcttcggcagattcgacttgcg

SEQ ID NO: 39735 - DNA, 19 bp, Artificial Sequence
  Synthetic
ccagtttggacggcaggct

SEQ ID NO: 39736 - DNA, 22 bp, Artificial Sequence
  Synthetic
ggcagatttgttcgagccttgc

SEQ ID NO: 39737 - DNA, 21 bp, Artificial Sequence
  Synthetic
cggacaaagcctcggagaagc

SEQ ID NO: 39738 - DNA, 20 bp, Artificial Sequence
  Synthetic
tggtacgccgatgccgtact

SEQ ID NO: 39739 - DNA, 19 bp, Artificial Sequence
  Synthetic
acttctggacgctgctgcc

SEQ ID NO: 39740 - DNA, 19 bp, Artificial Sequence
  Synthetic
ggaagccgttccttccgct

SEQ ID NO: 39741 - DNA, 22 bp, Artificial Sequence
  Synthetic
cgtcgtcgctttcttcaaaggc

SEQ ID NO: 39742 - DNA, 22 bp, Artificial Sequence
  Synthetic
cttaaacgcgcttctttgccgc

SEQ ID NO: 39743 - DNA, 18 bp, Artificial Sequence
  Synthetic
cccagccggtgtgcgttt

SEQ ID NO: 39744 - DNA, 19 bp, Artificial Sequence
  Synthetic
caacgcgctgtccgactgg

SEQ ID NO: 39745 - DNA, 22 bp, Artificial Sequence
  Synthetic
ggtgcatacgccgaagtcatcg

SEQ ID NO: 39746 - DNA, 19 bp, Artificial Sequence
  Synthetic
atcgccgtggacgacatcg

SEQ ID NO: 39747 - DNA, 18 bp, Artificial Sequence
  Synthetic
ccatgcttgccgaacgcg

SEQ ID NO: 39748 - DNA, 21 bp, Artificial Sequence
  Synthetic
cgatagctgccgttacgcagc

SEQ ID NO: 39749 - DNA, 22 bp, Artificial Sequence
  Synthetic
cgcatcgagataaagctgcggc

SEQ ID NO: 39750 - DNA, 21 bp, Artificial Sequence
  Synthetic
catttccttctccgccacgcg

SEQ ID NO: 39751 - DNA, 18 bp, Artificial Sequence
  Synthetic
gccgccgttgccgaaaca

SEQ ID NO: 39752 - DNA, 22 bp, Artificial Sequence
  Synthetic
ggcatcttccgccgtttcaaac

SEQ ID NO: 39753 - DNA, 22 bp, Artificial Sequence
  Synthetic
ctcgtcctgatcgaaaccgacc

SEQ ID NO: 39754 - DNA, 20 bp, Artificial Sequence
  Synthetic
taaagggcagccccagcgtg

SEQ ID NO: 39755 - DNA, 18 bp, Artificial Sequence
  Synthetic
gcgacccagccgccaaat

SEQ ID NO: 39756 - DNA, 20 bp, Artificial Sequence
  Synthetic
cgctgatgacgctcgaaggc

SEQ ID NO: 39757 - DNA, 19 bp, Artificial Sequence
  Synthetic
gccgactgcacgtccgcat

SEQ ID NO: 39758 - DNA, 21 bp, Artificial Sequence
  Synthetic
ctgctgccgctgaaatccaca

SEQ ID NO: 39759 - DNA, 18 bp, Artificial Sequence
  Synthetic
ccgccacatcgggcgaaa

SEQ ID NO: 39760 - DNA, 20 bp, Artificial Sequence
  Synthetic
actgctccaaaccgacctgc

SEQ ID NO: 39761 - DNA, 18 bp, Artificial Sequence
  Synthetic
tcctgctgcaacgcaccc

SEQ ID NO: 39762 - DNA, 21 bp, Artificial Sequence
  Synthetic
agctgtcggcgatttgatccg

SEQ ID NO: 39763 - DNA, 22 bp, Artificial Sequence
  Synthetic
cggcagtgccatcatcaaaagc

SEQ ID NO: 39764 - DNA, 19 bp, Artificial Sequence
  Synthetic
ggcacgtccgtcacccaca

SEQ ID NO: 39765 - DNA, 19 bp, Artificial Sequence
  Synthetic
accgtggccgaagtgttcg

SEQ ID NO: 39766 - DNA, 20 bp, Artificial Sequence
  Synthetic
tcagacggcattcgggcaaa

SEQ ID NO: 39767 - DNA, 21 bp, Artificial Sequence
  Synthetic
accaattacgatgtgtgcgtt

SEQ ID NO: 39768 - DNA, 20 bp, Artificial Sequence
  Synthetic
acgtttggctgcgatatcag

SEQ ID NO: 39769 - DNA, 21 bp, Artificial Sequence
  Synthetic
tttggttgcatttgccaagac

SEQ ID NO: 39770 - DNA, 22 bp, Artificial Sequence
  Synthetic
gtatccgccaaacccttacgcg

SEQ ID NO: 39771 - DNA, 18 bp, Artificial Sequence
  Synthetic
acgcccaacgaggcttcg

SEQ ID NO: 39772 - DNA, 20 bp, Artificial Sequence
  Synthetic
gcgaaccggattccaaggcg

SEQ ID NO: 39773 - DNA, 22 bp, Artificial Sequence
  Synthetic
tcgtcaatcaccatcaccacgc

SEQ ID NO: 39774 - DNA, 20 bp, Artificial Sequence
  Synthetic
accagccccaacatccggaa

SEQ ID NO: 39775 - DNA, 22 bp, Artificial Sequence
  Synthetic
caaaacccaaggataggcctcc

SEQ ID NO: 39776 - DNA, 22 bp, Artificial Sequence
  Synthetic
attagacagggcggagatgtgc

SEQ ID NO: 39777 - DNA, 19 bp, Artificial Sequence
  Synthetic
cctgcgggcgatggacact

SEQ ID NO: 39778 - DNA, 20 bp, Artificial Sequence
  Synthetic
tttgtcggtttcgcggctgg

SEQ ID NO: 39779 - DNA, 21 bp, Artificial Sequence
  Synthetic
taacgcgcgataaaggggacg

SEQ ID NO: 39780 - DNA, 22 bp, Artificial Sequence
  Synthetic
aaggttgcggaatgtgtgagga

SEQ ID NO: 39781 - DNA, 22 bp, Artificial Sequence
  Synthetic
gctgcgacagaaagcaccaatg

SEQ ID NO: 39782 - DNA, 22 bp, Artificial Sequence
  Synthetic
aatggtgcgttccatgctgtcc

SEQ ID NO: 39783 - DNA, 19 bp, Artificial Sequence
  Synthetic
caaaccggccacctgtgca

SEQ ID NO: 39784 - DNA, 20 bp, Artificial Sequence
  Synthetic
gccccgtccaagaaagcgtc

SEQ ID NO: 39785 - DNA, 19 bp, Artificial Sequence
  Synthetic
ggcagcgtcgaccagcagt

SEQ ID NO: 39786 - DNA, 19 bp, Artificial Sequence
  Synthetic
cctgtccctcgtcgttgcc

SEQ ID NO: 39787 - DNA, 21 bp, Artificial Sequence
  Synthetic
tcgtcccctacttcaccccct

SEQ ID NO: 39788 - DNA, 20 bp, Artificial Sequence
  Synthetic
acgaagaatgcagccccgac

SEQ ID NO: 39789 - DNA, 22 bp, Artificial Sequence
  Synthetic
cacatcctcctccaacagctcc

SEQ ID NO: 39790 - DNA, 22 bp, Artificial Sequence
  Synthetic
tgggcaaagccttgaaacagcc

SEQ ID NO: 39791 - DNA, 20 bp, Artificial Sequence
  Synthetic
ccggttgcggacaagtcgat

SEQ ID NO: 39792 - DNA, 22 bp, Artificial Sequence
  Synthetic
ccacgcttttgcccaacttgac

SEQ ID NO: 39793 - DNA, 24 bp, Artificial Sequence
  Synthetic
gttcagacggcattgtttatctgt

SEQ ID NO: 39794 - DNA, 20 bp, Artificial Sequence
  Synthetic
aaatgtgggcaatatcgggc

SEQ ID NO: 39795 - DNA, 21 bp, Artificial Sequence
  Synthetic
tttgaaagcggatgggggacg

SEQ ID NO: 39796 - DNA, 21 bp, Artificial Sequence
  Synthetic
ttttccatgctgaccgtgccg

SEQ ID NO: 39797 - DNA, 22 bp, Artificial Sequence
  Synthetic
atttgccatattgccgccgaag

SEQ ID NO: 39798 - DNA, 22 bp, Artificial Sequence
  Synthetic
tgccggctgatattgaggtagc

SEQ ID NO: 39799 - DNA, 19 bp, Artificial Sequence
  Synthetic
cgggcgagcctttgagggt

SEQ ID NO: 39800 - DNA, 20 bp, Artificial Sequence
  Synthetic
ctgcttccgtaccggcgatc

SEQ ID NO: 39801 - DNA, 21 bp, Artificial Sequence
  Synthetic
cggtggaggacaggaatgtgc

SEQ ID NO: 39802 - DNA, 20 bp, Artificial Sequence
  Synthetic
cccccagcctggcatcgatg

SEQ ID NO: 39803 - DNA, 18 bp, Artificial Sequence
  Synthetic
ggtgcgccgcaaaccgat

SEQ ID NO: 39804 - DNA, 19 bp, Artificial Sequence
  Synthetic
ggtaacgtccgcgccccat

SEQ ID NO: 39805 - DNA, 19 bp, Artificial Sequence
  Synthetic
cgtcgcgccaggtttgacg

SEQ ID NO: 39806 - DNA, 21 bp, Artificial Sequence
  Synthetic
ccgtttggcagccagaattcg

SEQ ID NO: 39807 - DNA, 22 bp, Artificial Sequence
  Synthetic
tcgatacgcaacgccataacgt

SEQ ID NO: 39808 - DNA, 22 bp, Artificial Sequence
  Synthetic
agaacgtcggtgtctttgagca

SEQ ID NO: 39809 - DNA, 18 bp, Artificial Sequence
  Synthetic
gcacgccccaaaatcgcc

SEQ ID NO: 39810 - DNA, 22 bp, Artificial Sequence
  Synthetic
acacgttgtcgatttggcaccc

SEQ ID NO: 39811 - DNA, 19 bp, Artificial Sequence
  Synthetic
tccgacagggacggacagc

SEQ ID NO: 39812 - DNA, 19 bp, Artificial Sequence
  Synthetic
ggtcatgctggtcgcccat

SEQ ID NO: 39813 - DNA, 20 bp, Artificial Sequence
  Synthetic
actgtggcagaccgttaccg

SEQ ID NO: 39814 - DNA, 18 bp, Artificial Sequence
  Synthetic
cgggctgttgcgccaaca

SEQ ID NO: 39815 - DNA, 18 bp, Artificial Sequence
  Synthetic
ggcgcgctttggggtgtt

SEQ ID NO: 39816 - DNA, 22 bp, Artificial Sequence
  Synthetic
acgttttttgctgttggacggc

SEQ ID NO: 39817 - DNA, 20 bp, Artificial Sequence
  Synthetic
cagggttgccattcgggggt

SEQ ID NO: 39818 - DNA, 19 bp, Artificial Sequence
  Synthetic
ttccatcacttgcgccgcc

SEQ ID NO: 39819 - DNA, 19 bp, Artificial Sequence
  Synthetic
cggcgacggagtgcgtact

SEQ ID NO: 39820 - DNA, 20 bp, Artificial Sequence
  Synthetic
cccggcagtcgattacccag

SEQ ID NO: 39821 - DNA, 18 bp, Artificial Sequence
  Synthetic
catcggatgccgcgccaa

SEQ ID NO: 39822 - DNA, 21 bp, Artificial Sequence
  Synthetic
cgactgccgttccgaaggtca

SEQ ID NO: 39823 - DNA, 19 bp, Artificial Sequence
  Synthetic
cgccgaaccaaaccagccc

SEQ ID NO: 39824 - DNA, 19 bp, Artificial Sequence
  Synthetic
gcccgatggtgcgcctgaa

SEQ ID NO: 39825 - DNA, 18 bp, Artificial Sequence
  Synthetic
gcgcatcgccattgtccg

SEQ ID NO: 39826 - DNA, 21 bp, Artificial Sequence
  Synthetic
gcaaaccgcgtcgaatacgtc

SEQ ID NO: 39827 - DNA, 19 bp, Artificial Sequence
  Synthetic
cccgacgatggggctgaac

SEQ ID NO: 39828 - DNA, 21 bp, Artificial Sequence
  Synthetic
ggattttcagagcctccgccg

SEQ ID NO: 39829 - DNA, 20 bp, Artificial Sequence
  Synthetic
cgaagaaatcgcccgcaccg

SEQ ID NO: 39830 - DNA, 21 bp, Artificial Sequence
  Synthetic
aagccagcatcctgccggata

SEQ ID NO: 39831 - DNA, 22 bp, Artificial Sequence
  Synthetic
tgacctgtaccggtgcactttc

SEQ ID NO: 39832 - DNA, 22 bp, Artificial Sequence
  Synthetic
tacggatctggtgggaaagggc

SEQ ID NO: 39833 - DNA, 22 bp, Artificial Sequence
  Synthetic
ccgtgccacggttcgaaattcg

SEQ ID NO: 39834 - DNA, 18 bp, Artificial Sequence
  Synthetic
gcggcgggcaaaggcatt

SEQ ID NO: 39835 - DNA, 20 bp, Artificial Sequence
  Synthetic
cgcgtttcgaattccgctgg

SEQ ID NO: 39836 - DNA, 19 bp, Artificial Sequence
  Synthetic
gtaaccggccgtccgcaga

SEQ ID NO: 39837 - DNA, 22 bp, Artificial Sequence
  Synthetic
gtgaaggcgttgatgagttcgc

SEQ ID NO: 39838 - DNA, 21 bp, Artificial Sequence
  Synthetic
tgtgccgctgttttttcccgt

SEQ ID NO: 39839 - DNA, 19 bp, Artificial Sequence
  Synthetic
caaaatcctgcgccgccca

SEQ ID NO: 39840 - DNA, 22 bp, Artificial Sequence
  Synthetic
tggagcgaggcgtattacaccg

SEQ ID NO: 39841 - DNA, 22 bp, Artificial Sequence
  Synthetic
ggtgcttggtgtcgattttgcc

SEQ ID NO: 39842 - DNA, 21 bp, Artificial Sequence
  Synthetic
atccaccctgcccgcctttta

SEQ ID NO: 39843 - DNA, 21 bp, Artificial Sequence
  Synthetic
atccgctgttttgcttcgggc

SEQ ID NO: 39844 - DNA, 20 bp, Artificial Sequence
  Synthetic
cagcgcgccttgaatttcgc

SEQ ID NO: 39845 - DNA, 20 bp, Artificial Sequence
  Synthetic
atggcgatgcgcggtttgtg

SEQ ID NO: 39846 - DNA, 20 bp, Artificial Sequence
  Synthetic
ttttcatcgggcggggaagc

SEQ ID NO: 39847 - DNA, 20 bp, Artificial Sequence
  Synthetic
gcaggttcggtttttgcgcc

SEQ ID NO: 39848 - DNA, 18 bp, Artificial Sequence
  Synthetic
gctgccgatgcctttggc

SEQ ID NO: 39849 - DNA, 22 bp, Artificial Sequence
  Synthetic
caggttacgatggtgtggtccg

SEQ ID NO: 39850 - DNA, 22 bp, Artificial Sequence
  Synthetic
ttgaccgaggtgtttctgcagg

SEQ ID NO: 39851 - DNA, 19 bp, Artificial Sequence
  Synthetic
acggaacagacgggggcga

SEQ ID NO: 39852 - DNA, 19 bp, Artificial Sequence
  Synthetic
tgtttcatgcgccgtgcgg

SEQ ID NO: 39853 - DNA, 19 bp, Artificial Sequence
  Synthetic
cttgaaaccggcgttgcgg

SEQ ID NO: 39854 - DNA, 22 bp, Artificial Sequence
  Synthetic
aatcaaacccgaaaaacgcggc

SEQ ID NO: 39855 - DNA, 24 bp, Artificial Sequence
  Synthetic
tttccaagtcaagcctacattcat

SEQ ID NO: 39856 - DNA, 21 bp, Artificial Sequence
  Synthetic
aaccgcccgtaatccaaagca

SEQ ID NO: 39857 - DNA, 19 bp, Artificial Sequence
  Synthetic
ggccggcgtagttgtggct

SEQ ID NO: 39858 - DNA, 19 bp, Artificial Sequence
  Synthetic
gcgcttttcggcagggtgc

SEQ ID NO: 39859 - DNA, 19 bp, Artificial Sequence
  Synthetic
aagacgtacaccgccgcac

SEQ ID NO: 39860 - DNA, 19 bp, Artificial Sequence
  Synthetic
cccgaaaacggcaccgtgg

SEQ ID NO: 39861 - DNA, 19 bp, Artificial Sequence
  Synthetic
gggaatctgcccccggatg

SEQ ID NO: 39862 - DNA, 18 bp, Artificial Sequence
  Synthetic
gcccaaaatcggcgcggt

SEQ ID NO: 39863 - DNA, 20 bp, Artificial Sequence
  Synthetic
gtcgggcaagccagctttcg

SEQ ID NO: 39864 - DNA, 18 bp, Artificial Sequence
  Synthetic
atttccggcgcgcctgct

SEQ ID NO: 39865 - DNA, 22 bp, Artificial Sequence
  Synthetic
acgatttgtggaatcctgccga

SEQ ID NO: 39866 - DNA, 19 bp, Artificial Sequence
  Synthetic
tcgtcaaagccgcgtgtgg

SEQ ID NO: 39867 - DNA, 21 bp, Artificial Sequence
  Synthetic
ctcctcgtgctgctggtcatc

SEQ ID NO: 39868 - DNA, 20 bp, Artificial Sequence
  Synthetic
caaaaccacatccgccgcac

SEQ ID NO: 39869 - DNA, 18 bp, Artificial Sequence
  Synthetic
tgccgccgatgaagccct

SEQ ID NO: 39870 - DNA, 20 bp, Artificial Sequence
  Synthetic
caaagacccctacgccctgc

SEQ ID NO: 39871 - DNA, 20 bp, Artificial Sequence
  Synthetic
gagttgggcgcggttaacga

SEQ ID NO: 39872 - DNA, 19 bp, Artificial Sequence
  Synthetic
ggcaaagccgtggcacagg

SEQ ID NO: 39873 - DNA, 19 bp, Artificial Sequence
  Synthetic
gcggtgggcggcaggattt

SEQ ID NO: 39874 - DNA, 20 bp, Artificial Sequence
  Synthetic
cgataaagcccggggcgacg

SEQ ID NO: 39875 - DNA, 22 bp, Artificial Sequence
  Synthetic
ccgctgtccgccggataagttg

SEQ ID NO: 39876 - DNA, 22 bp, Artificial Sequence
  Synthetic
agggatgctgatgttggcaagg

SEQ ID NO: 39877 - DNA, 19 bp, Artificial Sequence
  Synthetic
tagctttcggtggcggcaa

SEQ ID NO: 39878 - DNA, 18 bp, Artificial Sequence
  Synthetic
ggcggcgttgcctgcaat

SEQ ID NO: 39879 - DNA, 21 bp, Artificial Sequence
  Synthetic
cttgcctgttttgcggtagcc

SEQ ID NO: 39880 - DNA, 23 bp, Artificial Sequence
  Synthetic
cgcatgttgtgagaaatgcttaa

SEQ ID NO: 39881 - DNA, 20 bp, Artificial Sequence
  Synthetic
aaacagcagcacaaccagaa

SEQ ID NO: 39882 - DNA, 21 bp, Artificial Sequence
  Synthetic
gcagaaaactggactttgcgt

SEQ ID NO: 39883 - DNA, 20 bp, Artificial Sequence
  Synthetic
cgggcccaggattaccttct

SEQ ID NO: 39884 - DNA, 21 bp, Artificial Sequence
  Synthetic
cccctagggtgttttacgagt

SEQ ID NO: 39885 - DNA, 20 bp, Artificial Sequence
  Synthetic
ggtcctttgggcattggaac

SEQ ID NO: 39886 - DNA, 25 bp, Artificial Sequence
  Synthetic
aaaattaagcattgaggacccaagt

SEQ ID NO: 39887 - DNA, 20 bp, Artificial Sequence
  Synthetic
ccgagacttgagccacacaa

SEQ ID NO: 39888 - DNA, 20 bp, Artificial Sequence
  Synthetic
gagtcccccaaaggagtgga

SEQ ID NO: 39889 - DNA, 20 bp, Artificial Sequence
  Synthetic
gggagaccgaagcgaggagg

SEQ ID NO: 39890 - DNA, 19 bp, Artificial Sequence
  Synthetic
cccaagctccttcccccca

SEQ ID NO: 39891 - DNA, 20 bp, Artificial Sequence
  Synthetic
gcgaggaggtggagatgcca

SEQ ID NO: 39892 - DNA, 22 bp, Artificial Sequence
  Synthetic
acttccatctggtccgttcggg

SEQ ID NO: 39893 - DNA, 25 bp, Artificial Sequence
  Synthetic
tgtgaaagcttgaatactactttgc

SEQ ID NO: 39894 - DNA, 22 bp, Artificial Sequence
  Synthetic
gaattgtggatgaaaagcgacg

SEQ ID NO: 39895 - DNA, 25 bp, Artificial Sequence
  Synthetic
tgaggatgaaacagataatatgcgt

SEQ ID NO: 39896 - DNA, 25 bp, Artificial Sequence
  Synthetic
agctatagtggaaaaacatacaggg

SEQ ID NO: 39897 - DNA, 25 bp, Artificial Sequence
  Synthetic
ttgcaagacataacaaatcaacaca

SEQ ID NO: 39898 - DNA, 20 bp, Artificial Sequence
  Synthetic
atggagaacctttgccagcg

SEQ ID NO: 39899 - DNA, 22 bp, Artificial Sequence
  Synthetic
atatgggacaggtgtgcaatgg

SEQ ID NO: 39900 - DNA, 20 bp, Artificial Sequence
  Synthetic
acacagcccggacagtcagt

SEQ ID NO: 39901 - DNA, 23 bp, Artificial Sequence
  Synthetic
gctttgaacttaccacatcctct

SEQ ID NO: 39902 - DNA, 20 bp, Artificial Sequence
  Synthetic
taggttgggtcaaaaggcca

SEQ ID NO: 39903 - DNA, 25 bp, Artificial Sequence
  Synthetic
ctagtgacagcaaggtatatcttcc

SEQ ID NO: 39904 - DNA, 21 bp, Artificial Sequence
  Synthetic
taatcctgacacagaacgcct

SEQ ID NO: 39905 - DNA, 22 bp, Artificial Sequence
  Synthetic
taaaggtgctgaatcaggcagg

SEQ ID NO: 39906 - DNA, 20 bp, Artificial Sequence
  Synthetic
ggactcatgacgctcgcgtg

SEQ ID NO: 39907 - DNA, 22 bp, Artificial Sequence
  Synthetic
ctcgtagaccgtagcacatgcc

SEQ ID NO: 39908 - DNA, 22 bp, Artificial Sequence
  Synthetic
tcggtgtccacctttttgtggt

SEQ ID NO: 39909 - DNA, 22 bp, Artificial Sequence
  Synthetic
acggactccttcttggctgacc

SEQ ID NO: 39910 - DNA, 22 bp, Artificial Sequence
  Synthetic
aaataacacatggggttgctgc

SEQ ID NO: 39911 - DNA, 21 bp, Artificial Sequence
  Synthetic
ggttcttggttacaggttccg

SEQ ID NO: 39912 - DNA, 20 bp, Artificial Sequence
  Synthetic
gcgtctcggaaagtgtcatg

SEQ ID NO: 39913 - DNA, 21 bp, Artificial Sequence
  Synthetic
taccgcaccttttacgctgca

SEQ ID NO: 39914 - DNA, 22 bp, Artificial Sequence
  Synthetic
gggagaccaaggggtatctggt

SEQ ID NO: 39915 - DNA, 22 bp, Artificial Sequence
  Synthetic
tcttggtcctaaatcccagtgt

SEQ ID NO: 39916 - DNA, 23 bp, Artificial Sequence
  Synthetic
ttaaccgatgaaggcactatccc

SEQ ID NO: 39917 - DNA, 21 bp, Artificial Sequence
  Synthetic
aggagcaaatttggacgagtg

SEQ ID NO: 39918 - DNA, 20 bp, Artificial Sequence
  Synthetic
gcaggagttgtgggcgtctt

SEQ ID NO: 39919 - DNA, 20 bp, Artificial Sequence
  Synthetic
ggagcgggtgagtgtaaccc

SEQ ID NO: 39920 - DNA, 25 bp, Artificial Sequence
  Synthetic
gtttcctcaaacaaagatcattggt

SEQ ID NO: 39921 - DNA, 22 bp, Artificial Sequence
  Synthetic
attgaggctttctcggtggtgc

SEQ ID NO: 39922 - DNA, 22 bp, Artificial Sequence
  Synthetic
aaccaagtgatgctgtgtgaac

SEQ ID NO: 39923 - DNA, 22 bp, Artificial Sequence
  Synthetic
gagaaccttatgtgtcatgcga

SEQ ID NO: 39924 - DNA, 20 bp, Artificial Sequence
  Synthetic
gcagagacaactggaaaggc

SEQ ID NO: 39925 - DNA, 20 bp, Artificial Sequence
  Synthetic
gcgagaagttacgctcagga

SEQ ID NO: 39926 - DNA, 21 bp, Artificial Sequence
  Synthetic
gtgcagagagtgtacaccaag

SEQ ID NO: 39927 - DNA, 22 bp, Artificial Sequence
  Synthetic
ttctgtgttccaaaggacgtcg

SEQ ID NO: 39928 - DNA, 20 bp, Artificial Sequence
  Synthetic
acagtaaggttacggccgat

SEQ ID NO: 39929 - DNA, 21 bp, Artificial Sequence
  Synthetic
gcaggagctgatgaaacagtt

SEQ ID NO: 39930 - DNA, 22 bp, Artificial Sequence
  Synthetic
acaaaggcaaaatgtcagcatg

SEQ ID NO: 39931 - DNA, 20 bp, Artificial Sequence
  Synthetic
tgggctccaatgctatggaa

SEQ ID NO: 39932 - DNA, 19 bp, Artificial Sequence
  Synthetic
agatttgggcgtgcccccg

SEQ ID NO: 39933 - DNA, 19 bp, Artificial Sequence
  Synthetic
gtgcgcgcgactcggaaga

SEQ ID NO: 39934 - DNA, 22 bp, Artificial Sequence
  Synthetic
gcccttcttcggagagccgttg

SEQ ID NO: 39935 - DNA, 22 bp, Artificial Sequence
  Synthetic
accagtttctttaaccccgggc

SEQ ID NO: 39936 - DNA, 20 bp, Artificial Sequence
  Synthetic
actatcccccacgaccgtgc

SEQ ID NO: 39937 - DNA, 20 bp, Artificial Sequence
  Synthetic
gcttccgcaagcacccagac

SEQ ID NO: 39938 - DNA, 19 bp, Artificial Sequence
  Synthetic
aggttggtccctggggcca

SEQ ID NO: 39939 - DNA, 20 bp, Artificial Sequence
  Synthetic
catgcctcttccaccctgcc

SEQ ID NO: 39940 - DNA, 20 bp, Artificial Sequence
  Synthetic
ccaaaggcccggtagtgcag

SEQ ID NO: 39941 - DNA, 19 bp, Artificial Sequence
  Synthetic
cgaaggcgctcgagttcgt

SEQ ID NO: 39942 - DNA, 20 bp, Artificial Sequence
  Synthetic
catacccgcgacaggagacg

SEQ ID NO: 39943 - DNA, 21 bp, Artificial Sequence
  Synthetic
gagaccgtccggcattttcga

SEQ ID NO: 39944 - DNA, 22 bp, Artificial Sequence
  Synthetic
tcacactgacacaccccatcac

SEQ ID NO: 39945 - DNA, 19 bp, Artificial Sequence
  Synthetic
tcacagatcgcgccaccca

SEQ ID NO: 39946 - DNA, 20 bp, Artificial Sequence
  Synthetic
cgcggggatggagtgaactc

SEQ ID NO: 39947 - DNA, 22 bp, Artificial Sequence
  Synthetic
accctgtaaccccctcctaagg

SEQ ID NO: 39948 - DNA, 22 bp, Artificial Sequence
  Synthetic
aagcacatagagggtgtgtggc

SEQ ID NO: 39949 - DNA, 21 bp, Artificial Sequence
  Synthetic
gatgaagcgagcctgagagcc

SEQ ID NO: 39950 - DNA, 21 bp, Artificial Sequence
  Synthetic
cagactgcttacggtttcgtc

SEQ ID NO: 39951 - DNA, 22 bp, Artificial Sequence
  Synthetic
atgtggagaccttgaatgagga

SEQ ID NO: 39952 - DNA, 20 bp, Artificial Sequence
  Synthetic
caggctgctggtgttatcag

SEQ ID NO: 39953 - DNA, 24 bp, Artificial Sequence
  Synthetic
ggactttaccgtcagtgtatacgt

SEQ ID NO: 39954 - DNA, 21 bp, Artificial Sequence
  Synthetic
cttaaaagggggtgcaccaat

SEQ ID NO: 39955 - DNA, 25 bp, Artificial Sequence
  Synthetic
ggtacagaggatgattatcaaggtc

SEQ ID NO: 39956 - DNA, 20 bp, Artificial Sequence
  Synthetic
aggtgcactcaacaaggcaa

SEQ ID NO: 39957 - DNA, 24 bp, Artificial Sequence
  Synthetic
tattgcagtcaatgacaaagctct

SEQ ID NO: 39958 - DNA, 22 bp, Artificial Sequence
  Synthetic
aataccctccaaaaaggctggt

SEQ ID NO: 39959 - DNA, 22 bp, Artificial Sequence
  Synthetic
agaaacagtttctttggctggc

SEQ ID NO: 39960 - DNA, 23 bp, Artificial Sequence
  Synthetic
acatgtctgctttaaaccacaca

SEQ ID NO: 39961 - DNA, 23 bp, Artificial Sequence
  Synthetic
tcaagcctgtgtcgtataaactc

SEQ ID NO: 39962 - DNA, 23 bp, Artificial Sequence
  Synthetic
actcccttgattcttatccagct

SEQ ID NO: 39963 - DNA, 20 bp, Artificial Sequence
  Synthetic
atggttgcacctcttcgact

SEQ ID NO: 39964 - DNA, 22 bp, Artificial Sequence
  Synthetic
cgcttcacctctactttgacaa

SEQ ID NO: 39965 - DNA, 20 bp, Artificial Sequence
  Synthetic
ggcaaagttgaagggtgcat

SEQ ID NO: 39966 - DNA, 24 bp, Artificial Sequence
  Synthetic
gttctagcatgctacaatggttca

SEQ ID NO: 39967 - DNA, 21 bp, Artificial Sequence
  Synthetic
tcaaacaggaattgccgtctt

SEQ ID NO: 39968 - DNA, 25 bp, Artificial Sequence
  Synthetic
tactcttggtattatggcaattgct

SEQ ID NO: 39969 - DNA, 22 bp, Artificial Sequence
  Synthetic
gtgctactcttcaggctattgc

SEQ ID NO: 39970 - DNA, 22 bp, Artificial Sequence
  Synthetic
cggaatgtggaaaggttatggc

SEQ ID NO: 39971 - DNA, 22 bp, Artificial Sequence
  Synthetic
acgatttcggtgatttcgtaca

SEQ ID NO: 39972 - DNA, 20 bp, Artificial Sequence
  Synthetic
catgtgtggcggctcactat

SEQ ID NO: 39973 - DNA, 24 bp, Artificial Sequence
  Synthetic
catgcaaaagtactctacactcca

SEQ ID NO: 39974 - DNA, 23 bp, Artificial Sequence
  Synthetic
tattggcgatcctgctcaattac

SEQ ID NO: 39975 - DNA, 24 bp, Artificial Sequence
  Synthetic
agaatttcttacacgcaatcctgc

SEQ ID NO: 39976 - DNA, 25 bp, Artificial Sequence
  Synthetic
tgtaactggactttttaaggactgt

SEQ ID NO: 39977 - DNA, 22 bp, Artificial Sequence
  Synthetic
agagatgctgtgggtactaacc

SEQ ID NO: 39978 - DNA, 22 bp, Artificial Sequence
  Synthetic
tgaaagaacgtgttgtctgtgt

SEQ ID NO: 39979 - DNA, 24 bp, Artificial Sequence
  Synthetic
tggaaatccaaaggctatcaagtg

SEQ ID NO: 39980 - DNA, 23 bp, Artificial Sequence
  Synthetic
ctccagctttcgataaaagtgca

SEQ ID NO: 39981 - DNA, 20 bp, Artificial Sequence
  Synthetic
cgaagcacctgtttccatca

SEQ ID NO: 39982 - DNA, 24 bp, Artificial Sequence
  Synthetic
ctacccaaaactacaagcaagtca

SEQ ID NO: 39983 - DNA, 24 bp, Artificial Sequence
  Synthetic
ccttttcgcttgatgtttcagaaa

SEQ ID NO: 39984 - DNA, 24 bp, Artificial Sequence
  Synthetic
agatgatgtaagacaaatagcgcc

SEQ ID NO: 39985 - DNA, 22 bp, Artificial Sequence
  Synthetic
ttggctaccaaccttacagagt

SEQ ID NO: 39986 - DNA, 24 bp, Artificial Sequence
  Synthetic
caattcatgcagatcaactcacac

SEQ ID NO: 39987 - DNA, 25 bp, Artificial Sequence
  Synthetic
cagaagttcaatggacttacagtgt

SEQ ID NO: 39988 - DNA, 21 bp, Artificial Sequence
  Synthetic
caggagaggaacttcaccaca

SEQ ID NO: 39989 - DNA, 20 bp, Artificial Sequence
  Synthetic
gcaggtatggaggcgcaatt

SEQ ID NO: 39990 - DNA, 20 bp, Artificial Sequence
  Synthetic
cgcttcgattgtgtgcgtac

SEQ ID NO: 39991 - DNA, 20 bp, Artificial Sequence
  Synthetic
ttgtggccagtaacacttgc

SEQ ID NO: 39992 - DNA, 22 bp, Artificial Sequence
  Synthetic
acaaattaggagcgtcgcagcg

SEQ ID NO: 39993 - DNA, 24 bp, Artificial Sequence
  Synthetic
actactaaaagaaccttgcccatc

SEQ ID NO: 39994 - DNA, 25 bp, Artificial Sequence
  Synthetic
ctaggggtaatacttatagcactgc

SEQ ID NO: 39995 - DNA, 21 bp, Artificial Sequence
  Synthetic
actgcgtcttggttcacagct

SEQ ID NO: 39996 - DNA, 20 bp, Artificial Sequence
  Synthetic
cgccaaaaacgtactgccac

SEQ ID NO: 39997 - DNA, 21 bp, Artificial Sequence
  Synthetic
attcccaccaacagagcctaa

SEQ ID NO: 39998 - DNA, 24 bp, Artificial Sequence
  Synthetic
gaaagagccaccacattttcatcg

SEQ ID NO: 39999 - DNA, 22 bp, Artificial Sequence
  Synthetic
ctgtcaaaggtcaagcacttct

SEQ ID NO: 40000 - DNA, 22 bp, Artificial Sequence
  Synthetic
gtgtgctcagtgtgcttcctcc

SEQ ID NO: 40001 - DNA, 23 bp, Artificial Sequence
  Synthetic
attcagtgagcaatggatctagc

SEQ ID NO: 40002 - DNA, 24 bp, Artificial Sequence
  Synthetic
aggagattccactataacatccca

SEQ ID NO: 40003 - DNA, 24 bp, Artificial Sequence
  Synthetic
tgggcaattcttaacaactgatga

SEQ ID NO: 40004 - DNA, 23 bp, Artificial Sequence
  Synthetic
ttgcaagctattacacacactgg

SEQ ID NO: 40005 - DNA, 24 bp, Artificial Sequence
  Synthetic
atatccaacctagcacatctgtgt

SEQ ID NO: 40006 - DNA, 21 bp, Artificial Sequence
  Synthetic
agaaggacaaccataccccag

SEQ ID NO: 40007 - DNA, 25 bp, Artificial Sequence
  Synthetic
ttactgccaccacaaagataggtat

SEQ ID NO: 40008 - DNA, 25 bp, Artificial Sequence
  Synthetic
gctccagagagaagagtagttactc

SEQ ID NO: 40009 - DNA, 23 bp, Artificial Sequence
  Synthetic
accctgaagtattctggtcaact

SEQ ID NO: 40010 - DNA, 21 bp, Artificial Sequence
  Synthetic
ctacctttcctgtggctgaga

SEQ ID NO: 40011 - DNA, 21 bp, Artificial Sequence
  Synthetic
tcagttgctgctgtctgatct

SEQ ID NO: 40012 - DNA, 20 bp, Artificial Sequence
  Synthetic
cacctcacagaccaccgaac

SEQ ID NO: 40013 - DNA, 23 bp, Artificial Sequence
  Synthetic
cgccttgttcagtttgaatctga

SEQ ID NO: 40014 - DNA, 25 bp, Artificial Sequence
  Synthetic
ggtgttgatacagcttcaaatacca

SEQ ID NO: 40015 - DNA, 20 bp, Artificial Sequence
  Synthetic
gaggttggaagaggaggtcc

SEQ ID NO: 40016 - DNA, 24 bp, Artificial Sequence
  Synthetic
acctattccagatgtagaaggtgt

SEQ ID NO: 40017 - DNA, 22 bp, Artificial Sequence
  Synthetic
accttctgacattggagatgct

SEQ ID NO: 40018 - DNA, 24 bp, Artificial Sequence
  Synthetic
tgaatgagacacaacaagttcagt

SEQ ID NO: 40019 - DNA, 21 bp, Artificial Sequence
  Synthetic
attgtcgcctgatgatgaacc

SEQ ID NO: 40020 - DNA, 21 bp, Artificial Sequence
  Synthetic
aaggcgactctcaaagatccc

SEQ ID NO: 40021 - DNA, 24 bp, Artificial Sequence
  Synthetic
cccgcctagtaacttttgaatttg

SEQ ID NO: 40022 - DNA, 23 bp, Artificial Sequence
  Synthetic
actgagatcagagcatctgttgg

SEQ ID NO: 40023 - DNA, 21 bp, Artificial Sequence
  Synthetic
gcgaacaatggagaagatgca

SEQ ID NO: 40024 - DNA, 22 bp, Artificial Sequence
  Synthetic
caagtcctgcttgcctgcttgt

SEQ ID NO: 40025 - DNA, 23 bp, Artificial Sequence
  Synthetic
attcaagcgcaagttggaaaatt

SEQ ID NO: 40026 - DNA, 25 bp, Artificial Sequence
  Synthetic
tgatgagtcgttatgattttgagcg

SEQ ID NO: 40027 - DNA, 20 bp, Artificial Sequence
  Synthetic
ggttccagatgagcgtctgc

SEQ ID NO: 40028 - DNA, 20 bp, Artificial Sequence
  Synthetic
catgtcatcttggggcttgg

SEQ ID NO: 40029 - DNA, 23 bp, Artificial Sequence
  Synthetic
cattttggatgttcggtcagttg

SEQ ID NO: 40030 - DNA, 25 bp, Artificial Sequence
  Synthetic
tgtcgatatcagcaatagtagcatc

SEQ ID NO: 40031 - DNA, 25 bp, Artificial Sequence
  Synthetic
ttagcattttcaaaaaagcgttcgc

SEQ ID NO: 40032 - DNA, 24 bp, Artificial Sequence
  Synthetic
gctggtaatgcttcaggaatcaat

SEQ ID NO: 40033 - DNA, 25 bp, Artificial Sequence
  Synthetic
atctgtaatgatgctggttttgttg

SEQ ID NO: 40034 - DNA, 25 bp, Artificial Sequence
  Synthetic
ttgtaatatccatgacatcttcggc

SEQ ID NO: 40035 - DNA, 20 bp, Artificial Sequence
  Synthetic
aaaagaccatccacgccttc

SEQ ID NO: 40036 - DNA, 25 bp, Artificial Sequence
  Synthetic
ttccgcctattttttcagctaaagc

SEQ ID NO: 40037 - DNA, 23 bp, Artificial Sequence
  Synthetic
cagttaccgaatactcttcaccg

SEQ ID NO: 40038 - DNA, 20 bp, Artificial Sequence
  Synthetic
gagcgtcattccaagcacaa

SEQ ID NO: 40039 - DNA, 20 bp, Artificial Sequence
  Synthetic
gcagcaactgttcaggaagc

SEQ ID NO: 40040 - DNA, 22 bp, Artificial Sequence
  Synthetic
gtggcgattttagcagatttgg

SEQ ID NO: 40041 - DNA, 21 bp, Artificial Sequence
  Synthetic
gttcctatggcaccacctgcg

SEQ ID NO: 40042 - DNA, 24 bp, Artificial Sequence
  Synthetic
cttcaaagaagaagtggcttctgc

SEQ ID NO: 40043 - DNA, 24 bp, Artificial Sequence
  Synthetic
tattgttggtactggtttagctgg

SEQ ID NO: 40044 - DNA, 20 bp, Artificial Sequence
  Synthetic
gtgtggatgatgacggccag

SEQ ID NO: 40045 - DNA, 21 bp, Artificial Sequence
  Synthetic
ctgctgaaagctggtttgtgt

SEQ ID NO: 40046 - DNA, 25 bp, Artificial Sequence
  Synthetic
gaaatcacagaagaatggttgtacc

SEQ ID NO: 40047 - DNA, 22 bp, Artificial Sequence
  Synthetic
ctggtccagctgtttttctagc

SEQ ID NO: 40048 - DNA, 22 bp, Artificial Sequence
  Synthetic
tattgcaagaactctaggcggt

SEQ ID NO: 40049 - DNA, 21 bp, Artificial Sequence
  Synthetic
tggcgttgggcaaaaaaactc

SEQ ID NO: 40050 - DNA, 24 bp, Artificial Sequence
  Synthetic
ttgatcttgagctttcaccaatga

SEQ ID NO: 40051 - DNA, 25 bp, Artificial Sequence
  Synthetic
aatgaactaaaagcaggacaagtct

SEQ ID NO: 40052 - DNA, 22 bp, Artificial Sequence
  Synthetic
gagaagtggtcaaactttcccg

SEQ ID NO: 40053 - DNA, 21 bp, Artificial Sequence
  Synthetic
aagcaccctaatcacgctttg

SEQ ID NO: 40054 - DNA, 21 bp, Artificial Sequence
  Synthetic
ttatcagatgaccgagggcat

SEQ ID NO: 40055 - DNA, 21 bp, Artificial Sequence
  Synthetic
atttcgggctacatttcccca

SEQ ID NO: 40056 - DNA, 20 bp, Artificial Sequence
  Synthetic
agaaaagccctttgtacgcc

SEQ ID NO: 40057 - DNA, 22 bp, Artificial Sequence
  Synthetic
ctttttagggcgtgattgtcgc

SEQ ID NO: 40058 - DNA, 23 bp, Artificial Sequence
  Synthetic
aaaatggtcgcccagatttacca

SEQ ID NO: 40059 - DNA, 20 bp, Artificial Sequence
  Synthetic
gggtttacgtgaccaccgtg

SEQ ID NO: 40060 - DNA, 23 bp, Artificial Sequence
  Synthetic
tacttgctacatgacatggcaaa

SEQ ID NO: 40061 - DNA, 22 bp, Artificial Sequence
  Synthetic
gagatgtttttgggactgggaa

SEQ ID NO: 40062 - DNA, 25 bp, Artificial Sequence
  Synthetic
aaagccaggtagtaaaaccattacc

SEQ ID NO: 40063 - DNA, 20 bp, Artificial Sequence
  Synthetic
caacacgtccaggttgccaa

SEQ ID NO: 40064 - DNA, 24 bp, Artificial Sequence
  Synthetic
aaaatcgtattagaaggttgccgt

SEQ ID NO: 40065 - DNA, 20 bp, Artificial Sequence
  Synthetic
ttgaagccatcaaagtggcc

SEQ ID NO: 40066 - DNA, 22 bp, Artificial Sequence
  Synthetic
tcgttgcttatgccaacaaaga

SEQ ID NO: 40067 - DNA, 23 bp, Artificial Sequence
  Synthetic
tggtagggaagacagaatctcaa

SEQ ID NO: 40068 - DNA, 24 bp, Artificial Sequence
  Synthetic
aagcacattattttggaccgttcc

SEQ ID NO: 40069 - DNA, 22 bp, Artificial Sequence
  Synthetic
aatcattggcagagcaccaaga

SEQ ID NO: 40070 - DNA, 25 bp, Artificial Sequence
  Synthetic
aacaatcgatttaaccatcccattg

SEQ ID NO: 40071 - DNA, 23 bp, Artificial Sequence
  Synthetic
tcctgattgaacttgagacaacc

SEQ ID NO: 40072 - DNA, 20 bp, Artificial Sequence
  Synthetic
atagcatcagggtccttgcg

SEQ ID NO: 40073 - DNA, 20 bp, Artificial Sequence
  Synthetic
aatgacctcggcgaacaaca

SEQ ID NO: 40074 - DNA, 23 bp, Artificial Sequence
  Synthetic
tatcgtattcgtcaacccaatcc

SEQ ID NO: 40075 - DNA, 20 bp, Artificial Sequence
  Synthetic
aggttctaccatccatgcgt

SEQ ID NO: 40076 - DNA, 21 bp, Artificial Sequence
  Synthetic
cttcatcaataggctgcggag

SEQ ID NO: 40077 - DNA, 23 bp, Artificial Sequence
  Synthetic
tgctatttctccatgctgttcaa

SEQ ID NO: 40078 - DNA, 25 bp, Artificial Sequence
  Synthetic
aatagccataaagtcataacgctca

SEQ ID NO: 40079 - DNA, 21 bp, Artificial Sequence
  Synthetic
tcaagaacaaagccttgcgat

SEQ ID NO: 40080 - DNA, 25 bp, Artificial Sequence
  Synthetic
cctctggtaataggtctttagcttc

SEQ ID NO: 40081 - DNA, 20 bp, Artificial Sequence
  Synthetic
tggttttttcgtccgccagt

SEQ ID NO: 40082 - DNA, 20 bp, Artificial Sequence
  Synthetic
tgccaaggccgattctgaag

SEQ ID NO: 40083 - DNA, 20 bp, Artificial Sequence
  Synthetic
tgttcgattggaaggccgtg

SEQ ID NO: 40084 - DNA, 23 bp, Artificial Sequence
  Synthetic
ataacgaaaaaagcctcgtctca

SEQ ID NO: 40085 - DNA, 22 bp, Artificial Sequence
  Synthetic
agagtcaagttggtaagcctct

SEQ ID NO: 40086 - DNA, 25 bp, Artificial Sequence
  Synthetic
attatagataatgggcacgagtgga

SEQ ID NO: 40087 - DNA, 23 bp, Artificial Sequence
  Synthetic
ggtgtatctcctaggctatcgtc

SEQ ID NO: 40088 - DNA, 22 bp, Artificial Sequence
  Synthetic
acggatagggaccgaactgtct

SEQ ID NO: 40089 - DNA, 22 bp, Artificial Sequence
  Synthetic
agttacggggtcattttgccga

SEQ ID NO: 40090 - DNA, 20 bp, Artificial Sequence
  Synthetic
ctactgcgtccctccatcac

SEQ ID NO: 40091 - DNA, 20 bp, Artificial Sequence
  Synthetic
tcagcgtctttcatcatgcg

SEQ ID NO: 40092 - DNA, 24 bp, Artificial Sequence
  Synthetic
ggagttttcgtacgttctacaagg

SEQ ID NO: 40093 - DNA, 25 bp, Artificial Sequence
  Synthetic
atatcccttttgaaagacttctgca

SEQ ID NO: 40094 - DNA, 20 bp, Artificial Sequence
  Synthetic
tcttcactagagcgacgctg

SEQ ID NO: 40095 - DNA, 20 bp, Artificial Sequence
  Synthetic
agtccaaacccacggtaagg

SEQ ID NO: 40096 - DNA, 24 bp, Artificial Sequence
  Synthetic
tatcagattcatgcaatcgaagcc

SEQ ID NO: 40097 - DNA, 23 bp, Artificial Sequence
  Synthetic
gaagccattcatgataaagcggt

SEQ ID NO: 40098 - DNA, 25 bp, Artificial Sequence
  Synthetic
agatgacaaaatctaaacagcctca

SEQ ID NO: 40099 - DNA, 24 bp, Artificial Sequence
  Synthetic
tgatcaattgattcagttgcagga

SEQ ID NO: 40100 - DNA, 21 bp, Artificial Sequence
  Synthetic
aggacaagcgtacattgaggt

SEQ ID NO: 40101 - DNA, 20 bp, Artificial Sequence
  Synthetic
ccccttgagatgtccatggt

SEQ ID NO: 40102 - DNA, 23 bp, Artificial Sequence
  Synthetic
atcaggctctcctttttaacgtg

SEQ ID NO: 40103 - DNA, 20 bp, Artificial Sequence
  Synthetic
tggtttctgtcgtccctgtt

SEQ ID NO: 40104 - DNA, 25 bp, Artificial Sequence
  Synthetic
ttaggatctaaagcaacactagctg

SEQ ID NO: 40105 - DNA, 22 bp, Artificial Sequence
  Synthetic
tctttccttttgcacgcgtggg

SEQ ID NO: 40106 - DNA, 20 bp, Artificial Sequence
  Synthetic
gcccatgcctcccctttgag

SEQ ID NO: 40107 - DNA, 22 bp, Artificial Sequence
  Synthetic
ccctacacctgttacgtaccgc

SEQ ID NO: 40108 - DNA, 20 bp, Artificial Sequence
  Synthetic
gcgtgtgcggcgcgttttac

SEQ ID NO: 40109 - DNA, 21 bp, Artificial Sequence
  Synthetic
atgttgggctacagcactccc

SEQ ID NO: 40110 - DNA, 22 bp, Artificial Sequence
  Synthetic
atttgttggcggccgattaccc

SEQ ID NO: 40111 - DNA, 19 bp, Artificial Sequence
  Synthetic
cgccctgccctgctttgga

SEQ ID NO: 40112 - DNA, 20 bp, Artificial Sequence
  Synthetic
agcttgcggggtcgatggaa

SEQ ID NO: 40113 - DNA, 22 bp, Artificial Sequence
  Synthetic
gggtcacccctgatgttgtcag

SEQ ID NO: 40114 - DNA, 20 bp, Artificial Sequence
  Synthetic
gatcgctgagggccgtatgg

SEQ ID NO: 40115 - DNA, 20 bp, Artificial Sequence
  Synthetic
ccgtgttaaccggttccgca

SEQ ID NO: 40116 - DNA, 20 bp, Artificial Sequence
  Synthetic
gttcccacccggcatactgg

SEQ ID NO: 40117 - DNA, 24 bp, Artificial Sequence
  Synthetic
gcatgggatggttacttatcttct

SEQ ID NO: 40118 - DNA, 25 bp, Artificial Sequence
  Synthetic
ggtatgtttggtctttacgatgaca

SEQ ID NO: 40119 - DNA, 25 bp, Artificial Sequence
  Synthetic
tcgttttatggttgatcctacaact

SEQ ID NO: 40120 - DNA, 20 bp, Artificial Sequence
  Synthetic
cactgctggtgtttgcatca

SEQ ID NO: 40121 - DNA, 24 bp, Artificial Sequence
  Synthetic
aatgaaaatctcttgcatggaggc

SEQ ID NO: 40122 - DNA, 22 bp, Artificial Sequence
  Synthetic
ggttttgaaaaggcagcacttt

SEQ ID NO: 40123 - DNA, 23 bp, Artificial Sequence
  Synthetic
agacataaattgcgttcacgtgt

SEQ ID NO: 40124 - DNA, 23 bp, Artificial Sequence
  Synthetic
agcgtattaatgttgttcctggt

SEQ ID NO: 40125 - DNA, 21 bp, Artificial Sequence
  Synthetic
gtcggtgttacaatgcatggt

SEQ ID NO: 40126 - DNA, 25 bp, Artificial Sequence
  Synthetic
attgtgaacgtgttgttaaacttca

SEQ ID NO: 40127 - DNA, 25 bp, Artificial Sequence
  Synthetic
cccttccttgataatagcttcttcc

SEQ ID NO: 40128 - DNA, 20 bp, Artificial Sequence
  Synthetic
aggatcttgtcagctggtgt

SEQ ID NO: 40129 - DNA, 22 bp, Artificial Sequence
  Synthetic
ttgtggtgattgtctgcgtaag

SEQ ID NO: 40130 - DNA, 25 bp, Artificial Sequence
  Synthetic
tctgtaacattcatagaaacgagca

SEQ ID NO: 40131 - DNA, 21 bp, Artificial Sequence
  Synthetic
cagttgcagtctgctgaatgg

SEQ ID NO: 40132 - DNA, 20 bp, Artificial Sequence
  Synthetic
ggctaccacccgatgcaata

SEQ ID NO: 40133 - DNA, 25 bp, Artificial Sequence
  Synthetic
ttggttttgtgctaatcagagtaca

SEQ ID NO: 40134 - DNA, 20 bp, Artificial Sequence
  Synthetic
gccaccgttactgtgaatgt

SEQ ID NO: 40135 - DNA, 23 bp, Artificial Sequence
  Synthetic
tatggcctgtacctggtcttaaa

SEQ ID NO: 40136 - DNA, 22 bp, Artificial Sequence
  Synthetic
cactgtgcgtgaaattgttgtt

SEQ ID NO: 40137 - DNA, 25 bp, Artificial Sequence
  Synthetic
atgaccgctgttaatgagtctagat

SEQ ID NO: 40138 - DNA, 25 bp, Artificial Sequence
  Synthetic
agttgacagattaattactggacgg

SEQ ID NO: 40139 - DNA, 21 bp, Artificial Sequence
  Synthetic
agggtcatgtttcaacctcgc

SEQ ID NO: 40140 - DNA, 24 bp, Artificial Sequence
  Synthetic
tttggttagttctgataaggcacc

SEQ ID NO: 40141 - DNA, 21 bp, Artificial Sequence
  Synthetic
aactccgttgtgttacatgca

SEQ ID NO: 40142 - DNA, 22 bp, Artificial Sequence
  Synthetic
gtttggggtgtccgtgaaaatt

SEQ ID NO: 40143 - DNA, 21 bp, Artificial Sequence
  Synthetic
aggcagttccatctttagcgt

SEQ ID NO: 40144 - DNA, 22 bp, Artificial Sequence
  Synthetic
tcagtgtctgtgtttttgggac

SEQ ID NO: 40145 - DNA, 22 bp, Artificial Sequence
  Synthetic
agtttttttgggaggtttgggc

SEQ ID NO: 40146 - DNA, 25 bp, Artificial Sequence
  Synthetic
tttctgacataccaaacattgttgc

SEQ ID NO: 40147 - DNA, 25 bp, Artificial Sequence
  Synthetic
catcttctgttgtacaagaaacagc

SEQ ID NO: 40148 - DNA, 21 bp, Artificial Sequence
  Synthetic
aaccagggggacggttaaggg

SEQ ID NO: 40149 - DNA, 21 bp, Artificial Sequence
  Synthetic
tgagacagcagaggatgactt

SEQ ID NO: 40150 - DNA, 24 bp, Artificial Sequence
  Synthetic
cggacatcctttgtttgagatctc

SEQ ID NO: 40151 - DNA, 20 bp, Artificial Sequence
  Synthetic
acaaatgttcctcgtcggct

SEQ ID NO: 40152 - DNA, 25 bp, Artificial Sequence
  Synthetic
tgctggttttattaataattgcgct

SEQ ID NO: 40153 - DNA, 23 bp, Artificial Sequence
  Synthetic
atttgctgccaaacttatctggt

SEQ ID NO: 40154 - DNA, 22 bp, Artificial Sequence
  Synthetic
cttggagagtgaacaacagctt

SEQ ID NO: 40155 - DNA, 24 bp, Artificial Sequence
  Synthetic
caggtagaaactgaatgcaactcg

SEQ ID NO: 40156 - DNA, 25 bp, Artificial Sequence
  Synthetic
acagtttgatttgtcagaaatggtg

SEQ ID NO: 40157 - DNA, 24 bp, Artificial Sequence
  Synthetic
gttaggagacttggtatgcaaaca

SEQ ID NO: 40158 - DNA, 22 bp, Artificial Sequence
  Synthetic
attcctgtaggagaaggtggtg

SEQ ID NO: 40159 - DNA, 22 bp, Artificial Sequence
  Synthetic
actgcggctgtattacatgttg

SEQ ID NO: 40160 - DNA, 22 bp, Artificial Sequence
  Synthetic
caagtacacctgtttctaggcc

SEQ ID NO: 40161 - DNA, 22 bp, Artificial Sequence
  Synthetic
tgctcaaattttcaacaggccg

SEQ ID NO: 40162 - DNA, 21 bp, Artificial Sequence
  Synthetic
cctttttggcagcatcgtttg

SEQ ID NO: 40163 - DNA, 24 bp, Artificial Sequence
  Synthetic
tgaaaggttttcatggcaaagagc

SEQ ID NO: 40164 - DNA, 25 bp, Artificial Sequence
  Synthetic
caaatgtccaaattacgattggacc

SEQ ID NO: 40165 - DNA, 23 bp, Artificial Sequence
  Synthetic
ttatcaccagaagagggagacaa

SEQ ID NO: 40166 - DNA, 20 bp, Artificial Sequence
  Synthetic
ggctacgggtgaaacctctt

SEQ ID NO: 40167 - DNA, 22 bp, Artificial Sequence
  Synthetic
ttccaacaggggggattgatct

SEQ ID NO: 40168 - DNA, 25 bp, Artificial Sequence
  Synthetic
cctgagacatttcctgaattgaaac

SEQ ID NO: 40169 - DNA, 25 bp, Artificial Sequence
  Synthetic
ttacaggagcaactgatgtagatgg

SEQ ID NO: 40170 - DNA, 21 bp, Artificial Sequence
  Synthetic
cttgaaatggatgctggggtt

SEQ ID NO: 40171 - DNA, 25 bp, Artificial Sequence
  Synthetic
gatgtccaatgagattaaacatggc

SEQ ID NO: 40172 - DNA, 20 bp, Artificial Sequence
  Synthetic
gctcgttggaggatggtttg

SEQ ID NO: 40173 - DNA, 22 bp, Artificial Sequence
  Synthetic
ggttatgaatgccttgggagtg

SEQ ID NO: 40174 - DNA, 20 bp, Artificial Sequence
  Synthetic
atgtgccggattatgcctcc

SEQ ID NO: 40175 - DNA, 25 bp, Artificial Sequence
  Synthetic
caaatgcaattctgaatgcatcact

SEQ ID NO: 40176 - DNA, 21 bp, Artificial Sequence
  Synthetic
ttggtacggtttcaggcatca

SEQ ID NO: 40177 - DNA, 24 bp, Artificial Sequence
  Synthetic
tttttgctttgtgttgctttgttg

SEQ ID NO: 40178 - DNA, 25 bp, Artificial Sequence
  Synthetic
ttgttgtattgttgttagatgccag

SEQ ID NO: 40179 - DNA, 22 bp, Artificial Sequence
  Synthetic
agagcagtcagaaaacctgtca

SEQ ID NO: 40180 - DNA, 23 bp, Artificial Sequence
  Synthetic
gccgcaacacaaatgtaaaaagc

SEQ ID NO: 40181 - DNA, 20 bp, Artificial Sequence
  Synthetic
ctcgcatgctgcttagcttt

SEQ ID NO: 40182 - DNA, 20 bp, Artificial Sequence
  Synthetic
gctgcgttttttggtgggtt

SEQ ID NO: 40183 - DNA, 21 bp, Artificial Sequence
  Synthetic
acctgatttgttgccaggaga

SEQ ID NO: 40184 - DNA, 23 bp, Artificial Sequence
  Synthetic
ccattgaattgcaactgttaggg

SEQ ID NO: 40185 - DNA, 22 bp, Artificial Sequence
  Synthetic
taccaccatcaacaccagttgc

SEQ ID NO: 40186 - DNA, 25 bp, Artificial Sequence
  Synthetic
atgtcagtggtaaatcctgataggg

SEQ ID NO: 40187 - DNA, 23 bp, Artificial Sequence
  Synthetic
gagcgtgtccacctctagaatta

SEQ ID NO: 40188 - DNA, 22 bp, Artificial Sequence
  Synthetic
agagaaccttatgtgtcatgcg

SEQ ID NO: 40189 - DNA, 25 bp, Artificial Sequence
  Synthetic
atgaaactttcaaagtcattggtgg

SEQ ID NO: 40190 - DNA, 22 bp, Artificial Sequence
  Synthetic
tctcagctggctgacaggatcg

SEQ ID NO: 40191 - DNA, 18 bp, Artificial Sequence
  Synthetic
ctggagacgcgggcgaaa

SEQ ID NO: 40192 - DNA, 19 bp, Artificial Sequence
  Synthetic
ccgtcctggcggttgacgt

SEQ ID NO: 40193 - DNA, 19 bp, Artificial Sequence
  Synthetic
cgcaccccctcgttgcgaa

SEQ ID NO: 40194 - DNA, 21 bp, Artificial Sequence
  Synthetic
cgacgccgtgacgtatgaaga

SEQ ID NO: 40195 - DNA, 22 bp, Artificial Sequence
  Synthetic
aaatccgttccatcgaccattt

SEQ ID NO: 40196 - DNA, 20 bp, Artificial Sequence
  Synthetic
agcatcgacttttcggccaa

SEQ ID NO: 40197 - DNA, 23 bp, Artificial Sequence
  Synthetic
acaacgacatatggaagagcaaa

SEQ ID NO: 40198 - DNA, 22 bp, Artificial Sequence
  Synthetic
cctatatcgcaacatcaccgtc

SEQ ID NO: 40199 - DNA, 20 bp, Artificial Sequence
  Synthetic
gtgtctgtgtcgatgcttgg

SEQ ID NO: 40200 - DNA, 22 bp, Artificial Sequence
  Synthetic
tttctacaatggctcgagttcg

SEQ ID NO: 40201 - DNA, 20 bp, Artificial Sequence
  Synthetic
gttcatccgcccgtaactga

SEQ ID NO: 40202 - DNA, 20 bp, Artificial Sequence
  Synthetic
gtgattggaaaccgtcgctt

SEQ ID NO: 40203 - DNA, 20 bp, Artificial Sequence
  Synthetic
ggattacgttcgctgcaacg

SEQ ID NO: 40204 - DNA, 24 bp, Artificial Sequence
  Synthetic
gtccatgagattttcaatccggag

SEQ ID NO: 40205 - DNA, 21 bp, Artificial Sequence
  Synthetic
gatgaaactgtcgaatgccca

SEQ ID NO: 40206 - DNA, 20 bp, Artificial Sequence
  Synthetic
aaccagtatcttgcggcatg

SEQ ID NO: 40207 - DNA, 21 bp, Artificial Sequence
  Synthetic
aggaactcatgttgcctctgg

SEQ ID NO: 40208 - DNA, 20 bp, Artificial Sequence
  Synthetic
gtttgctttcctgcacgaga

SEQ ID NO: 40209 - DNA, 19 bp, Artificial Sequence
  Synthetic
cggccgccgacgaacacaa

SEQ ID NO: 40210 - DNA, 22 bp, Artificial Sequence
  Synthetic
ggacctctgttagcgttctggc

SEQ ID NO: 40211 - DNA, 23 bp, Artificial Sequence
  Synthetic
tatgcaaactaagaggggtagcc

SEQ ID NO: 40212 - DNA, 22 bp, Artificial Sequence
  Synthetic
gcaattgagctcagtgtcatca

SEQ ID NO: 40213 - DNA, 24 bp, Artificial Sequence
  Synthetic
ggtcatcaagatacagcaagaagt

SEQ ID NO: 40214 - DNA, 20 bp, Artificial Sequence
  Synthetic
caggatatgcagccgacctg

SEQ ID NO: 40215 - DNA, 21 bp, Artificial Sequence
  Synthetic
ctctgttctgccacgacgtgt

SEQ ID NO: 40216 - DNA, 18 bp, Artificial Sequence
  Synthetic
tcctcgagtgacgccgga

SEQ ID NO: 40217 - DNA, 19 bp, Artificial Sequence
  Synthetic
gcggacgacttggagctgc

SEQ ID NO: 40218 - DNA, 19 bp, Artificial Sequence
  Synthetic
ggtccacacgccagtctgc

SEQ ID NO: 40219 - DNA, 19 bp, Artificial Sequence
  Synthetic
cccccactcgaatcgcgca

SEQ ID NO: 40220 - DNA, 21 bp, Artificial Sequence
  Synthetic
actcaaagaaagctccgcgcg

SEQ ID NO: 40221 - DNA, 19 bp, Artificial Sequence
  Synthetic
gcgagacggtacagcgcgt

SEQ ID NO: 40222 - DNA, 19 bp, Artificial Sequence
  Synthetic
cgagcatgtcggaggtggc

SEQ ID NO: 40223 - DNA, 20 bp, Artificial Sequence
  Synthetic
ctccgcgcatgtgatgatgt

SEQ ID NO: 40224 - DNA, 22 bp, Artificial Sequence
  Synthetic
ccatcagaatcgtcagtggatg

SEQ ID NO: 40225 - DNA, 21 bp, Artificial Sequence
  Synthetic
cgatcccatattgtccagcac

SEQ ID NO: 40226 - DNA, 21 bp, Artificial Sequence
  Synthetic
ttccgccaacaaatacagtgt

SEQ ID NO: 40227 - DNA, 22 bp, Artificial Sequence
  Synthetic
agcaaacctgtatctctcttgc

SEQ ID NO: 40228 - DNA, 22 bp, Artificial Sequence
  Synthetic
atagctgcatgaaggttccatg

SEQ ID NO: 40229 - DNA, 22 bp, Artificial Sequence
  Synthetic
atcgcgacaagttgctaagaat

SEQ ID NO: 40230 - DNA, 20 bp, Artificial Sequence
  Synthetic
cggtgccatgtttctgtgaa

SEQ ID NO: 40231 - DNA, 20 bp, Artificial Sequence
  Synthetic
agagcgttttcggaactgtc

SEQ ID NO: 40232 - DNA, 25 bp, Artificial Sequence
  Synthetic
ggtatagtccggataatttcatggc

SEQ ID NO: 40233 - DNA, 21 bp, Artificial Sequence
  Synthetic
gggtctctgttctgccacgac

SEQ ID NO: 40234 - DNA, 19 bp, Artificial Sequence
  Synthetic
tccctgggcacggtccaca

SEQ ID NO: 40235 - DNA, 19 bp, Artificial Sequence
  Synthetic
gcgctgtcggttccgcaca

SEQ ID NO: 40236 - DNA, 21 bp, Artificial Sequence
  Synthetic
ggaagacctagagctgccgga

SEQ ID NO: 40237 - DNA, 24 bp, Artificial Sequence
  Synthetic
aatctcactcagttattctgctgg

SEQ ID NO: 40238 - DNA, 22 bp, Artificial Sequence
  Synthetic
aaggaagaggcaacacccttgg

SEQ ID NO: 40239 - DNA, 25 bp, Artificial Sequence
  Synthetic
actgaaagcgaacttcagtgtaatc

SEQ ID NO: 40240 - DNA, 20 bp, Artificial Sequence
  Synthetic
cggctccacagctagaactt

SEQ ID NO: 40241 - DNA, 21 bp, Artificial Sequence
  Synthetic
atgccacaaaccattgtctcc

SEQ ID NO: 40242 - DNA, 23 bp, Artificial Sequence
  Synthetic
ggatggtttttagttgaggctgt

SEQ ID NO: 40243 - DNA, 25 bp, Artificial Sequence
  Synthetic
ggatttaaatgctaaactgtgtggt

SEQ ID NO: 40244 - DNA, 24 bp, Artificial Sequence
  Synthetic
aatgcagcagcgtttttaaaaagt

SEQ ID NO: 40245 - DNA, 23 bp, Artificial Sequence
  Synthetic
gcttgcagaaccaaagaaatgtt

SEQ ID NO: 40246 - DNA, 24 bp, Artificial Sequence
  Synthetic
agcaacaacaaaatcaggaacagt

SEQ ID NO: 40247 - DNA, 20 bp, Artificial Sequence
  Synthetic
ttgtgcagcctattccacct

SEQ ID NO: 40248 - DNA, 23 bp, Artificial Sequence
  Synthetic
tgtgaataaaccattgctggagc

SEQ ID NO: 40249 - DNA, 23 bp, Artificial Sequence
  Synthetic
gttgacaccagaggaaaaacagt

SEQ ID NO: 40250 - DNA, 20 bp, Artificial Sequence
  Synthetic
agtagaccatctgcaggagc

SEQ ID NO: 40251 - DNA, 21 bp, Artificial Sequence
  Synthetic
ggaagctgtaaaacgaaggct

SEQ ID NO: 40252 - DNA, 21 bp, Artificial Sequence
  Synthetic
aaaacgatggagacgctatgc

SEQ ID NO: 40253 - DNA, 23 bp, Artificial Sequence
  Synthetic
ccaaatatgggtgtaaaggcaca

SEQ ID NO: 40254 - DNA, 22 bp, Artificial Sequence
  Synthetic
accacagccagagagtcctacg

SEQ ID NO: 40255 - DNA, 22 bp, Artificial Sequence
  Synthetic
tttgtctgctttaatgtgccgc

SEQ ID NO: 40256 - DNA, 25 bp, Artificial Sequence
  Synthetic
ggaaatacctatgcaaacatttgct

SEQ ID NO: 40257 - DNA, 22 bp, Artificial Sequence
  Synthetic
tgcctttacaacacgtagaggt

SEQ ID NO: 40258 - DNA, 22 bp, Artificial Sequence
  Synthetic
cctattttcttgcagatggcgg

SEQ ID NO: 40259 - DNA, 23 bp, Artificial Sequence
  Synthetic
ataacctgtcaaaaggatcagcc

SEQ ID NO: 40260 - DNA, 24 bp, Artificial Sequence
  Synthetic
tgcaaacatctgcactttagtgtt

SEQ ID NO: 40261 - DNA, 22 bp, Artificial Sequence
  Synthetic
aaggtcaagcacttctgtttcc

SEQ ID NO: 40262 - DNA, 22 bp, Artificial Sequence
  Synthetic
tgaagccaaagatcggacaggg

SEQ ID NO: 40263 - DNA, 25 bp, Artificial Sequence
  Synthetic
taaccagaggagattcaacaatcac

SEQ ID NO: 40264 - DNA, 25 bp, Artificial Sequence
  Synthetic
tgactactgatgatatgcaatcacc

SEQ ID NO: 40265 - DNA, 25 bp, Artificial Sequence
  Synthetic
taccatttcttagcattgcatcagc

SEQ ID NO: 40266 - DNA, 20 bp, Artificial Sequence
  Synthetic
acacatgttgggagaggctt

SEQ ID NO: 40267 - DNA, 25 bp, Artificial Sequence
  Synthetic
ttccaaggaccaatttctttagacg

SEQ ID NO: 40268 - DNA, 22 bp, Artificial Sequence
  Synthetic
cacaaccgtttttgtttctggc

SEQ ID NO: 40269 - DNA, 20 bp, Artificial Sequence
  Synthetic
ctggtgactgtcctcctgat

SEQ ID NO: 40270 - DNA, 20 bp, Artificial Sequence
  Synthetic
gcaaccaattccacccccaa

SEQ ID NO: 40271 - DNA, 21 bp, Artificial Sequence
  Synthetic
ggactgatacgagtcagcaga

SEQ ID NO: 40272 - DNA, 22 bp, Artificial Sequence
  Synthetic
cgtaaacgtaaacgctcagaca

SEQ ID NO: 40273 - DNA, 23 bp, Artificial Sequence
  Synthetic
aattccactgaaggtcaactgtt

SEQ ID NO: 40274 - DNA, 22 bp, Artificial Sequence
  Synthetic
cacaggtcagcaagcaaaatgt

SEQ ID NO: 40275 - DNA, 25 bp, Artificial Sequence
  Synthetic
aaacttgaggacaaacaattccagc

SEQ ID NO: 40276 - DNA, 20 bp, Artificial Sequence
  Synthetic
gtgctttgggcgctatggaa

SEQ ID NO: 40277 - DNA, 22 bp, Artificial Sequence
  Synthetic
ccaacaacacaggtttggtaca

SEQ ID NO: 40278 - DNA, 25 bp, Artificial Sequence
  Synthetic
ctttgtccatacagccactatgatt

SEQ ID NO: 40279 - DNA, 21 bp, Artificial Sequence
  Synthetic
attacccacagcacatccagt

SEQ ID NO: 40280 - DNA, 21 bp, Artificial Sequence
  Synthetic
aattgacagatgtgagtgccc

SEQ ID NO: 40281 - DNA, 25 bp, Artificial Sequence
  Synthetic
ctggttgaagaaattcactgaatgc

SEQ ID NO: 40282 - DNA, 20 bp, Artificial Sequence
  Synthetic
caaagcacttcagccctgtg

SEQ ID NO: 40283 - DNA, 21 bp, Artificial Sequence
  Synthetic
caagaccagggctacatctca

SEQ ID NO: 40284 - DNA, 22 bp, Artificial Sequence
  Synthetic
gccccagagaaaattaaggctg

SEQ ID NO: 40285 - DNA, 23 bp, Artificial Sequence
  Synthetic
ttacaccaattatgatggcagct

SEQ ID NO: 40286 - DNA, 20 bp, Artificial Sequence
  Synthetic
tccaaagaacacgcaggacc

SEQ ID NO: 40287 - DNA, 24 bp, Artificial Sequence
  Synthetic
tgtttcagaactggggaattgaac

SEQ ID NO: 40288 - DNA, 21 bp, Artificial Sequence
  Synthetic
gccacgcccggatatgaggta

SEQ ID NO: 40289 - DNA, 25 bp, Artificial Sequence
  Synthetic
agggtatttaaaccagttaagtccg

SEQ ID NO: 40290 - DNA, 23 bp, Artificial Sequence
  Synthetic
cgaagctgtacctacttcagttt

SEQ ID NO: 40291 - DNA, 20 bp, Artificial Sequence
  Synthetic
gaacggggcagaggtggaca

SEQ ID NO: 40292 - DNA, 21 bp, Artificial Sequence
  Synthetic
tgcttttgcctggtgaagggc

SEQ ID NO: 40293 - DNA, 22 bp, Artificial Sequence
  Synthetic
gacgagctcgtcgcttgacagc

SEQ ID NO: 40294 - DNA, 20 bp, Artificial Sequence
  Synthetic
gcatggcctcgtgttctggg

SEQ ID NO: 40295 - DNA, 22 bp, Artificial Sequence
  Synthetic
cgtgcacttggggaacttgtca

SEQ ID NO: 40296 - DNA, 21 bp, Artificial Sequence
  Synthetic
tgacgggttgcaggtggtagt

SEQ ID NO: 40297 - DNA, 18 bp, Artificial Sequence
  Synthetic
actcgggggcaaaggcgt

SEQ ID NO: 40298 - DNA, 19 bp, Artificial Sequence
  Synthetic
acgtgcgaggggtagcggt

SEQ ID NO: 40299 - DNA, 19 bp, Artificial Sequence
  Synthetic
tgaccaggtccacgctggt

SEQ ID NO: 40300 - DNA, 22 bp, Artificial Sequence
  Synthetic
aagaaggcggggccaagattgg

SEQ ID NO: 40301 - DNA, 21 bp, Artificial Sequence
  Synthetic
cgaaggaccccatccaggtgt

SEQ ID NO: 40302 - DNA, 22 bp, Artificial Sequence
  Synthetic
tgttcgcctgcgtaggacttac

SEQ ID NO: 40303 - DNA, 21 bp, Artificial Sequence
  Synthetic
ttaagggtggtggcgatgtgc

SEQ ID NO: 40304 - DNA, 20 bp, Artificial Sequence
  Synthetic
gctcgatcatttccccgcgg

SEQ ID NO: 40305 - DNA, 19 bp, Artificial Sequence
  Synthetic
gcctgttgcacgcgggtga

SEQ ID NO: 40306 - DNA, 19 bp, Artificial Sequence
  Synthetic
atccaggtaatgccggcgg

SEQ ID NO: 40307 - DNA, 21 bp, Artificial Sequence
  Synthetic
ggtattggcactcccgtctcg

SEQ ID NO: 40308 - DNA, 19 bp, Artificial Sequence
  Synthetic
ccctgggcctgatgcacct

SEQ ID NO: 40309 - DNA, 19 bp, Artificial Sequence
  Synthetic
tgagcgacgacctgggcgt

SEQ ID NO: 40310 - DNA, 19 bp, Artificial Sequence
  Synthetic
ccagccgtccggtctagca

SEQ ID NO: 40311 - DNA, 18 bp, Artificial Sequence
  Synthetic
ttgacgcccaactcgcgg

SEQ ID NO: 40312 - DNA, 22 bp, Artificial Sequence
  Synthetic
atatgtgcagcagagcgtaggg

SEQ ID NO: 40313 - DNA, 20 bp, Artificial Sequence
  Synthetic
cgagtacgacatgcccgacc

SEQ ID NO: 40314 - DNA, 19 bp, Artificial Sequence
  Synthetic
ggactcggccgacgatagc

SEQ ID NO: 40315 - DNA, 18 bp, Artificial Sequence
  Synthetic
cgccgagctcatgccctt

SEQ ID NO: 40316 - DNA, 19 bp, Artificial Sequence
  Synthetic
ccgtggacgcggtcattga

SEQ ID NO: 40317 - DNA, 22 bp, Artificial Sequence
  Synthetic
ttaaggtgcgccccattaagca

SEQ ID NO: 40318 - DNA, 20 bp, Artificial Sequence
  Synthetic
gccaaccggctgatgcccaa

SEQ ID NO: 40319 - DNA, 21 bp, Artificial Sequence
  Synthetic
cagtgtctggagcgggcttaa

SEQ ID NO: 40320 - DNA, 20 bp, Artificial Sequence
  Synthetic
ccctgcaggtagacgagccg

SEQ ID NO: 40321 - DNA, 22 bp, Artificial Sequence
  Synthetic
gggcctgggagtgaaaagtctg

SEQ ID NO: 40322 - DNA, 22 bp, Artificial Sequence
  Synthetic
cagtgtgaacctctacgccacc

SEQ ID NO: 40323 - DNA, 22 bp, Artificial Sequence
  Synthetic
tcccctacccgcttattggaga

SEQ ID NO: 40324 - DNA, 19 bp, Artificial Sequence
  Synthetic
atgagcggctccagcgaac

SEQ ID NO: 40325 - DNA, 20 bp, Artificial Sequence
  Synthetic
cagcgccctggccttatcgc

SEQ ID NO: 40326 - DNA, 20 bp, Artificial Sequence
  Synthetic
gctctaccgcttccttgcgc

SEQ ID NO: 40327 - DNA, 19 bp, Artificial Sequence
  Synthetic
ctcatctgcagggcgccca

SEQ ID NO: 40328 - DNA, 19 bp, Artificial Sequence
  Synthetic
cgtggtcccacagggcact

SEQ ID NO: 40329 - DNA, 19 bp, Artificial Sequence
  Synthetic
ctttcggcgcttggtgggc

SEQ ID NO: 40330 - DNA, 21 bp, Artificial Sequence
  Synthetic
ctggagcatggctacctggga

SEQ ID NO: 40331 - DNA, 20 bp, Artificial Sequence
  Synthetic
ccgttaacctcccgcccaag

SEQ ID NO: 40332 - DNA, 21 bp, Artificial Sequence
  Synthetic
tcctgcctggggatcctacac

SEQ ID NO: 40333 - DNA, 22 bp, Artificial Sequence
  Synthetic
gtttttcccgaacgcctaaggc

SEQ ID NO: 40334 - DNA, 19 bp, Artificial Sequence
  Synthetic
taagcaccagcggcagggc

SEQ ID NO: 40335 - DNA, 21 bp, Artificial Sequence
  Synthetic
tcacccgcagttgcttgtacc

SEQ ID NO: 40336 - DNA, 22 bp, Artificial Sequence
  Synthetic
ttcgacgcagttagagaagcgg

SEQ ID NO: 40337 - DNA, 24 bp, Artificial Sequence
  Synthetic
gaacagccacgatgtaacattacc

SEQ ID NO: 40338 - DNA, 22 bp, Artificial Sequence
  Synthetic
tggtttttaaagtgcaagccca

SEQ ID NO: 40339 - DNA, 25 bp, Artificial Sequence
  Synthetic
gaatcaaaaattccctcagctactg

SEQ ID NO: 40340 - DNA, 21 bp, Artificial Sequence
  Synthetic
taggagacccatctacaggcc

SEQ ID NO: 40341 - DNA, 25 bp, Artificial Sequence
  Synthetic
catacacactacaaaacagttcacc

SEQ ID NO: 40342 - DNA, 21 bp, Artificial Sequence
  Synthetic
aggtgggctaactttgcaaga

SEQ ID NO: 40343 - DNA, 22 bp, Artificial Sequence
  Synthetic
aatccacacagtttcctggcga

SEQ ID NO: 40344 - DNA, 21 bp, Artificial Sequence
  Synthetic
cgtgaccatcgtaccaaatgc

SEQ ID NO: 40345 - DNA, 22 bp, Artificial Sequence
  Synthetic
taaaaccagcagcacatggtaa

SEQ ID NO: 40346 - DNA, 22 bp, Artificial Sequence
  Synthetic
ttccaaacggtctcgaaggacg

SEQ ID NO: 40347 - DNA, 21 bp, Artificial Sequence
  Synthetic
cgccccctccactttcataat

SEQ ID NO: 40348 - DNA, 22 bp, Artificial Sequence
  Synthetic
ccacaatgtggtagcttacacc

SEQ ID NO: 40349 - DNA, 22 bp, Artificial Sequence
  Synthetic
cgccaaaaaaaaacacacacgc

SEQ ID NO: 40350 - DNA, 22 bp, Artificial Sequence
  Synthetic
cctggtcaaagaagtaccgttt

SEQ ID NO: 40351 - DNA, 24 bp, Artificial Sequence
  Synthetic
taaagccataacaagtagtgctgg

SEQ ID NO: 40352 - DNA, 21 bp, Artificial Sequence
  Synthetic
atcactcgatcagcaaccaca

SEQ ID NO: 40353 - DNA, 25 bp, Artificial Sequence
  Synthetic
catcgacaacccaaaagaaaacaag

SEQ ID NO: 40354 - DNA, 21 bp, Artificial Sequence
  Synthetic
gcgaggaactagtccaaaccc

SEQ ID NO: 40355 - DNA, 24 bp, Artificial Sequence
  Synthetic
ttctacaaaggaacaaaagacggc

SEQ ID NO: 40356 - DNA, 25 bp, Artificial Sequence
  Synthetic
aacaagatacacaacaaacaatgca

SEQ ID NO: 40357 - DNA, 22 bp, Artificial Sequence
  Synthetic
atggaagctctaggaggtcaag

SEQ ID NO: 40358 - DNA, 20 bp, Artificial Sequence
  Synthetic
tagggcaggagtatcaacgg

SEQ ID NO: 40359 - DNA, 22 bp, Artificial Sequence
  Synthetic
ccacagctgctcaaataactgc

SEQ ID NO: 40360 - DNA, 25 bp, Artificial Sequence
  Synthetic
tggaaaaatacatggttaccctctt

SEQ ID NO: 40361 - DNA, 25 bp, Artificial Sequence
  Synthetic
ctttctggatccaccacaatttcag

SEQ ID NO: 40362 - DNA, 21 bp, Artificial Sequence
  Synthetic
ttgcccactgtgaatgagact

SEQ ID NO: 40363 - DNA, 25 bp, Artificial Sequence
  Synthetic
atcaacaaccccatgaccattaaat

SEQ ID NO: 40364 - DNA, 23 bp, Artificial Sequence
  Synthetic
atttcccaatcttggtgaggatg

SEQ ID NO: 40365 - DNA, 20 bp, Artificial Sequence
  Synthetic
agttgcagctctagcagact

SEQ ID NO: 40366 - DNA, 25 bp, Artificial Sequence
  Synthetic
aagtactgtccaatgcattatcaca

SEQ ID NO: 40367 - DNA, 23 bp, Artificial Sequence
  Synthetic
gcaatgctgtcttgttatgatgc

SEQ ID NO: 40368 - DNA, 22 bp, Artificial Sequence
  Synthetic
attgaacagaaatcagccggct

SEQ ID NO: 40369 - DNA, 23 bp, Artificial Sequence
  Synthetic
ataccagcagaaatgctagcaag

SEQ ID NO: 40370 - DNA, 24 bp, Artificial Sequence
  Synthetic
atgataaataatgaccttgggcca

SEQ ID NO: 40371 - DNA, 21 bp, Artificial Sequence
  Synthetic
aatttccagcatggtggaggc

SEQ ID NO: 40372 - DNA, 25 bp, Artificial Sequence
  Synthetic
ttaaggctgacatgtgtattttgca

SEQ ID NO: 40373 - DNA, 22 bp, Artificial Sequence
  Synthetic
cagggtggttactacctgtggc

SEQ ID NO: 40374 - DNA, 22 bp, Artificial Sequence
  Synthetic
gggtaatatgtgcgtttggtgt

SEQ ID NO: 40375 - DNA, 25 bp, Artificial Sequence
  Synthetic
gtgcgcactatattggtatagaaca

SEQ ID NO: 40376 - DNA, 20 bp, Artificial Sequence
  Synthetic
tccagtacccctaccgctgg

SEQ ID NO: 40377 - DNA, 22 bp, Artificial Sequence
  Synthetic
tttttcagatggctttgtggcg

SEQ ID NO: 40378 - DNA, 21 bp, Artificial Sequence
  Synthetic
gctcgccactttttcaatcgc

SEQ ID NO: 40379 - DNA, 23 bp, Artificial Sequence
  Synthetic
cacccgcagtactaatttaacca

SEQ ID NO: 40380 - DNA, 20 bp, Artificial Sequence
  Synthetic
ccttgtgcatgtgctgtttg

SEQ ID NO: 40381 - DNA, 22 bp, Artificial Sequence
  Synthetic
tttgtgttgccgaccgttttcg

SEQ ID NO: 40382 - DNA, 20 bp, Artificial Sequence
  Synthetic
ttgctggtttggcattgctt

SEQ ID NO: 40383 - DNA, 20 bp, Artificial Sequence
  Synthetic
ggtctgaaccaacggcaaca

SEQ ID NO: 40384 - DNA, 21 bp, Artificial Sequence
  Synthetic
cacccatacagcagctacttg

SEQ ID NO: 40385 - DNA, 19 bp, Artificial Sequence
  Synthetic
gacagcgggaaccccacgt

SEQ ID NO: 40386 - DNA, 19 bp, Artificial Sequence
  Synthetic
acgccccagccgtcaatca

SEQ ID NO: 40387 - DNA, 22 bp, Artificial Sequence
  Synthetic
cggatggaaaacatatcgcacg

SEQ ID NO: 40388 - DNA, 22 bp, Artificial Sequence
  Synthetic
gggttgcagacaaaagtgattg

SEQ ID NO: 40389 - DNA, 21 bp, Artificial Sequence
  Synthetic
gttgttggatgctctgcgtgc

SEQ ID NO: 40390 - DNA, 21 bp, Artificial Sequence
  Synthetic
tccgtgctccttcattgtcgg

SEQ ID NO: 40391 - DNA, 21 bp, Artificial Sequence
  Synthetic
taccgggacagcctctggatg

SEQ ID NO: 40392 - DNA, 21 bp, Artificial Sequence
  Synthetic
ttaacctcggcctcggttgga

SEQ ID NO: 40393 - DNA, 22 bp, Artificial Sequence
  Synthetic
gcagggactcaagaggacccca

SEQ ID NO: 40394 - DNA, 22 bp, Artificial Sequence
  Synthetic
ctgaagggccatgccacctatg

SEQ ID NO: 40395 - DNA, 22 bp, Artificial Sequence
  Synthetic
ggcataccacgtgtgtgatggg

SEQ ID NO: 40396 - DNA, 19 bp, Artificial Sequence
  Synthetic
gcaaggcgggccagaggtt

SEQ ID NO: 40397 - DNA, 21 bp, Artificial Sequence
  Synthetic
attgcgcaacatggtaaggcg

SEQ ID NO: 40398 - DNA, 19 bp, Artificial Sequence
  Synthetic
cgcggtcgggggttctgat

SEQ ID NO: 40399 - DNA, 19 bp, Artificial Sequence
  Synthetic
ccggaggggagttgcctgt

SEQ ID NO: 40400 - DNA, 20 bp, Artificial Sequence
  Synthetic
gcggtcatgacggagaccaa

SEQ ID NO: 40401 - DNA, 21 bp, Artificial Sequence
  Synthetic
gggatacacccgctcactcgc

SEQ ID NO: 40402 - DNA, 21 bp, Artificial Sequence
  Synthetic
ccaactggtgtgagaggggga

SEQ ID NO: 40403 - DNA, 19 bp, Artificial Sequence
  Synthetic
ccagcccccacacatcacc

SEQ ID NO: 40404 - DNA, 19 bp, Artificial Sequence
  Synthetic
tcaggatcccgccggagat

SEQ ID NO: 40405 - DNA, 19 bp, Artificial Sequence
  Synthetic
cgccggacagctcctcgat

SEQ ID NO: 40406 - DNA, 20 bp, Artificial Sequence
  Synthetic
ggagcgggtgaaggaatggg

SEQ ID NO: 40407 - DNA, 19 bp, Artificial Sequence
  Synthetic
agtgccccaggggtctctg

SEQ ID NO: 40408 - DNA, 21 bp, Artificial Sequence
  Synthetic
ccagctggtaaacaccaccga

SEQ ID NO: 40409 - DNA, 21 bp, Artificial Sequence
  Synthetic
ctcctgtaggaggccggcttg

SEQ ID NO: 40410 - DNA, 22 bp, Artificial Sequence
  Synthetic
tgaaaccggtatgtccaggggt

SEQ ID NO: 40411 - DNA, 22 bp, Artificial Sequence
  Synthetic
agaggttagggtaggtgtccgg

SEQ ID NO: 40412 - DNA, 20 bp, Artificial Sequence
  Synthetic
ctgtgtatggtgcaaacggc

SEQ ID NO: 40413 - DNA, 22 bp, Artificial Sequence
  Synthetic
actgcgcctagcgttatggagg

SEQ ID NO: 40414 - DNA, 20 bp, Artificial Sequence
  Synthetic
cgtcaagggggagacggaga

SEQ ID NO: 40415 - DNA, 22 bp, Artificial Sequence
  Synthetic
ggacatagcatggaagacgaac

SEQ ID NO: 40416 - DNA, 21 bp, Artificial Sequence
  Synthetic
cagcaggctgacagtgtttac

SEQ ID NO: 40417 - DNA, 22 bp, Artificial Sequence
  Synthetic
tcgcagcctcagcagaatcaac

SEQ ID NO: 40418 - DNA, 22 bp, Artificial Sequence
  Synthetic
caggtaccagtgtgcaggtcag

SEQ ID NO: 40419 - DNA, 21 bp, Artificial Sequence
  Synthetic
cctcgcggttcactctctctg

SEQ ID NO: 40420 - DNA, 22 bp, Artificial Sequence
  Synthetic
tgtgtattaccatggtggcagt

SEQ ID NO: 40421 - DNA, 25 bp, Artificial Sequence
  Synthetic
agagccttatggtgattctatgttc

SEQ ID NO: 40422 - DNA, 20 bp, Artificial Sequence
  Synthetic
ggaacttcggtgtaccccct

SEQ ID NO: 40423 - DNA, 20 bp, Artificial Sequence
  Synthetic
gttttcggttgcgtgcagtt

SEQ ID NO: 40424 - DNA, 25 bp, Artificial Sequence
  Synthetic
gttgcaaagtaaaaatagacgtgct

SEQ ID NO: 40425 - DNA, 22 bp, Artificial Sequence
  Synthetic
tcctcatcaacacccagaggga

SEQ ID NO: 40426 - DNA, 20 bp, Artificial Sequence
  Synthetic
ggattggtgggagtacaggc

SEQ ID NO: 40427 - DNA, 21 bp, Artificial Sequence
  Synthetic
aatgcaggcagacctagcata

SEQ ID NO: 40428 - DNA, 23 bp, Artificial Sequence
  Synthetic
gtgccacttgaaattacagcatc

SEQ ID NO: 40429 - DNA, 23 bp, Artificial Sequence
  Synthetic
ctttggatgttagccattcaggt

SEQ ID NO: 40430 - DNA, 25 bp, Artificial Sequence
  Synthetic
gatttccctggctttgtataacagt

SEQ ID NO: 40431 - DNA, 24 bp, Artificial Sequence
  Synthetic
taatggcgcgagttttgaaaatgg

SEQ ID NO: 40432 - DNA, 23 bp, Artificial Sequence
  Synthetic
gtaaaggtactggtggttctacg

SEQ ID NO: 40433 - DNA, 20 bp, Artificial Sequence
  Synthetic
gataacaacccccgcagttt

SEQ ID NO: 40434 - DNA, 21 bp, Artificial Sequence
  Synthetic
accttttgttgcttgtggacc

SEQ ID NO: 40435 - DNA, 21 bp, Artificial Sequence
  Synthetic
ggttcgccagcaataaaacca

SEQ ID NO: 40436 - DNA, 25 bp, Artificial Sequence
  Synthetic
tcaaagaatggcatctaagattgga

SEQ ID NO: 40437 - DNA, 22 bp, Artificial Sequence
  Synthetic
ctcaggacaattgctatgggac

SEQ ID NO: 40438 - DNA, 20 bp, Artificial Sequence
  Synthetic
tctaacagctgaagcgccag

SEQ ID NO: 40439 - DNA, 22 bp, Artificial Sequence
  Synthetic
gcggacgataaaggtactgatc

SEQ ID NO: 40440 - DNA, 23 bp, Artificial Sequence
  Synthetic
ctcacagatgaagctgacattgc

SEQ ID NO: 40441 - DNA, 20 bp, Artificial Sequence
  Synthetic
agacgaggcagacaatggag

SEQ ID NO: 40442 - DNA, 23 bp, Artificial Sequence
  Synthetic
caaacaagctattggcatgatgc

SEQ ID NO: 40443 - DNA, 20 bp, Artificial Sequence
  Synthetic
ccaccaccttcagcaccacc

SEQ ID NO: 40444 - DNA, 21 bp, Artificial Sequence
  Synthetic
acgctctagtaccccactacg

SEQ ID NO: 40445 - DNA, 21 bp, Artificial Sequence
  Synthetic
gcccaaaatactcttggcagc

SEQ ID NO: 40446 - DNA, 20 bp, Artificial Sequence
  Synthetic
gattgcagcgcagatcgttt

SEQ ID NO: 40447 - DNA, 24 bp, Artificial Sequence
  Synthetic
gttactagctcttccaggaagtct

SEQ ID NO: 40448 - DNA, 21 bp, Artificial Sequence
  Synthetic
tctagggcatcacacacagat

SEQ ID NO: 40449 - DNA, 24 bp, Artificial Sequence
  Synthetic
cgctttatagtacatccagacaca

SEQ ID NO: 40450 - DNA, 20 bp, Artificial Sequence
  Synthetic
actgtccattgtgtgccctc

SEQ ID NO: 40451 - DNA, 20 bp, Artificial Sequence
  Synthetic
ggcgccgctattaatgacat

SEQ ID NO: 40452 - DNA, 25 bp, Artificial Sequence
  Synthetic
ttgataatgaatggactgaggaagc

SEQ ID NO: 40453 - DNA, 20 bp, Artificial Sequence
  Synthetic
cgacttggaaggcttgaagc

SEQ ID NO: 40454 - DNA, 20 bp, Artificial Sequence
  Synthetic
acagatgaaggcacaactgc

SEQ ID NO: 40455 - DNA, 21 bp, Artificial Sequence
  Synthetic
gtcgcgtgcagtacagtagac

SEQ ID NO: 40456 - DNA, 21 bp, Artificial Sequence
  Synthetic
actgtagaaggtgcatgcaga

SEQ ID NO: 40457 - DNA, 20 bp, Artificial Sequence
  Synthetic
ggtgtgccagatcagctgtg

SEQ ID NO: 40458 - DNA, 24 bp, Artificial Sequence
  Synthetic
cattacggaagagcaggaaattgc

SEQ ID NO: 40459 - DNA, 20 bp, Artificial Sequence
  Synthetic
ggaggacttcaaaccgcgga

SEQ ID NO: 40460 - DNA, 22 bp, Artificial Sequence
  Synthetic
ccaaaacgaatagtggtggagg

SEQ ID NO: 40461 - DNA, 21 bp, Artificial Sequence
  Synthetic
aggaacttttacggtcgacgg

SEQ ID NO: 40462 - DNA, 21 bp, Artificial Sequence
  Synthetic
atgttgctcctgaatgtgacg

SEQ ID NO: 40463 - DNA, 23 bp, Artificial Sequence
  Synthetic
actagaaaacgtcccagaactga

SEQ ID NO: 40464 - DNA, 20 bp, Artificial Sequence
  Synthetic
gctttggaccatctgcggta

SEQ ID NO: 40465 - DNA, 22 bp, Artificial Sequence
  Synthetic
agattgtgtatctggtgtgcca

SEQ ID NO: 40466 - DNA, 20 bp, Artificial Sequence
  Synthetic
attagggcatccgtcgggaa

SEQ ID NO: 40467 - DNA, 20 bp, Artificial Sequence
  Synthetic
ctgtgcgtatggacctgcag

SEQ ID NO: 40468 - DNA, 25 bp, Artificial Sequence
  Synthetic
acatgagggcagaaatcataagaat

SEQ ID NO: 40469 - DNA, 20 bp, Artificial Sequence
  Synthetic
ccacgtactgtgcaccatct

SEQ ID NO: 40470 - DNA, 24 bp, Artificial Sequence
  Synthetic
agaggatgaggatgaagtagacaa

SEQ ID NO: 40471 - DNA, 25 bp, Artificial Sequence
  Synthetic
ttgggagacattagtaatcagcaat

SEQ ID NO: 40472 - DNA, 22 bp, Artificial Sequence
  Synthetic
taccctcagatccaacgtatcc

SEQ ID NO: 40473 - DNA, 21 bp, Artificial Sequence
  Synthetic
cctatatgtgccgcttttgct

SEQ ID NO: 40474 - DNA, 20 bp, Artificial Sequence
  Synthetic
cagacgaaaacgggcctctg

SEQ ID NO: 40475 - DNA, 23 bp, Artificial Sequence
  Synthetic
cggccatatattggttagcactc

SEQ ID NO: 40476 - DNA, 21 bp, Artificial Sequence
  Synthetic
ctttacaacacgtaggggtgg

SEQ ID NO: 40477 - DNA, 20 bp, Artificial Sequence
  Synthetic
ggcggcctagtgaaaccaag

SEQ ID NO: 40478 - DNA, 21 bp, Artificial Sequence
  Synthetic
tatagggtctttagggtccgc

SEQ ID NO: 40479 - DNA, 23 bp, Artificial Sequence
  Synthetic
gccttatgtgaagaggtcaacat

SEQ ID NO: 40480 - DNA, 22 bp, Artificial Sequence
  Synthetic
ttaacagaggacgacgacaagg

SEQ ID NO: 40481 - DNA, 20 bp, Artificial Sequence
  Synthetic
gggtttgggtattggtagcg

SEQ ID NO: 40482 - DNA, 20 bp, Artificial Sequence
  Synthetic
aatgctggggaatgtcctcc

SEQ ID NO: 40483 - DNA, 25 bp, Artificial Sequence
  Synthetic
tgacttaatgattaagggtacaggc

SEQ ID NO: 40484 - DNA, 25 bp, Artificial Sequence
  Synthetic
agcacaaaggtttaatgtgttttgg

SEQ ID NO: 40485 - DNA, 22 bp, Artificial Sequence
  Synthetic
gctctatcaaaacccaaccact

SEQ ID NO: 40486 - DNA, 22 bp, Artificial Sequence
  Synthetic
acaccaagtgtcaaactccaat

SEQ ID NO: 40487 - DNA, 20 bp, Artificial Sequence
  Synthetic
gtggatacgctgcagacaaa

SEQ ID NO: 40488 - DNA, 20 bp, Artificial Sequence
  Synthetic
agttccctagcactggcaat

SEQ ID NO: 40489 - DNA, 20 bp, Artificial Sequence
  Synthetic
gaaatcagagcatccgtcgg

SEQ ID NO: 40490 - DNA, 24 bp, Artificial Sequence
  Synthetic
gatcaatgatcggaacttctggag

SEQ ID NO: 40491 - DNA, 21 bp, Artificial Sequence
  Synthetic
ggatccagtaaaagacggctg

SEQ ID NO: 40492 - DNA, 24 bp, Artificial Sequence
  Synthetic
caggctactggggatttatgaagc

SEQ ID NO: 40493 - DNA, 20 bp, Artificial Sequence
  Synthetic
aagacgcacaggacaattgg

SEQ ID NO: 40494 - DNA, 23 bp, Artificial Sequence
  Synthetic
taaagggcctgcaaatactacca

SEQ ID NO: 40495 - DNA, 20 bp, Artificial Sequence
  Synthetic
tgttggtgagggacgggtta

SEQ ID NO: 40496 - DNA, 20 bp, Artificial Sequence
  Synthetic
tgggatgttgctcctgcatg

SEQ ID NO: 40497 - DNA, 25 bp, Artificial Sequence
  Synthetic
agttatttagtaggccctactggat

SEQ ID NO: 40498 - DNA, 22 bp, Artificial Sequence
  Synthetic
gaatgtcctctgaattaggggc

SEQ ID NO: 40499 - DNA, 24 bp, Artificial Sequence
  Synthetic
tttaggtactggctacattccaca

SEQ ID NO: 40500 - DNA, 20 bp, Human papillomavirus type 175
tagagttgacacctgttgta

SEQ ID NO: 40501 - DNA, 20 bp, Human papillomavirus type 175
acacctgttgtagtacttgt

SEQ ID NO: 40502 - DNA, 20 bp, Human papillomavirus type 175
tagtacttgtggaacaggtg

SEQ ID NO: 40503 - DNA, 20 bp, Human papillomavirus type 175
tggaacaggtgtccgtctct

SEQ ID NO: 40504 - DNA, 20 bp, Human papillomavirus type 175
tggccacaaggtcagccatc

SEQ ID NO: 40505 - DNA, 20 bp, Human papillomavirus type 175
tcctgactggattagaaagc

SEQ ID NO: 40506 - DNA, 20 bp, Human papillomavirus type 175
cctgactggattagaaagca

SEQ ID NO: 40507 - DNA, 20 bp, Human papillomavirus type 175
ctgactggattagaaagcat

SEQ ID NO: 40508 - DNA, 20 bp, Human papillomavirus type 175
gaaagcatacacaattaaat

SEQ ID NO: 40509 - DNA, 20 bp, Human papillomavirus type 175
aatcatgaaacagctgcagc

SEQ ID NO: 40510 - DNA, 20 bp, Human papillomavirus type 175
ctggttgcaaaatcttatta

SEQ ID NO: 40511 - DNA, 20 bp, Human papillomavirus type 175
tggttgcaaaatcttattaa

SEQ ID NO: 40512 - DNA, 20 bp, Human papillomavirus type 175
caaaatcttattaatacaaa

SEQ ID NO: 40513 - DNA, 20 bp, Human papillomavirus type 175
ttaatacaaaaataggtttt

SEQ ID NO: 40514 - DNA, 20 bp, Human papillomavirus type 175
atacaaaaataggttttcta

SEQ ID NO: 40515 - DNA, 20 bp, Human papillomavirus type 175
agcattggcaacttgttaga

SEQ ID NO: 40516 - DNA, 20 bp, Human papillomavirus type 175
gcaacttgttagaaaaatta

SEQ ID NO: 40517 - DNA, 20 bp, Human papillomavirus type 175
ttagaaaaattaatgtgcta

SEQ ID NO: 40518 - DNA, 20 bp, Human papillomavirus type 175
gaaaaattaatgtgctatat

SEQ ID NO: 40519 - DNA, 20 bp, Human papillomavirus type 175
atgtgctatattattatgct

SEQ ID NO: 40520 - DNA, 20 bp, Human papillomavirus type 175
ccccaccgcagagcctccca

SEQ ID NO: 40521 - DNA, 20 bp, Human papillomavirus type 175
cccaccgcagagcctcccac

SEQ ID NO: 40522 - DNA, 20 bp, Human papillomavirus type 175
cctcttcgctttcgtgggat

SEQ ID NO: 40523 - DNA, 20 bp, Human papillomavirus type 175
gctttcgtgggatcttgtat

SEQ ID NO: 40524 - DNA, 20 bp, Human papillomavirus type 175
cgtgggatcttgtatgccgc

SEQ ID NO: 40525 - DNA, 20 bp, Human papillomavirus type 175
cagcaacaggtcttacagga

SEQ ID NO: 40526 - DNA, 20 bp, Human papillomavirus type 175
caagtcctgtaagacctgtt

SEQ ID NO: 40527 - DNA, 20 bp, Human papillomavirus type 175
ctggaaccgttcgatgtccg

SEQ ID NO: 40528 - DNA, 20 bp, Human papillomavirus type 175
gatgtccgcttcccacttct

SEQ ID NO: 40529 - DNA, 20 bp, Human papillomavirus type 175
ccacttctccagcagatacc

SEQ ID NO: 40530 - DNA, 20 bp, Human papillomavirus type 175
gttatgcatcacatagaatg

SEQ ID NO: 40531 - DNA, 20 bp, Human papillomavirus type 175
tgcatcacatagaatgcttg

SEQ ID NO: 40532 - DNA, 20 bp, Human papillomavirus type 175
tagcatttcaaaatcaggct

SEQ ID NO: 40533 - DNA, 20 bp, Human papillomavirus type 175
caaaatcaggctcagagaaa

SEQ ID NO: 40534 - DNA, 20 bp, Human papillomavirus type 175
aaaatcaggctcagagaaag

SEQ ID NO: 40535 - DNA, 20 bp, Human papillomavirus type 175
aggggaacatataggcctgg

SEQ ID NO: 40536 - DNA, 20 bp, Human papillomavirus type 175
ggggaacatataggcctgga

SEQ ID NO: 40537 - DNA, 20 bp, Human papillomavirus type 175
gagactttgggaggtcctga

SEQ ID NO: 40538 - DNA, 20 bp, Human papillomavirus type 175
gggaggtcctgaaacatttg

SEQ ID NO: 40539 - DNA, 20 bp, Human papillomavirus type 175
ggaggtcctgaaacatttga

SEQ ID NO: 40540 - DNA, 20 bp, Human papillomavirus type 175
agaatttcaacaagacttgc

SEQ ID NO: 40541 - DNA, 20 bp, Human papillomavirus type 175
gaatttcaacaagacttgca

SEQ ID NO: 40542 - DNA, 20 bp, Human papillomavirus type 175
caacaagacttgcaagaggt

SEQ ID NO: 40543 - DNA, 20 bp, Human papillomavirus type 175
aacaagacttgcaagaggta

SEQ ID NO: 40544 - DNA, 20 bp, Human papillomavirus type 175
caagaggtagctgctgctcc

SEQ ID NO: 40545 - DNA, 20 bp, Human papillomavirus type 175
ttaacccacaggcagaaagt

SEQ ID NO: 40546 - DNA, 20 bp, Human papillomavirus type 175
acccacaggcagaaagtagt

SEQ ID NO: 40547 - DNA, 20 bp, Human papillomavirus type 175
tatagatgcattagctgagt

SEQ ID NO: 40548 - DNA, 20 bp, Human papillomavirus type 175
atagatgcattagctgagtc

SEQ ID NO: 40549 - DNA, 20 bp, Human papillomavirus type 175
tagatgcattagctgagtct

SEQ ID NO: 40550 - DNA, 20 bp, Human papillomavirus type 175
aggcattggattaacaggaa

SEQ ID NO: 40551 - DNA, 20 bp, Human papillomavirus type 175
ggcattggattaacaggaaa

SEQ ID NO: 40552 - DNA, 20 bp, Human papillomavirus type 175
gattaacaggaaatcctttg

SEQ ID NO: 40553 - DNA, 20 bp, Human papillomavirus type 175
acaggaaatcctttgttcaa

SEQ ID NO: 40554 - DNA, 20 bp, Human papillomavirus type 175
gttcaataaatatgctgacg

SEQ ID NO: 40555 - DNA, 20 bp, Human papillomavirus type 175
tatcactcaccagtaaataa

SEQ ID NO: 40556 - DNA, 20 bp, Human papillomavirus type 175
ctccctacacgtattttcca

SEQ ID NO: 40557 - DNA, 20 bp, Human papillomavirus type 175
tccaaccacaagcggttcct

SEQ ID NO: 40558 - DNA, 20 bp, Human papillomavirus type 175
ccaaccacaagcggttcctt

SEQ ID NO: 40559 - DNA, 20 bp, Human papillomavirus type 175
caaccacaagcggttcctta

SEQ ID NO: 40560 - DNA, 20 bp, Human papillomavirus type 175
tggactatggatctgtctga

SEQ ID NO: 40561 - DNA, 20 bp, Human papillomavirus type 175
gcattaggtaaaaagttttt

SEQ ID NO: 40562 - DNA, 20 bp, Human papillomavirus type 175
cattaggtaaaaagttttta

SEQ ID NO: 40563 - DNA, 20 bp, Human papillomavirus type 175
ggtaaaaagtttttatatca

SEQ ID NO: 40564 - DNA, 20 bp, Human papillomavirus type 175
atataaaaactttttaccta

SEQ ID NO: 40565 - DNA, 20 bp, Human papillomavirus type 175
aattgcatccttaggactta

SEQ ID NO: 40566 - DNA, 20 bp, Human papillomavirus type 175
attgcatccttaggacttag

SEQ ID NO: 40567 - DNA, 20 bp, Human papillomavirus type 175
catccttaggacttagttac

SEQ ID NO: 40568 - DNA, 20 bp, Human papillomavirus type 175
ggacttagttacagactgct

SEQ ID NO: 40569 - DNA, 20 bp, Human papillomavirus type 175
gttacagactgctgtggaca

SEQ ID NO: 40570 - DNA, 20 bp, Human papillomavirus type 163
agttcgtggtcgttggcgtg

SEQ ID NO: 40571 - DNA, 20 bp, Human papillomavirus type 175
gttcgtggtcgttggcgtgc

SEQ ID NO: 40572 - DNA, 20 bp, Human papillomavirus type 163
gtggtcgttggcgtgcttat

SEQ ID NO: 40573 - DNA, 20 bp, Human papillomavirus type 163
gcgtgcttattgcaggcatt

SEQ ID NO: 40574 - DNA, 20 bp, Human papillomavirus type 163
ttgcaggcattgtactgaaa

SEQ ID NO: 40575 - DNA, 20 bp, Human papillomavirus type 163
gaacaacttattctcgacga

SEQ ID NO: 40576 - DNA, 20 bp, Human papillomavirus type 163
ttctcgacgaaggactttct

SEQ ID NO: 40577 - DNA, 20 bp, Human papillomavirus type 163
tcgacgaaggactttctctt

SEQ ID NO: 40578 - DNA, 20 bp, Human papillomavirus type 163
ctctttgttgtccatcctgt

SEQ ID NO: 40579 - DNA, 20 bp, Human papillomavirus type 163
tctttgttgtccatcctgtg

SEQ ID NO: 40580 - DNA, 20 bp, Human papillomavirus type 163
tacaatgcacaggcaactgt

SEQ ID NO: 40581 - DNA, 20 bp, Human papillomavirus type 163
taaaagtccagaagttgcag

SEQ ID NO: 40582 - DNA, 20 bp, Human papillomavirus type 163
cagttgccgatttgagtcca

SEQ ID NO: 40583 - DNA, 20 bp, Human papillomavirus type 163
ccgatttgagtccacagttg

SEQ ID NO: 40584 - DNA, 20 bp, Human papillomavirus type 163
tggacttttagaatactttc

SEQ ID NO: 40585 - DNA, 20 bp, Human papillomavirus type 163
tataaatttactgatggtgc

SEQ ID NO: 40586 - DNA, 20 bp, Human papillomavirus type 163
actgatggtgcatggaaatc

SEQ ID NO: 40587 - DNA, 20 bp, Human papillomavirus type 163
ctgatggtgcatggaaatct

SEQ ID NO: 40588 - DNA, 20 bp, Human papillomavirus type 163
ctttagaaagcttggcgccc

SEQ ID NO: 40589 - DNA, 20 bp, Human papillomavirus type 163
tttagaaagcttggcgccca

SEQ ID NO: 40590 - DNA, 20 bp, Human papillomavirus type 163
gggagattctcccgattttt

SEQ ID NO: 40591 - DNA, 20 bp, Human papillomavirus type 163
ggagattctcccgatttttg

SEQ ID NO: 40592 - DNA, 20 bp, Human papillomavirus type 163
tcccgatttttggagtcgtc

SEQ ID NO: 40593 - DNA, 20 bp, Human papillomavirus type 163
ttggagtcgtctcctagcag

SEQ ID NO: 40594 - DNA, 20 bp, Human papillomavirus type 163
tggagtcgtctcctagcagg

SEQ ID NO: 40595 - DNA, 20 bp, Human papillomavirus type 163
gacaattacaagcggacgct

SEQ ID NO: 40596 - DNA, 20 bp, Human papillomavirus type 163
caagcggacgcttgggatcc

SEQ ID NO: 40597 - DNA, 20 bp, Human papillomavirus type 163
ggatccgccaataattcttg

SEQ ID NO: 40598 - DNA, 20 bp, Human papillomavirus type 163
ttgtaaggggtctacccaac

SEQ ID NO: 40599 - DNA, 20 bp, Human papillomavirus type 163
taaggggtctacccaacacg

SEQ ID NO: 40600 - DNA, 20 bp, Human papillomavirus type 163
tcaactcctagtagagtaaa

SEQ ID NO: 40601 - DNA, 20 bp, Human papillomavirus type 163
ctgttgacactataggccca

SEQ ID NO: 40602 - DNA, 20 bp, Human papillomavirus type 163
acactataggcccatctgag

SEQ ID NO: 40603 - DNA, 20 bp, Human papillomavirus type 163
caatagatgttattgatcct

SEQ ID NO: 40604 - DNA, 20 bp, Human papillomavirus type 163
gaactacctcagatgggcct

SEQ ID NO: 40605 - DNA, 20 bp, Human papillomavirus type 163
ttgcagctagtggacatcca

SEQ ID NO: 40606 - DNA, 20 bp, Human papillomavirus type 163
cagctagtggacatccaacc

SEQ ID NO: 40607 - DNA, 20 bp, Human papillomavirus type 163
ttagcaatgcagaagaaggt

SEQ ID NO: 40608 - DNA, 20 bp, Human papillomavirus type 163
gcaatgcagaagaaggtgta

SEQ ID NO: 40609 - DNA, 20 bp, Human papillomavirus type 163
gatgtgcaacctatagaacc

SEQ ID NO: 40610 - DNA, 20 bp, Human papillomavirus type 163
tgaaatgatacctttggaga

SEQ ID NO: 40611 - DNA, 20 bp, Human papillomavirus type 163
ggagacattacacaccagag

SEQ ID NO: 40612 - DNA, 20 bp, Human papillomavirus type 163
gagacattacacaccagagc

SEQ ID NO: 40613 - DNA, 20 bp, Human papillomavirus type 163
cacaccagagctgaatttga

SEQ ID NO: 40614 - DNA, 20 bp, Human papillomavirus type 163
gaaattgaagcccctcccag

SEQ ID NO: 40615 - DNA, 20 bp, Human papillomavirus type 163
gagcaggatgtagcagaggc

SEQ ID NO: 40616 - DNA, 20 bp, Human papillomavirus type 163
agcaggatgtagcagaggcg

SEQ ID NO: 40617 - DNA, 20 bp, Human papillomavirus type 163
cagcgcccgatctggatttt

SEQ ID NO: 40618 - DNA, 20 bp, Human papillomavirus type 163
tgctgacattagagtattag

SEQ ID NO: 40619 - DNA, 20 bp, Human papillomavirus type 163
gctgacattagagtattagg

SEQ ID NO: 40620 - DNA, 20 bp, Human papillomavirus type 163
attatatgattttgaaagcc

SEQ ID NO: 40621 - DNA, 20 bp, Human papillomavirus type 163
ttatatgattttgaaagcca

SEQ ID NO: 40622 - DNA, 20 bp, Human papillomavirus type 163
tatgattttgaaagccatga

SEQ ID NO: 40623 - DNA, 20 bp, Human papillomavirus type 163
tgaaagccatgattttatac

SEQ ID NO: 40624 - DNA, 20 bp, Human papillomavirus type 163
gaaagccatgattttatact

SEQ ID NO: 40625 - DNA, 20 bp, Human papillomavirus type 163
actgtaggtcacccatactt

SEQ ID NO: 40626 - DNA, 20 bp, Human papillomavirus type 163
cctattcgggatgttcaaga

SEQ ID NO: 40627 - DNA, 20 bp, Human papillomavirus type 163
ctattcgggatgttcaagat

SEQ ID NO: 40628 - DNA, 20 bp, Human papillomavirus type 163
gggatgttcaagataaaaca

SEQ ID NO: 40629 - DNA, 20 bp, Human papillomavirus type 163
aagataaaacaaaaatatta

SEQ ID NO: 40630 - DNA, 20 bp, Human papillomavirus type 163
aacagagcgatgataatcgc

SEQ ID NO: 40631 - DNA, 20 bp, Human papillomavirus type 163
agaccctaagcaaacccaac

SEQ ID NO: 40632 - DNA, 20 bp, Human papillomavirus type 163
gaccctaagcaaacccaact

SEQ ID NO: 40633 - DNA, 20 bp, Human papillomavirus type 163
attgtaggctgtgctccacc

SEQ ID NO: 40634 - DNA, 20 bp, Human papillomavirus type 163
ttgtaggctgtgctccacca

SEQ ID NO: 40635 - DNA, 20 bp, Human papillomavirus type 163
ggaacacctagtggttctct

SEQ ID NO: 40636 - DNA, 20 bp, Human papillomavirus type 163
gaacacctagtggttctcta

SEQ ID NO: 40637 - DNA, 20 bp, Human papillomavirus type 163
tctagtttccagtgaatccc

SEQ ID NO: 40638 - DNA, 20 bp, Human papillomavirus type 163
ccagtgaatcccaagtattt

SEQ ID NO: 40639 - DNA, 20 bp, Human papillomavirus type 163
cagtgaatcccaagtattta

SEQ ID NO: 40640 - DNA, 20 bp, Hepatitis C virus
gtatgagtgtcgtacagcct

SEQ ID NO: 40641 - DNA, 20 bp, Hepatitis C virus
ccgggaagactgggtccttt

SEQ ID NO: 40642 - DNA, 20 bp, Hepatitis C virus
ccggcaattccggtgtactc

SEQ ID NO: 40643 - DNA, 20 bp, Hepatitis C virus
cggtgtactcaccggttccg

SEQ ID NO: 40644 - DNA, 20 bp, Hepatitis C virus
cgcagaccactatggctctc

SEQ ID NO: 40645 - DNA, 20 bp, Hepatitis C virus
agttcccgggtggcgggcag

SEQ ID NO: 40646 - DNA, 20 bp, Hepatitis C virus
ccgggtggcgggcagatcgt

SEQ ID NO: 40647 - DNA, 20 bp, Hepatitis C virus
gcggagtctacttgttgccg

SEQ ID NO: 40648 - DNA, 20 bp, Hepatitis C virus
ttgccgcgcaggggccctag

SEQ ID NO: 40649 - DNA, 20 bp, Hepatitis C virus
ccgcgcaggggccctagatt

SEQ ID NO: 40650 - DNA, 20 bp, Hepatitis C virus
gccgacctcatggggtacat

SEQ ID NO: 40651 - DNA, 20 bp, Hepatitis C virus
ccgacctcatggggtacatc

SEQ ID NO: 40652 - DNA, 20 bp, Hepatitis C virus
ccagggctctggcacatggt

SEQ ID NO: 40653 - DNA, 20 bp, Hepatitis C virus
gagttctggaggacggggtc

SEQ ID NO: 40654 - DNA, 20 bp, Hepatitis C virus
cgttcgcgagggtaatacta

SEQ ID NO: 40655 - DNA, 20 bp, Hepatitis C virus
gcgagggtaatactagcagg

SEQ ID NO: 40656 - DNA, 20 bp, Hepatitis C virus
ggaaccagtggcccccactt

SEQ ID NO: 40657 - DNA, 20 bp, Hepatitis C virus
ggcggtccgctatcgcggag

SEQ ID NO: 40658 - DNA, 20 bp, Hepatitis C virus
gcggtccgctatcgcggagc

SEQ ID NO: 40659 - DNA, 20 bp, Hepatitis C virus
tcaatggttgccgcttacgc

SEQ ID NO: 40660 - DNA, 20 bp, Hepatitis C virus
ccgcttacgctgtgagagtg

SEQ ID NO: 40661 - DNA, 20 bp, Hepatitis C virus
cgctgtgagagtgcccggtg

SEQ ID NO: 40662 - DNA, 20 bp, Hepatitis C virus
acaaggccggcgcccagttc

SEQ ID NO: 40663 - DNA, 20 bp, Hepatitis C virus
tgcatcatgtcccacgccat

SEQ ID NO: 40664 - DNA, 20 bp, Hepatitis C virus
atagcggccctcttctacac

SEQ ID NO: 40665 - DNA, 20 bp, Hepatitis C virus
tacacacataggttcaattc

SEQ ID NO: 40666 - DNA, 20 bp, Hepatitis C virus
aattctagtggctgtcccga

SEQ ID NO: 40667 - DNA, 20 bp, Hepatitis C virus
tagtggctgtcccgagagga

SEQ ID NO: 40668 - DNA, 20 bp, Hepatitis C virus
ttgtaaacctctcagtgact

SEQ ID NO: 40669 - DNA, 20 bp, Hepatitis C virus
acgaagacctgcggaggtcc

SEQ ID NO: 40670 - DNA, 20 bp, Hepatitis C virus
ctctgggcaccctggggacg

SEQ ID NO: 40671 - DNA, 20 bp, Hepatitis C virus
cacggaggacctccgcaggt

SEQ ID NO: 40672 - DNA, 20 bp, Hepatitis C virus
cactacggagctcgcaatac

SEQ ID NO: 40673 - DNA, 20 bp, Hepatitis C virus
cgagctccgtagtggaatgg

SEQ ID NO: 40674 - DNA, 20 bp, Hepatitis C virus
atccacctcaacgcggccag

SEQ ID NO: 40675 - DNA, 20 bp, Hepatitis C virus
cgggaacccatggtatctgg

SEQ ID NO: 40676 - DNA, 20 bp, Hepatitis C virus
ccgcaaggctggccgcgttg

SEQ ID NO: 40677 - DNA, 20 bp, Hepatitis C virus
aggtggatcaagttctccag

SEQ ID NO: 40678 - DNA, 20 bp, Hepatitis C virus
tccagagcggcttcagcctg

SEQ ID NO: 40679 - DNA, 20 bp, Hepatitis C virus
ccttacaaggtgtgaagcag

SEQ ID NO: 40680 - DNA, 20 bp, Hepatitis C virus
cttacaaggtgtgaagcagc

SEQ ID NO: 40681 - DNA, 20 bp, Hepatitis C virus
caaggtgtgaagcagcactc

SEQ ID NO: 40682 - DNA, 20 bp, Hepatitis C virus
agaggagggacccacgtttg

SEQ ID NO: 40683 - DNA, 20 bp, Hepatitis C virus
ggagtgctgcttcacacctt

SEQ ID NO: 40684 - DNA, 20 bp, Hepatitis C virus
tatttataaccatctcgccc

SEQ ID NO: 40685 - DNA, 20 bp, Hepatitis C virus
ataaccatctcgcccccctg

SEQ ID NO: 40686 - DNA, 20 bp, Hepatitis C virus
taaccatctcgcccccctgg

SEQ ID NO: 40687 - DNA, 20 bp, Hepatitis C virus
ggccgttgcagtcgagcccg

SEQ ID NO: 40688 - DNA, 20 bp, Hepatitis C virus
gccgttgcagtcgagcccgt

SEQ ID NO: 40689 - DNA, 20 bp, Hepatitis C virus
tccacctcaacgcagacctt

SEQ ID NO: 40690 - DNA, 20 bp, Hepatitis C virus
ctggggaccaatgtgggcgg

SEQ ID NO: 40691 - DNA, 20 bp, Hepatitis C virus
gtccccaggaaggtctgcgt

SEQ ID NO: 40692 - DNA, 20 bp, Hepatitis C virus
aggtggacaacacctgcacc

SEQ ID NO: 40693 - DNA, 20 bp, Hepatitis C virus
aaggctcctcgggagggcct

SEQ ID NO: 40694 - DNA, 20 bp, Hepatitis C virus
tgcccccaaagtcattgcgt

SEQ ID NO: 40695 - DNA, 20 bp, Hepatitis C virus
cgttggcatcttcagagctg

SEQ ID NO: 40696 - DNA, 20 bp, Hepatitis C virus
gcatcttcagagctgctgtc

SEQ ID NO: 40697 - DNA, 20 bp, Hepatitis C virus
agagctgctgtctgcacccg

SEQ ID NO: 40698 - DNA, 20 bp, Hepatitis C virus
ggtttggtgcctacatgtcc

SEQ ID NO: 40699 - DNA, 20 bp, Hepatitis C virus
ggtgcctacatgtccaaggc

SEQ ID NO: 40700 - DNA, 20 bp, Hepatitis C virus
gtgcctacatgtccaaggct

SEQ ID NO: 40701 - DNA, 20 bp, Hepatitis C virus
tggaattgatccaagtgtgc

SEQ ID NO: 40702 - DNA, 20 bp, Hepatitis C virus
atccaagtgtgcgcaccggc

SEQ ID NO: 40703 - DNA, 20 bp, Hepatitis C virus
ccttctatgggaaagccatc

SEQ ID NO: 40704 - DNA, 20 bp, Hepatitis C virus
tatgggaaagccatccccct

SEQ ID NO: 40705 - DNA, 20 bp, Hepatitis C virus
tctgtcattccaaaaagaaa

SEQ ID NO: 40706 - DNA, 20 bp, Hepatitis C virus
ctgtcattccaaaaagaaat

SEQ ID NO: 40707 - DNA, 20 bp, Hepatitis C virus
tgtcattccaaaaagaaatg

SEQ ID NO: 40708 - DNA, 20 bp, Hepatitis C virus
actattgagaccaccacagt

SEQ ID NO: 40709 - DNA, 20 bp, Hepatitis C virus
agaccaccacagtcccgcaa

SEQ ID NO: 40710 - DNA, 20 bp, Hepatitis C virus
tgtctcgcgctctcagagac

SEQ ID NO: 40711 - DNA, 20 bp, Hepatitis C virus
cgggactgtggtggtctcaa

SEQ ID NO: 40712 - DNA, 20 bp, Hepatitis C virus
gccgtgtggtccttggatcc

SEQ ID NO: 40713 - DNA, 20 bp, Hepatitis C virus
gatccaacgtggtgacggcc

SEQ ID NO: 40714 - DNA, 20 bp, Hepatitis C virus
tataccagcactttgatgag

SEQ ID NO: 40715 - DNA, 20 bp, Hepatitis C virus
ataccagcactttgatgaga

SEQ ID NO: 40716 - DNA, 20 bp, Hepatitis C virus
taccagcactttgatgagat

SEQ ID NO: 40717 - DNA, 20 bp, Hepatitis C virus
accgcctcagttactagccc

SEQ ID NO: 40718 - DNA, 20 bp, Hepatitis C virus
ctagcccccttgctacatcg

SEQ ID NO: 40719 - DNA, 20 bp, Hepatitis C virus
ctacatcgaccacactacta

SEQ ID NO: 40720 - DNA, 20 bp, Hepatitis C virus
gcaagccagttagcgccgcc

SEQ ID NO: 40721 - DNA, 20 bp, Hepatitis C virus
gcgccgccgtctgctgccac

SEQ ID NO: 40722 - DNA, 20 bp, Hepatitis C virus
agttgtgggagttgtttgtg

SEQ ID NO: 40723 - DNA, 20 bp, Hepatitis C virus
gttgtgggagttgtttgtgc

SEQ ID NO: 40724 - DNA, 20 bp, Hepatitis C virus
tgggagttgtttgtgccgcg

SEQ ID NO: 40725 - DNA, 20 bp, Hepatitis C virus
tttgtgccgcgatcatcaaa

SEQ ID NO: 40726 - DNA, 20 bp, Hepatitis C virus
gtgccgcgatcatcaaacgg

SEQ ID NO: 40727 - DNA, 20 bp, Hepatitis C virus
gcatcttggttgaaggccaa

SEQ ID NO: 40728 - DNA, 20 bp, Hepatitis C virus
catcttggttgaaggccaag

SEQ ID NO: 40729 - DNA, 20 bp, Hepatitis C virus
gttgaaggccaaggtacttc

SEQ ID NO: 40730 - DNA, 20 bp, Hepatitis C virus
aaggccaaggtacttcccag

SEQ ID NO: 40731 - DNA, 20 bp, Hepatitis C virus
ccagccttccagggatccca

SEQ ID NO: 40732 - DNA, 20 bp, Hepatitis C virus
ygtggtgggagtgacggcgg

SEQ ID NO: 40733 - DNA, 20 bp, Hepatitis C virus
cttcccccgaattcttcagc

SEQ ID NO: 40734 - DNA, 20 bp, Hepatitis C virus
ccccgaattcttcagctttg

SEQ ID NO: 40735 - DNA, 20 bp, Hepatitis C virus
ttcagctttgtggacggggt

SEQ ID NO: 40736 - DNA, 20 bp, Hepatitis C virus
agctttgtggacggggtgcg

SEQ ID NO: 40737 - DNA, 20 bp, Hepatitis C virus
caccacccaggcggaagcgg

SEQ ID NO: 40738 - DNA, 20 bp, Hepatitis C virus
tccaactcacagagtccgcg

SEQ ID NO: 40739 - DNA, 20 bp, Hepatitis C virus
gataaccgcccgcttccgcc

SEQ ID NO: 40740 - DNA, 20 bp, Hepatitis C virus
cgcctgggtggtggaacagg

SEQ ID NO: 40741 - DNA, 20 bp, Hepatitis C virus
gggtacggggcaaaggaagt

SEQ ID NO: 40742 - DNA, 20 bp, Hepatitis C virus
ggtacggggcaaaggaagtc

SEQ ID NO: 40743 - DNA, 20 bp, Hepatitis C virus
cgcccaaggcaatgtctcac

SEQ ID NO: 40744 - DNA, 20 bp, Hepatitis C virus
ctacaggacatgaccacccc

SEQ ID NO: 40745 - DNA, 20 bp, Hepatitis C virus
attcttggccattatggtgg

SEQ ID NO: 40746 - DNA, 20 bp, Hepatitis C virus
gattccactgtcacagaaca

SEQ ID NO: 40747 - DNA, 20 bp, Hepatitis C virus
attccactgtcacagaacaa

SEQ ID NO: 40748 - DNA, 20 bp, Hepatitis C virus
cactgtcacagaacaagaca

SEQ ID NO: 40749 - DNA, 20 bp, Hepatitis C virus
atgatggtgcgagcctcggg

SEQ ID NO: 40750 - DNA, 20 bp, Hepatitis C virus
cagcactgatagatctcgct

SEQ ID NO: 40751 - DNA, 20 bp, Hepatitis C virus
cctggtctgcggcgatgact

SEQ ID NO: 40752 - DNA, 20 bp, Hepatitis C virus
ctggtctgcggcgatgactt

SEQ ID NO: 40753 - DNA, 20 bp, Hepatitis C virus
gtggtcatttgcgagagcaa

SEQ ID NO: 40754 - DNA, 20 bp, Hepatitis C virus
gcgagagcaagggagtcgaa

SEQ ID NO: 40755 - DNA, 20 bp, Hepatitis C virus
cgagagcaagggagtcgaac

SEQ ID NO: 40756 - DNA, 20 bp, Hepatitis C virus
caggcgctggccggctcgat

SEQ ID NO: 40757 - DNA, 20 bp, Hepatitis C virus
cgagctggttcagcgtttgc

SEQ ID NO: 40758 - DNA, 20 bp, Hepatitis C virus
gagctggttcagcgtttgcg

SEQ ID NO: 40759 - DNA, 20 bp, Hepatitis C virus
gatcttggtcctgacagccc

SEQ ID NO: 40760 - DNA, 20 bp, Hepatitis C virus
atcttggtcctgacagccca

SEQ ID NO: 40761 - DNA, 20 bp, Influenza C virus
cagcaataacaggaggaaaa

SEQ ID NO: 40762 - DNA, 20 bp, Influenza C virus
agcaataacaggaggaaaat

SEQ ID NO: 40763 - DNA, 20 bp, Influenza C virus
agaatgaacatcttccccta

SEQ ID NO: 40764 - DNA, 20 bp, Influenza C virus
ccctaatgtctggagaagcc

SEQ ID NO: 40765 - DNA, 20 bp, Influenza C virus
tggtggcttctccagacatt

SEQ ID NO: 40766 - DNA, 20 bp, Influenza C virus
ttgggagtggagtcaatgat

SEQ ID NO: 40767 - DNA, 20 bp, Influenza C virus
ggagtggagtcaatgatgaa

SEQ ID NO: 40768 - DNA, 20 bp, Influenza C virus
tttggtcatctctgaaggcc

SEQ ID NO: 40769 - DNA, 20 bp, Influenza C virus
ggtcatctctgaaggccctc

SEQ ID NO: 40770 - DNA, 20 bp, Influenza C virus
gtcatctctgaaggccctca

SEQ ID NO: 40771 - DNA, 20 bp, Influenza B virus
ccccttattctcatggaacg

SEQ ID NO: 40772 - DNA, 20 bp, Influenza B virus
ttctcatggaacgggaacag

SEQ ID NO: 40773 - DNA, 20 bp, Influenza B virus
tcatggaacgggaacaggct

SEQ ID NO: 40774 - DNA, 20 bp, Influenza B virus
gaacacacgagtactcaaac

SEQ ID NO: 40775 - DNA, 20 bp, Influenza B virus
ttttcccttgtttgagtact

SEQ ID NO: 40776 - DNA, 20 bp, Influenza B virus
caagcagggtcacagaatgc

SEQ ID NO: 40777 - DNA, 20 bp, Influenza B virus
aagcagggtcacagaatgcc

SEQ ID NO: 40778 - DNA, 20 bp, Influenza B virus
actcaggggagacagacctt

SEQ ID NO: 40779 - DNA, 20 bp, Influenza B virus
gattggacggtgtgtagaaa

SEQ ID NO: 40780 - DNA, 20 bp, Influenza B virus
attggacggtgtgtagaaac

SEQ ID NO: 40781 - DNA, 20 bp, Influenza B virus
acccgtaggtggaaacgaaa

SEQ ID NO: 40782 - DNA, 20 bp, Influenza B virus
cccgtaggtggaaacgaaaa

SEQ ID NO: 40783 - DNA, 20 bp, Influenza B virus
ctgagcattttagccactgc

SEQ ID NO: 40784 - DNA, 20 bp, Influenza B virus
tagccactgcatttgatagt

SEQ ID NO: 40785 - DNA, 20 bp, Influenza B virus
agccactgcatttgatagtt

SEQ ID NO: 40786 - DNA, 20 bp, Influenza B virus
ttcatagctgactatagata

SEQ ID NO: 40787 - DNA, 20 bp, Influenza B virus
atagctgactatagatacac

SEQ ID NO: 40788 - DNA, 20 bp, Influenza B virus
gtaggtgtatctatagtcag

SEQ ID NO: 40789 - DNA, 20 bp, Influenza B virus
taggtgtatctatagtcagc

SEQ ID NO: 40790 - DNA, 20 bp, Influenza B virus
tatggctgtttgtgccgttg

SEQ ID NO: 40791 - DNA, 20 bp, Influenza B virus
acaatttgagaaacctgcat

SEQ ID NO: 40792 - DNA, 20 bp, Influenza B virus
caatttgagaaacctgcata

SEQ ID NO: 40793 - DNA, 20 bp, Influenza B virus
gagaaacctgcatattccag

SEQ ID NO: 40794 - DNA, 20 bp, Influenza B virus
agaaacctgcatattccaga

SEQ ID NO: 40795 - DNA, 20 bp, Influenza B virus
cagaaataatattaaaatac

SEQ ID NO: 40796 - DNA, 20 bp, Influenza B virus
ttgaggaacaatgctacgct

SEQ ID NO: 40797 - DNA, 20 bp, Influenza B virus
aggaacaatgctacgctaag

SEQ ID NO: 40798 - DNA, 20 bp, Influenza B virus
caacctttttgaggcttgct

SEQ ID NO: 40799 - DNA, 20 bp, Influenza B virus
ttgaggcttgctttaacagt

SEQ ID NO: 40800 - DNA, 20 bp, Influenza B virus
tgaggcttgctttaacagtg

SEQ ID NO: 40801 - DNA, 20 bp, Influenza A virus
atctcatactcctgttcaca

SEQ ID NO: 40802 - DNA, 20 bp, Influenza A virus
tctcatactcctgttcacag

SEQ ID NO: 40803 - DNA, 20 bp, Influenza A virus
acagcagtgaggggggacca

SEQ ID NO: 40804 - DNA, 20 bp, Influenza A virus
gataccatgccaataattcc

SEQ ID NO: 40805 - DNA, 20 bp, Influenza A virus
cacagaaaaggtcgacacaa

SEQ ID NO: 40806 - DNA, 20 bp, Influenza A virus
taagtgtgccagaatggtcc

SEQ ID NO: 40807 - DNA, 20 bp, Influenza A virus
gtgttacccaggcagcttca

SEQ ID NO: 40808 - DNA, 20 bp, Influenza A virus
tgttacccaggcagcttcaa

SEQ ID NO: 40809 - DNA, 20 bp, Influenza A virus
cccaggcagcttcaatgact

SEQ ID NO: 40810 - DNA, 20 bp, Influenza A virus
aatgactatgaagaattgaa

SEQ ID NO: 40811 - DNA, 20 bp, Influenza A virus
tccggttgccaaaggatcgt

SEQ ID NO: 40812 - DNA, 20 bp, Influenza A virus
ccaaaggatcgtacaacaat

SEQ ID NO: 40813 - DNA, 20 bp, Influenza A virus
ggggagtgcaccatcctaat

SEQ ID NO: 40814 - DNA, 20 bp, Influenza A virus
gggagtgcaccatcctaatg

SEQ ID NO: 40815 - DNA, 20 bp, Influenza A virus
ttctgcctcatcattaggat

SEQ ID NO: 40816 - DNA, 20 bp, Influenza A virus
caccagagtatgggttcaaa

SEQ ID NO: 40817 - DNA, 20 bp, Influenza A virus
aaaatatcgaaaagaggtag

SEQ ID NO: 40818 - DNA, 20 bp, Influenza A virus
agggatcatgaagacagaag

SEQ ID NO: 40819 - DNA, 20 bp, Influenza A virus
agaactgtgaaaccaaatgc

SEQ ID NO: 40820 - DNA, 20 bp, Influenza A virus
ggcatttggtttcacagttc

SEQ ID NO: 40821 - DNA, 20 bp, Influenza A virus
tttggggcaatagctggttt

SEQ ID NO: 40822 - DNA, 20 bp, Influenza A virus
ggggcaatagctggttttat

SEQ ID NO: 40823 - DNA, 20 bp, Influenza A virus
gggcaatagctggttttata

SEQ ID NO: 40824 - DNA, 20 bp, Influenza A virus
tatagaaggaggatggcaag

SEQ ID NO: 40825 - DNA, 20 bp, Influenza A virus
atagaaggaggatggcaagg

SEQ ID NO: 40826 - DNA, 20 bp, Respiratory syncytial virus
tcacttgagactataataat

SEQ ID NO: 40827 - DNA, 20 bp, Respiratory syncytial virus
agactataataatatcacta

SEQ ID NO: 40828 - DNA, 20 bp, Respiratory syncytial virus
gtgatattattatagtctca

SEQ ID NO: 40829 - DNA, 20 bp, Respiratory syncytial virus
ttatagtctcaagtgacaat

SEQ ID NO: 40830 - DNA, 20 bp, Respiratory syncytial virus
tagtctcaagtgacaatggt

SEQ ID NO: 40831 - DNA, 20 bp, Respiratory syncytial virus
gcaaagtcaagttgaatgat

SEQ ID NO: 40832 - DNA, 20 bp, Respiratory syncytial virus
aatgatacactcaacaaaga

SEQ ID NO: 40833 - DNA, 20 bp, Respiratory syncytial virus
tgtcatccagcaaatacacc

SEQ ID NO: 40834 - DNA, 20 bp, Respiratory syncytial virus
gatggtgtatttgctggatg

SEQ ID NO: 40835 - DNA, 20 bp, Respiratory syncytial virus
gctggatgacagaagttgat

SEQ ID NO: 40836 - DNA, 20 bp, Respiratory syncytial virus
ggagggctaataatgtccta

SEQ ID NO: 40837 - DNA, 20 bp, Respiratory syncytial virus
taaaggcttactacccaagg

SEQ ID NO: 40838 - DNA, 20 bp, Respiratory syncytial virus
ctacccaaggatatagccaa

SEQ ID NO: 40839 - DNA, 20 bp, Respiratory syncytial virus
tatgaagtgtttgaaaaata

SEQ ID NO: 40840 - DNA, 20 bp, Respiratory syncytial virus
gaaaaatatcctcactttat

SEQ ID NO: 40841 - DNA, 20 bp, Respiratory syncytial virus
cctcacttctccagtgtagt

SEQ ID NO: 40842 - DNA, 20 bp, Respiratory syncytial virus
ctcacttctccagtgtagta

SEQ ID NO: 40843 - DNA, 20 bp, Respiratory syncytial virus
tccagtgtagtattaggcaa

SEQ ID NO: 40844 - DNA, 20 bp, Respiratory syncytial virus
ggcaatgctgctggcctagg

SEQ ID NO: 40845 - DNA, 20 bp, Respiratory syncytial virus
tgcagcatcatatagatctt

SEQ ID NO: 40846 - DNA, 20 bp, Respiratory syncytial virus
gtttaagagaagacatgata

SEQ ID NO: 40847 - DNA, 20 bp, Respiratory syncytial virus
aagagaagacatgatagaaa

SEQ ID NO: 40848 - DNA, 20 bp, Respiratory syncytial virus
agagaagacatgatagaaaa

SEQ ID NO: 40849 - DNA, 20 bp, Respiratory syncytial virus
atgaccaatgacagactaga

SEQ ID NO: 40850 - DNA, 20 bp, Respiratory syncytial virus
ccatagcttctagtctgtca

SEQ ID NO: 40851 - DNA, 20 bp, Respiratory syncytial virus
tggattggctgattggcgta

SEQ ID NO: 40852 - DNA, 20 bp, Respiratory syncytial virus
ggattggctgattggcgtat

SEQ ID NO: 40853 - DNA, 20 bp, Respiratory syncytial virus
gattggctgattggcgtata

SEQ ID NO: 40854 - DNA, 20 bp, Respiratory syncytial virus
gctgattggcgtatagatgt

SEQ ID NO: 40855 - DNA, 20 bp, Respiratory syncytial virus
gcgtatagatgtttggttgg

SEQ ID NO: 40856 - DNA, 20 bp, Respiratory syncytial virus
attaagagtcatgataaact

SEQ ID NO: 40857 - DNA, 20 bp, Respiratory syncytial virus
agagtcatgataaactcaag

SEQ ID NO: 40858 - DNA, 20 bp, Respiratory syncytial virus
gctgggcatttgtgctagca

SEQ ID NO: 40859 - DNA, 20 bp, Respiratory syncytial virus
ctgggcatttgtgctagcac

SEQ ID NO: 40860 - DNA, 20 bp, Respiratory syncytial virus
gtgctagcactgcacttctt

SEQ ID NO: 40861 - DNA, 20 bp, Respiratory syncytial virus
aaaaatgccatcacaaatgc

SEQ ID NO: 40862 - DNA, 20 bp, Respiratory syncytial virus
ctcaggattactgttagtca

SEQ ID NO: 40863 - DNA, 20 bp, Respiratory syncytial virus
ctgttagtcatcacagtgac

SEQ ID NO: 40864 - DNA, 20 bp, Respiratory syncytial virus
gtcatcacagtgactgacaa

SEQ ID NO: 40865 - DNA, 20 bp, Respiratory syncytial virus
atgtatttgaatgctccttt

SEQ ID NO: 40866 - DNA, 20 bp, Respiratory syncytial virus
ttcatcagatctagtactca

SEQ ID NO: 40867 - DNA, 20 bp, Respiratory syncytial virus
atcagatctagtactcaaat

SEQ ID NO: 40868 - DNA, 20 bp, Respiratory syncytial virus
ataaaaatatccacatgggg

SEQ ID NO: 40869 - DNA, 20 bp, Respiratory syncytial virus
gaggaaatccaactaatcac

SEQ ID NO: 40870 - DNA, 20 bp, Respiratory syncytial virus
gttggatttcctccaatgat

SEQ ID NO: 40871 - DNA, 20 bp, Respiratory syncytial virus
ttcatatcatcgtgcttata

SEQ ID NO: 40872 - DNA, 20 bp, Respiratory syncytial virus
atatcatcgtgcttatacaa

SEQ ID NO: 40873 - DNA, 20 bp, Respiratory syncytial virus
tacaagttaaatcttaaatc

SEQ ID NO: 40874 - DNA, 20 bp, Respiratory syncytial virus
aatcttaaatctatagcaca

SEQ ID NO: 40875 - DNA, 20 bp, Respiratory syncytial virus
aatctatagcacaaatcaca

SEQ ID NO: 40876 - DNA, 20 bp, Respiratory syncytial virus
tcactttgaagtgttcaact

SEQ ID NO: 40877 - DNA, 20 bp, Respiratory syncytial virus
cactttgaagtgttcaactt

SEQ ID NO: 40878 - DNA, 20 bp, Respiratory syncytial virus
actttgaagtgttcaacttt

SEQ ID NO: 40879 - DNA, 20 bp, Respiratory syncytial virus
gaagtgttcaactttgtacc

SEQ ID NO: 40880 - DNA, 20 bp, Respiratory syncytial virus
aagtgttcaactttgtacct

SEQ ID NO: 40881 - DNA, 20 bp, Respiratory syncytial virus
tatagacttgtgaagggctt

SEQ ID NO: 40882 - DNA, 20 bp, Respiratory syncytial virus
tgaagggcttggattgccat

SEQ ID NO: 40883 - DNA, 20 bp, Respiratory syncytial virus
gattgccatcggaggaggtt

SEQ ID NO: 40884 - DNA, 20 bp, Respiratory syncytial virus
ccatcggaggaggttgagtg

SEQ ID NO: 40885 - DNA, 20 bp, Respiratory syncytial virus
agtggagggttcccttttga

SEQ ID NO: 40886 - DNA, 20 bp, Respiratory syncytial virus
ccaatcctcaaaacaaatgc

SEQ ID NO: 40887 - DNA, 20 bp, Respiratory syncytial virus
ccgcaatccttgctgcagtc

SEQ ID NO: 40888 - DNA, 20 bp, Respiratory syncytial virus
ctgcagtcacactctgtttt

SEQ ID NO: 40889 - DNA, 20 bp, Respiratory syncytial virus
tgcttccagtcaaaacatca

SEQ ID NO: 40890 - DNA, 20 bp, Respiratory syncytial virus
gcttccagtcaaaacatcac

SEQ ID NO: 40891 - DNA, 20 bp, Respiratory syncytial virus
tcaaatggagttagtgtctt

SEQ ID NO: 40892 - DNA, 20 bp, Respiratory syncytial virus
gtgtcttaaccagcaaagtg

SEQ ID NO: 40893 - DNA, 20 bp, Respiratory syncytial virus
accagcaaagtgttagacct

SEQ ID NO: 40894 - DNA, 20 bp, Respiratory syncytial virus
gacctcaaaaactatataga

SEQ ID NO: 40895 - DNA, 20 bp, Respiratory syncytial virus
atctatatagtttttgaggt

SEQ ID NO: 40896 - DNA, 20 bp, Respiratory syncytial virus
aacaagaaccgacagaggat

SEQ ID NO: 40897 - DNA, 20 bp, Respiratory syncytial virus
acaagaaccgacagaggatg

SEQ ID NO: 40898 - DNA, 20 bp, Respiratory syncytial virus
cttcccactagctgaaacat

SEQ ID NO: 40899 - DNA, 20 bp, Respiratory syncytial virus
ttcccactagctgaaacatg

SEQ ID NO: 40900 - DNA, 20 bp, Respiratory syncytial virus
ccactagctgaaacatgtaa

SEQ ID NO: 40901 - DNA, 20 bp, Respiratory syncytial virus
catttagtaactaaataaaa

SEQ ID NO: 40902 - DNA, 20 bp, Respiratory syncytial virus
agtaactaaataaaaatagc

SEQ ID NO: 40903 - DNA, 20 bp, Respiratory syncytial virus
gtaactaaataaaaatagca

SEQ ID NO: 40904 - DNA, 20 bp, Respiratory syncytial virus
ttacaatggtttcatatctg

SEQ ID NO: 40905 - DNA, 20 bp, Respiratory syncytial virus
caatggtttcatatctgctc

SEQ ID NO: 40906 - DNA, 20 bp, Respiratory syncytial virus
gacagaacagaagagtatgc

SEQ ID NO: 40907 - DNA, 20 bp, Respiratory syncytial virus
gagtgctagagagttatata

SEQ ID NO: 40908 - DNA, 20 bp, Respiratory syncytial virus
tataggatctataaataata

SEQ ID NO: 40909 - DNA, 20 bp, Respiratory syncytial virus
ccatgagcaaactcctcact

SEQ ID NO: 40910 - DNA, 20 bp, Respiratory syncytial virus
tttgatgtcatcactgttga

SEQ ID NO: 40911 - DNA, 20 bp, Respiratory syncytial virus
gacaggcaaagaaagagaac

SEQ ID NO: 40912 - DNA, 20 bp, Respiratory syncytial virus
acaggcaaagaaagagaact

SEQ ID NO: 40913 - DNA, 20 bp, Respiratory syncytial virus
gcaatgcaaccaggaatgtt

SEQ ID NO: 40914 - DNA, 20 bp, Respiratory syncytial virus
caatgcaaccaggaatgttc

SEQ ID NO: 40915 - DNA, 20 bp, Respiratory syncytial virus
gaacttgtctgaacattcct

SEQ ID NO: 40916 - DNA, 20 bp, Respiratory syncytial virus
tgagcacagctccaaacaaa

SEQ ID NO: 40917 - DNA, 20 bp, Respiratory syncytial virus
gagcacagctccaaacaaaa

SEQ ID NO: 40918 - DNA, 20 bp, Respiratory syncytial virus
agcacagctccaaacaaaat

SEQ ID NO: 40919 - DNA, 20 bp, Respiratory syncytial virus
tccaaaagtgcacaacacta

SEQ ID NO: 40920 - DNA, 20 bp, Respiratory syncytial virus
tgcaaaatatagaacctaca

SEQ ID NO: 40921 - DNA, 20 bp, Respiratory syncytial virus
acatatgagaaagccaaaaa

SEQ ID NO: 40922 - DNA, 20 bp, Respiratory syncytial virus
tttccacaatatttaagtgt

SEQ ID NO: 40923 - DNA, 20 bp, Respiratory syncytial virus
ccacaatatttaagtgttaa

SEQ ID NO: 40924 - DNA, 20 bp, Respiratory syncytial virus
cacaatatttaagtgttaac

SEQ ID NO: 40925 - DNA, 20 bp, Respiratory syncytial virus
aagtgttaactatttgcatc

SEQ ID NO: 40926 - DNA, 20 bp, Hepatitis C virus
acgcagaaagcgtctagcca

SEQ ID NO: 40927 - DNA, 20 bp, Hepatitis C virus
gtatgagtgtcgtgcagcct

SEQ ID NO: 40928 - DNA, 20 bp, Hepatitis C virus
cgcagaccactatggctctc

SEQ ID NO: 40929 - DNA, 20 bp, Hepatitis C virus
ctgcgtgaagacagtagttc

SEQ ID NO: 40930 - DNA, 20 bp, Hepatitis C virus
ccgggtggcggtcagatcgt

SEQ ID NO: 40931 - DNA, 20 bp, Hepatitis C virus
gtggagtttacttgttgccg

SEQ ID NO: 40932 - DNA, 20 bp, Hepatitis C virus
acttgttgccgcgcaggggc

SEQ ID NO: 40933 - DNA, 20 bp, Hepatitis C virus
cttgttgccgcgcaggggcc

SEQ ID NO: 40934 - DNA, 20 bp, Hepatitis C virus
ttgccgcgcaggggccctag

SEQ ID NO: 40935 - DNA, 20 bp, Hepatitis C virus
gccgacctcatggggtacat

SEQ ID NO: 40936 - DNA, 20 bp, Hepatitis C virus
gaggcgctgccagggccctg

SEQ ID NO: 40937 - DNA, 20 bp, Hepatitis C virus
tggaagacggcgtgaactat

SEQ ID NO: 40938 - DNA, 20 bp, Hepatitis C virus
cctgttgcatagttcacgcc

SEQ ID NO: 40939 - DNA, 20 bp, Hepatitis C virus
catagttcacgccgtcttcc

SEQ ID NO: 40940 - DNA, 20 bp, Hepatitis C virus
cgttcgcgagggtaacgcct

SEQ ID NO: 40941 - DNA, 20 bp, Hepatitis C virus
gcgagggtaacgcctcgagg

SEQ ID NO: 40942 - DNA, 20 bp, Hepatitis C virus
ggtggcggtgacccccacgg

SEQ ID NO: 40943 - DNA, 20 bp, Hepatitis C virus
gccgtccctggtggccaccg

SEQ ID NO: 40944 - DNA, 20 bp, Hepatitis C virus
ccgtccctggtggccaccgt

SEQ ID NO: 40945 - DNA, 20 bp, Hepatitis C virus
gtggtagctcagctgctccg

SEQ ID NO: 40946 - DNA, 20 bp, Hepatitis C virus
tgggatccggagcagctgag

SEQ ID NO: 40947 - DNA, 20 bp, Hepatitis C virus
gccagctgccgacgccttac

SEQ ID NO: 40948 - DNA, 20 bp, Hepatitis C virus
ccgattttgcccagggctgg

SEQ ID NO: 40949 - DNA, 20 bp, Hepatitis C virus
tgcccagggctggggtccta

SEQ ID NO: 40950 - DNA, 20 bp, Hepatitis C virus
gcccagggctggggtcctat

SEQ ID NO: 40951 - DNA, 20 bp, Hepatitis C virus
cccagggctggggtcctatc

SEQ ID NO: 40952 - DNA, 20 bp, Hepatitis C virus
gttcggttgtacctggatga

SEQ ID NO: 40953 - DNA, 20 bp, Hepatitis C virus
ggttgtacctggatgaactc

SEQ ID NO: 40954 - DNA, 20 bp, Hepatitis C virus
tacctggatgaactcaactg

SEQ ID NO: 40955 - DNA, 20 bp, Hepatitis C virus
accaaagtgtgcggagcgcc

SEQ ID NO: 40956 - DNA, 20 bp, Hepatitis C virus
tgtcatcggaggggtgggca

SEQ ID NO: 40957 - DNA, 20 bp, Hepatitis C virus
ctgctgtccaccacacagtg

SEQ ID NO: 40958 - DNA, 20 bp, Hepatitis C virus
cagatcacagcgttcgcccc

SEQ ID NO: 40959 - DNA, 20 bp, Hepatitis C virus
gccccgcgtccagttgcagg

SEQ ID NO: 40960 - DNA, 20 bp, Hepatitis C virus
tgtccttcctcgtgttcttc

SEQ ID NO: 40961 - DNA, 20 bp, Hepatitis C virus
ctcgtgttcttctgctttgc

SEQ ID NO: 40962 - DNA, 20 bp, Hepatitis C virus
ttctgctttgcgtggtatct

SEQ ID NO: 40963 - DNA, 20 bp, Hepatitis C virus
tgctttgcgtggtatctgaa

SEQ ID NO: 40964 - DNA, 20 bp, Hepatitis C virus
gcgtggtatctgaagggtag

SEQ ID NO: 40965 - DNA, 20 bp, Hepatitis C virus
gacatcaccaaactactcct

SEQ ID NO: 40966 - DNA, 20 bp, Hepatitis C virus
acatcaccaaactactcctg

SEQ ID NO: 40967 - DNA, 20 bp, Hepatitis C virus
ggacccctttggattcttca

SEQ ID NO: 40968 - DNA, 20 bp, Hepatitis C virus
ggattcttcaagccagtttg

SEQ ID NO: 40969 - DNA, 20 bp, Hepatitis C virus
gattcttcaagccagtttgc

SEQ ID NO: 40970 - DNA, 20 bp, Hepatitis C virus
tcccgaatggagaccaagct

SEQ ID NO: 40971 - DNA, 20 bp, Hepatitis C virus
gtctccattcgggagaagac

SEQ ID NO: 40972 - DNA, 20 bp, Hepatitis C virus
gggagaagacgactggttcc

SEQ ID NO: 40973 - DNA, 20 bp, Hepatitis C virus
cacagccacggccagatctc

SEQ ID NO: 40974 - DNA, 20 bp, Hepatitis C virus
ctggcaacgtgcatcaatgg

SEQ ID NO: 40975 - DNA, 20 bp, Hepatitis C virus
gtatacatctggatgacagg

SEQ ID NO: 40976 - DNA, 20 bp, Hepatitis C virus
ggtgatgcgatggtcctcgt

SEQ ID NO: 40977 - DNA, 20 bp, Hepatitis C virus
cggccccgtggtagacagtc

SEQ ID NO: 40978 - DNA, 20 bp, Hepatitis C virus
agggccgcggtgtgcacccg

SEQ ID NO: 40979 - DNA, 20 bp, Hepatitis C virus
atccctgtggagaacctagg

SEQ ID NO: 40980 - DNA, 20 bp, Hepatitis C virus
tccctgtggagaacctaggg

SEQ ID NO: 40981 - DNA, 20 bp, Hepatitis C virus
tccctaggttctccacaggg

SEQ ID NO: 40982 - DNA, 20 bp, Hepatitis C virus
tccacagggataaagtccac

SEQ ID NO: 40983 - DNA, 20 bp, Hepatitis C virus
ccactggcagccccatcacg

SEQ ID NO: 40984 - DNA, 20 bp, Hepatitis C virus
cttgccgacggcgggtgctc

SEQ ID NO: 40985 - DNA, 20 bp, Hepatitis C virus
ccgacggcgggtgctcagga

SEQ ID NO: 40986 - DNA, 20 bp, Hepatitis C virus
tgacataataatttgtgacg

SEQ ID NO: 40987 - DNA, 20 bp, Hepatitis C virus
ttatgtcataagcacctcct

SEQ ID NO: 40988 - DNA, 20 bp, Hepatitis C virus
tgccactcaaagaagaagtg

SEQ ID NO: 40989 - DNA, 20 bp, Hepatitis C virus
ggcatcaatgccgtggccta

SEQ ID NO: 40990 - DNA, 20 bp, Hepatitis C virus
atgcccaatgcgaccagctt

SEQ ID NO: 40991 - DNA, 20 bp, Hepatitis C virus
gcggcgagctcgtcgcactt

SEQ ID NO: 40992 - DNA, 20 bp, Hepatitis C virus
ttctttgagtggcagaagat

SEQ ID NO: 40993 - DNA, 20 bp, Hepatitis C virus
gtggcaccgggggagcgccc

SEQ ID NO: 40994 - DNA, 20 bp, Hepatitis C virus
tggcaccgggggagcgcccc

SEQ ID NO: 40995 - DNA, 20 bp, Hepatitis C virus
gactcgtccgtcctctgtga

SEQ ID NO: 40996 - DNA, 20 bp, Hepatitis C virus
gatccgccttaaacccaccc

SEQ ID NO: 40997 - DNA, 20 bp, Hepatitis C virus
atccgccttaaacccaccct

SEQ ID NO: 40998 - DNA, 20 bp, Hepatitis C virus
aacccaccctccatgggcca

SEQ ID NO: 40999 - DNA, 20 bp, Hepatitis C virus
agaatgaagtcaccctgacg

SEQ ID NO: 41000 - DNA, 20 bp, Hepatitis C virus
ggtgattgggtgcgtcaggg

SEQ ID NO: 41001 - DNA, 20 bp, Hepatitis C virus
ccgtacatcgagcaagggat

SEQ ID NO: 41002 - DNA, 20 bp, Hepatitis C virus
aagcagaaggccctcggcct

SEQ ID NO: 41003 - DNA, 20 bp, Hepatitis C virus
tcacccctgctgtccagacc

SEQ ID NO: 41004 - DNA, 20 bp, Hepatitis C virus
gtctggacagcaggggtgat

SEQ ID NO: 41005 - DNA, 20 bp, Hepatitis C virus
tgcttgaactgctcagcgag

SEQ ID NO: 41006 - DNA, 20 bp, Hepatitis C virus
gtgggtgctggcctagctgg

SEQ ID NO: 41007 - DNA, 20 bp, Hepatitis C virus
tgggtgctggcctagctggc

SEQ ID NO: 41008 - DNA, 20 bp, Hepatitis C virus
cccccacgcactacgtgccg

SEQ ID NO: 41009 - DNA, 20 bp, Hepatitis C virus
ccccacgcactacgtgccgg

SEQ ID NO: 41010 - DNA, 20 bp, Hepatitis C virus
cagtgaggctgctgagtatg

SEQ ID NO: 41011 - DNA, 20 bp, Hepatitis C virus
cccattaacgcctacaccac

SEQ ID NO: 41012 - DNA, 20 bp, Hepatitis C virus
acgcctacaccacgggcccc

SEQ ID NO: 41013 - DNA, 20 bp, Hepatitis C virus
atggggaacgtcccactcca

SEQ ID NO: 41014 - DNA, 20 bp, Hepatitis C virus
ctgcaggtcctaggaccgac

SEQ ID NO: 41015 - DNA, 20 bp, Hepatitis C virus
ttgacatgtccagtgatctc

SEQ ID NO: 41016 - DNA, 20 bp, Hepatitis C virus
cgcccccttgcaagcccttg

SEQ ID NO: 41017 - DNA, 20 bp, Hepatitis C virus
caagcccttgctgcgggagg

SEQ ID NO: 41018 - DNA, 20 bp, Hepatitis C virus
ctgcgggaggaggtatcatt

SEQ ID NO: 41019 - DNA, 20 bp, Hepatitis C virus
agagtaggactccacgagta

SEQ ID NO: 41020 - DNA, 20 bp, Hepatitis C virus
ccttgcgagcccgaaccgga

SEQ ID NO: 41021 - DNA, 20 bp, Hepatitis C virus
agtcagagaacaaagtggtg

SEQ ID NO: 41022 - DNA, 20 bp, Hepatitis C virus
tggactccttcgatccgctt

SEQ ID NO: 41023 - DNA, 20 bp, Hepatitis C virus
gatccgcttgtggcagagga

SEQ ID NO: 41024 - DNA, 20 bp, Hepatitis C virus
tggcagaggaggatgagcgg

SEQ ID NO: 41025 - DNA, 20 bp, Hepatitis C virus
cgcagaatttctgcaggtac

SEQ ID NO: 41026 - DNA, 20 bp, Hepatitis C virus
ccaccaaaagttttggcagc

SEQ ID NO: 41027 - DNA, 20 bp, Hepatitis C virus
tggcagctcctcaacttccg

SEQ ID NO: 41028 - DNA, 20 bp, Hepatitis C virus
ggcagctcctcaacttccgg

SEQ ID NO: 41029 - DNA, 20 bp, Hepatitis C virus
gcagctcctcaacttccggc

SEQ ID NO: 41030 - DNA, 20 bp, Hepatitis C virus
cggcattacgggcgacaata

SEQ ID NO: 41031 - DNA, 20 bp, Hepatitis C virus
caccacttcacgcagtgctt

SEQ ID NO: 41032 - DNA, 20 bp, Hepatitis C virus
acgcagtgcttgccaaaggc

SEQ ID NO: 41033 - DNA, 20 bp, Hepatitis C virus
ccaaaggcagaagaaagtca

SEQ ID NO: 41034 - DNA, 20 bp, Hepatitis C virus
gacagactgcaagttctgga

SEQ ID NO: 41035 - DNA, 20 bp, Hepatitis C virus
acagactgcaagttctggac

SEQ ID NO: 41036 - DNA, 20 bp, Hepatitis C virus
agcctgagaaggggggtcgt

SEQ ID NO: 41037 - DNA, 20 bp, Hepatitis C virus
cccgacctgggcgtgcgcgt

SEQ ID NO: 41038 - DNA, 20 bp, Hepatitis C virus
ctaaccacgtcgtacagggc

SEQ ID NO: 41039 - DNA, 20 bp, Hepatitis C virus
tcgcacacgcgcacgcccag

SEQ ID NO: 41040 - DNA, 20 bp, Hepatitis C virus
cgaccccccttctcaggctg

SEQ ID NO: 41041 - DNA, 20 bp, Hepatitis C virus
atgttgggggccctcttacc

SEQ ID NO: 41042 - DNA, 20 bp, Hepatitis C virus
tgttgggggccctcttacca

SEQ ID NO: 41043 - DNA, 20 bp, Hepatitis C virus
ggggccctcttaccaattca

SEQ ID NO: 41044 - DNA, 20 bp, Hepatitis C virus
ccaattcaaggggggaaaac

SEQ ID NO: 41045 - DNA, 20 bp, Hepatitis C virus
aaggggggaaaactgcggct

SEQ ID NO: 41046 - DNA, 20 bp, Hepatitis C virus
cccgtgaccctacaaccccc

SEQ ID NO: 41047 - DNA, 20 bp, Hepatitis C virus
tgttgcctagccaggaattg

SEQ ID NO: 41048 - DNA, 20 bp, Hepatitis C virus
cctagccaggaattgactgg

SEQ ID NO: 41049 - DNA, 20 bp, Hepatitis C virus
actggagtgtgtcttgctgt

SEQ ID NO: 41050 - DNA, 20 bp, Hepatitis C virus
ctgtctcccacgcggctctc

SEQ ID NO: 41051 - DNA, 20 bp, Hepatitis C virus
tcactccacagttactctcc

SEQ ID NO: 41052 - DNA, 20 bp, Hepatitis C virus
cactccacagttactctcca

SEQ ID NO: 41053 - DNA, 20 bp, Hepatitis C virus
actccacagttactctccag

SEQ ID NO: 41054 - DNA, 20 bp, Hepatitis C virus
ctctccaggtgaaatcaata

SEQ ID NO: 41055 - DNA, 20 bp, Hepatitis C virus
gggtcccgcccttgcgagct

SEQ ID NO: 41056 - DNA, 20 bp, Influenza A virus
aatccaatgattgtcgagct

SEQ ID NO: 41057 - DNA, 20 bp, Influenza A virus
tcgagcttgcggaaaaggca

SEQ ID NO: 41058 - DNA, 20 bp, Influenza A virus
cggaaaaggcaatgaaagaa

SEQ ID NO: 41059 - DNA, 20 bp, Influenza A virus
cggcaaatttgttcgtttcg

SEQ ID NO: 41060 - DNA, 20 bp, Influenza A virus
gttcgtttcgattttcggat

SEQ ID NO: 41061 - DNA, 20 bp, Influenza A virus
agaagcctaaatttctccca

SEQ ID NO: 41062 - DNA, 20 bp, Influenza A virus
ctcccagatttgtatgacta

SEQ ID NO: 41063 - DNA, 20 bp, Influenza A virus
tcccagatttgtatgactac

SEQ ID NO: 41064 - DNA, 20 bp, Influenza A virus
gtatgactacaaggagaacc

SEQ ID NO: 41065 - DNA, 20 bp, Influenza A virus
tatgactacaaggagaaccg

SEQ ID NO: 41066 - DNA, 20 bp, Influenza A virus
aaaacgaggagaaaattcca

SEQ ID NO: 41067 - DNA, 20 bp, Influenza A virus
caaagacaaagaacatgagg

SEQ ID NO: 41068 - DNA, 20 bp, Influenza A virus
aagtgggcacttggtgagaa

SEQ ID NO: 41069 - DNA, 20 bp, Influenza A virus
tcaccaagtgcccacttcaa

SEQ ID NO: 41070 - DNA, 20 bp, Influenza A virus
aattggcttgttttcctcat

SEQ ID NO: 41071 - DNA, 20 bp, Influenza A virus
aacttgatgaaataggggaa

SEQ ID NO: 41072 - DNA, 20 bp, Influenza A virus
atgaaataggggaagacgtt

SEQ ID NO: 41073 - DNA, 20 bp, Influenza A virus
ctccaattgagcacattgca

SEQ ID NO: 41074 - DNA, 20 bp, Influenza A virus
agcacattgcaagtatgaga

SEQ ID NO: 41075 - DNA, 20 bp, Influenza A virus
caagtatgagaaggaactat

SEQ ID NO: 41076 - DNA, 20 bp, Influenza A virus
gtgagtatggaattctctct

SEQ ID NO: 41077 - DNA, 20 bp, Influenza A virus
tgagtatggaattctctctt

SEQ ID NO: 41078 - DNA, 20 bp, Influenza A virus
tctcttactgatccgaggct

SEQ ID NO: 41079 - DNA, 20 bp, Influenza A virus
ctgatccgaggctggagcca

SEQ ID NO: 41080 - DNA, 20 bp, Influenza A virus
tcccatctgtgtggctccag

SEQ ID NO: 41081 - DNA, 20 bp, Influenza A virus
aacagattgagagcatgatt

SEQ ID NO: 41082 - DNA, 20 bp, Influenza A virus
agagcatgattgaggccgag

SEQ ID NO: 41083 - DNA, 20 bp, Influenza A virus
aggccgagtcttctgtcaaa

SEQ ID NO: 41084 - DNA, 20 bp, Influenza A virus
tgtcaaagaaaaagacatga

SEQ ID NO: 41085 - DNA, 20 bp, Influenza A virus
tttgaaaacaaatcagaaac

SEQ ID NO: 41086 - DNA, 20 bp, Influenza A virus
atgctaatgcccaagcagaa

SEQ ID NO: 41087 - DNA, 20 bp, Influenza A virus
gcatcagaatagaccaggca

SEQ ID NO: 41088 - DNA, 20 bp, Influenza A virus
catcagaatagaccaggcaa

SEQ ID NO: 41089 - DNA, 20 bp, Influenza A virus
caacatgatgttcttatcca

SEQ ID NO: 41090 - DNA, 20 bp, Influenza A virus
aacatgatgttcttatccat

SEQ ID NO: 41091 - DNA, 20 bp, Influenza A virus
gagtctctaaaactctacag

SEQ ID NO: 41092 - DNA, 20 bp, Influenza A virus
gcttggagaagcagtaatga

SEQ ID NO: 41093 - DNA, 20 bp, Influenza A virus
gagaagcagtaatgagaatg

SEQ ID NO: 41094 - DNA, 20 bp, Influenza A virus
ctgttttggagtgagtggag

SEQ ID NO: 41095 - DNA, 20 bp, Influenza A virus
tgttttggagtgagtggagg

SEQ ID NO: 41096 - DNA, 20 bp, Human papillomavirus 54
tagaaaacagttatttgggg

SEQ ID NO: 41097 - DNA, 20 bp, Human papillomavirus 54
tttgggggcaatgtctgcta

SEQ ID NO: 41098 - DNA, 20 bp, Human papillomavirus 54
gggggcaatgtctgctactg

SEQ ID NO: 41099 - DNA, 20 bp, Human papillomavirus 54
ggggcaatgtctgctactga

SEQ ID NO: 41100 - DNA, 20 bp, Human papillomavirus 54
gtgcaaggtatgcaatattc

SEQ ID NO: 41101 - DNA, 20 bp, Human papillomavirus 54
aggatatagtccttgattta

SEQ ID NO: 41102 - DNA, 20 bp, Human papillomavirus 54
atttaaaaccagaaccgttt

SEQ ID NO: 41103 - DNA, 20 bp, Human papillomavirus 54
aaaaccagaaccgtttgacc

SEQ ID NO: 41104 - DNA, 20 bp, Human papillomavirus 54
aaaccagaaccgtttgacct

SEQ ID NO: 41105 - DNA, 20 bp, Human papillomavirus 54
gacctgtactgcagggagca

SEQ ID NO: 41106 - DNA, 20 bp, Human papillomavirus 54
tttgtggaagcaattgtaga

SEQ ID NO: 41107 - DNA, 20 bp, Human papillomavirus 54
ttgtggaagcaattgtagaa

SEQ ID NO: 41108 - DNA, 20 bp, Human papillomavirus 54
tgtggaagcaattgtagaac

SEQ ID NO: 41109 - DNA, 20 bp, Human papillomavirus 54
gtggaagcaattgtagaacg

SEQ ID NO: 41110 - DNA, 20 bp, Human papillomavirus 54
tggaagcaattgtagaacgt

SEQ ID NO: 41111 - DNA, 20 bp, Human papillomavirus 54
caaacagcgaaccctgtgta

SEQ ID NO: 41112 - DNA, 20 bp, Human papillomavirus 54
ggctttggctgaccgccgtc

SEQ ID NO: 41113 - DNA, 20 bp, Human papillomavirus 54
gctttggctgaccgccgtcc

SEQ ID NO: 41114 - DNA, 20 bp, Human papillomavirus 54
ggctgaccgccgtcctaggg

SEQ ID NO: 41115 - DNA, 20 bp, Human papillomavirus 54
gctgaccgccgtcctaggga

SEQ ID NO: 41116 - DNA, 20 bp, Human papillomavirus 54
atatgcgcaatgcattagat

SEQ ID NO: 41117 - DNA, 20 bp, Human papillomavirus 54
tatgcgcaatgcattagatg

SEQ ID NO: 41118 - DNA, 20 bp, Human papillomavirus 54
gatggcaatcctatgtgctt

SEQ ID NO: 41119 - DNA, 20 bp, Human papillomavirus 54
gatagaaaacatcgagctat

SEQ ID NO: 41120 - DNA, 20 bp, Human papillomavirus 54
atagaaaacatcgagctatg

SEQ ID NO: 41121 - DNA, 20 bp, Human papillomavirus 54
agatgtgtgccaggaaaggc

SEQ ID NO: 41122 - DNA, 20 bp, Human papillomavirus 54
gatgtgtgccaggaaaggct

SEQ ID NO: 41123 - DNA, 20 bp, Human papillomavirus 54
tagacctatatgaaaaagat

SEQ ID NO: 41124 - DNA, 20 bp, Human papillomavirus 54
attactatctttttcatata

SEQ ID NO: 41125 - DNA, 20 bp, Human papillomavirus 54
ttactatctttttcatatag

SEQ ID NO: 41126 - DNA, 20 bp, Human papillomavirus 54
cattagagacattgcaaaag

SEQ ID NO: 41127 - DNA, 20 bp, Human papillomavirus 54
gagacattgcaaaagacagt

SEQ ID NO: 41128 - DNA, 20 bp, Human papillomavirus 54
caaaagacagtatacagcac

SEQ ID NO: 41129 - DNA, 20 bp, Human papillomavirus 54
caggacacatgcctggaacg

SEQ ID NO: 41130 - DNA, 20 bp, Human papillomavirus 54
ttaagcaaccagttggtggt

SEQ ID NO: 41131 - DNA, 20 bp, Human papillomavirus 54
attatatggatgcagaacac

SEQ ID NO: 41132 - DNA, 20 bp, Human papillomavirus 54
ttatatggatgcagaacaca

SEQ ID NO: 41133 - DNA, 20 bp, Human papillomavirus 54
tatggatgcagaacacaaag

SEQ ID NO: 41134 - DNA, 20 bp, Human papillomavirus 54
tgtggattttaaaaaggaag

SEQ ID NO: 41135 - DNA, 20 bp, Human papillomavirus 54
taaaaaggaagcatctaagt

SEQ ID NO: 41136 - DNA, 20 bp, Human papillomavirus 54
caacagccttccagtcttat

SEQ ID NO: 41137 - DNA, 20 bp, Human papillomavirus 54
cagtcttataacatatgaca

SEQ ID NO: 41138 - DNA, 20 bp, Human papillomavirus 54
taacatatgacaatcctgta

SEQ ID NO: 41139 - DNA, 20 bp, Human papillomavirus 54
ccctacactttgagcagccc

SEQ ID NO: 41140 - DNA, 20 bp, Human papillomavirus 54
gagcagcccacaatacataa

SEQ ID NO: 41141 - DNA, 20 bp, Human papillomavirus 54
aggccctcatcaggtcacac

SEQ ID NO: 41142 - DNA, 20 bp, Human papillomavirus 54
ggccctcatcaggtcacacc

SEQ ID NO: 41143 - DNA, 20 bp, Human papillomavirus 54
gttcccgcacgtcctatatt

SEQ ID NO: 41144 - DNA, 20 bp, Human papillomavirus 54
ttcccgcacgtcctatattt

SEQ ID NO: 41145 - DNA, 20 bp, Human papillomavirus 54
ccgcacgtcctatatttcca

SEQ ID NO: 41146 - DNA, 20 bp, Human papillomavirus 54
atgtagctacctcaatttgt

SEQ ID NO: 41147 - DNA, 20 bp, Human papillomavirus 54
gtaaatatcctgattacctt

SEQ ID NO: 41148 - DNA, 20 bp, Human papillomavirus 54
taaatatcctgattacctta

SEQ ID NO: 41149 - DNA, 20 bp, Human papillomavirus 54
ccttaaaatggctgcagagg

SEQ ID NO: 41150 - DNA, 20 bp, Human papillomavirus 54
aaatggctgcagaggcatat

SEQ ID NO: 41151 - DNA, 20 bp, Human papillomavirus 54
aataagccatactggttaca

SEQ ID NO: 41152 - DNA, 20 bp, Human papillomavirus 54
ataagccatactggttacaa

SEQ ID NO: 41153 - DNA, 20 bp, Human papillomavirus 54
caacgggcccagggtcaaaa

SEQ ID NO: 41154 - DNA, 20 bp, Human papillomavirus 54
gttggggcaatcaggtgttt

SEQ ID NO: 41155 - DNA, 20 bp, Human papillomavirus 54
ttggggcaatcaggtgtttt

SEQ ID NO: 41156 - DNA, 20 bp, Human papillomavirus 54
tagaggactggaactttggt

SEQ ID NO: 41157 - DNA, 20 bp, Human papillomavirus 54
ggtataacccccccagctac

SEQ ID NO: 41158 - DNA, 20 bp, Human papillomavirus 54
gtataacccccccagctaca

SEQ ID NO: 41159 - DNA, 20 bp, Human papillomavirus 54
ggaggacacatataggtttg

SEQ ID NO: 41160 - DNA, 20 bp, Human papillomavirus 54
gaggacacatataggtttgt

SEQ ID NO: 41161 - DNA, 20 bp, Human T-lymphotropic virus 1
agtcgcgttctgccgcctcc

SEQ ID NO: 41162 - DNA, 20 bp, Human T-lymphotropic virus 1
tgccgcctcccgcctgtggt

SEQ ID NO: 41163 - DNA, 20 bp, Human T-lymphotropic virus 1
agagctcaggtcgagaccgg

SEQ ID NO: 41164 - DNA, 20 bp, Human T-lymphotropic virus 1
gagctcaggtcgagaccggg

SEQ ID NO: 41165 - DNA, 20 bp, Human T-lymphotropic virus 1
cctagacggcggacgtagtt

SEQ ID NO: 41166 - DNA, 20 bp, Human T-lymphotropic virus 1
tatagcactctccaggagag

SEQ ID NO: 41167 - DNA, 20 bp, Human T-lymphotropic virus 1
agtacacagttgggggctcg

SEQ ID NO: 41168 - DNA, 20 bp, Human T-lymphotropic virus 1
gtacacagttgggggctcgt

SEQ ID NO: 41169 - DNA, 20 bp, Human T-lymphotropic virus 1
ggggctcgtccgggattcga

SEQ ID NO: 41170 - DNA, 20 bp, Human T-lymphotropic virus 1
gagcgcccctttattcccta

SEQ ID NO: 41171 - DNA, 20 bp, Human T-lymphotropic virus 1
tacacatactcatccaaacc

SEQ ID NO: 41172 - DNA, 20 bp, Human T-lymphotropic virus 1
acacatactcatccaaaccc

SEQ ID NO: 41173 - DNA, 20 bp, Human T-lymphotropic virus 1
cacatactcatccaaaccca

SEQ ID NO: 41174 - DNA, 20 bp, Human T-lymphotropic virus 1
gtgggtcagaatccgggggg

SEQ ID NO: 41175 - DNA, 20 bp, Human T-lymphotropic virus 1
tgggtcagaatccggggggt

SEQ ID NO: 41176 - DNA, 20 bp, Human T-lymphotropic virus 1
cggtgcagcagtttgacccc

SEQ ID NO: 41177 - DNA, 20 bp, Human T-lymphotropic virus 1
gaccccactgccaaagacct

SEQ ID NO: 41178 - DNA, 20 bp, Human T-lymphotropic virus 1
accccactgccaaagacctc

SEQ ID NO: 41179 - DNA, 20 bp, Human T-lymphotropic virus 1
gaggtctttggcagtggggt

SEQ ID NO: 41180 - DNA, 20 bp, Human T-lymphotropic virus 1
ggcagtggggtcaaactgct

SEQ ID NO: 41181 - DNA, 20 bp, Human T-lymphotropic virus 1
gccgccctgccagggagtgc

SEQ ID NO: 41182 - DNA, 20 bp, Human T-lymphotropic virus 1
ctgggcctctatcctccaag

SEQ ID NO: 41183 - DNA, 20 bp, Human T-lymphotropic virus 1
gaggatagaggcccaggaag

SEQ ID NO: 41184 - DNA, 20 bp, Human T-lymphotropic virus 1
ggcactccctggcagggcgg

SEQ ID NO: 41185 - DNA, 20 bp, Human T-lymphotropic virus 1
gcactccctggcagggcggc

SEQ ID NO: 41186 - DNA, 20 bp, Human T-lymphotropic virus 1
gttgtccagcctaaaaaacc

SEQ ID NO: 41187 - DNA, 20 bp, Human T-lymphotropic virus 1
tccagcctaaaaaacccccc

SEQ ID NO: 41188 - DNA, 20 bp, Human T-lymphotropic virus 1
cggtgcgggaaagcaggcca

SEQ ID NO: 41189 - DNA, 20 bp, Human T-lymphotropic virus 1
cccgcaccggaagcacggct

SEQ ID NO: 41190 - DNA, 20 bp, Human T-lymphotropic virus 1
ccgcaccggaagcacggctg

SEQ ID NO: 41191 - DNA, 20 bp, Human T-lymphotropic virus 1
ccaatacaggcgccagctgt

SEQ ID NO: 41192 - DNA, 20 bp, Human T-lymphotropic virus 1
ggctagaacacctcccaagg

SEQ ID NO: 41193 - DNA, 20 bp, Human T-lymphotropic virus 1
ggaggtgttctagcccaagg

SEQ ID NO: 41194 - DNA, 20 bp, Human T-lymphotropic virus 1
tagcccaaggacagctggcg

SEQ ID NO: 41195 - DNA, 20 bp, Human T-lymphotropic virus 1
gcaagattacaggcggcctt

SEQ ID NO: 41196 - DNA, 20 bp, Human T-lymphotropic virus 1
ccagttaaaaaagccaatgg

SEQ ID NO: 41197 - DNA, 20 bp, Human T-lymphotropic virus 1
aaaaagccaatggaacctgg

SEQ ID NO: 41198 - DNA, 20 bp, Human T-lymphotropic virus 1
atccacgacctgcgggccac

SEQ ID NO: 41199 - DNA, 20 bp, Human T-lymphotropic virus 1
gagagttagtggcccgcagg

SEQ ID NO: 41200 - DNA, 20 bp, Human T-lymphotropic virus 1
gtggcccgcaggtcgtggat

SEQ ID NO: 41201 - DNA, 20 bp, Human T-lymphotropic virus 1
aaaaatagtcccaccctgtt

SEQ ID NO: 41202 - DNA, 20 bp, Human T-lymphotropic virus 1
aaaatagtcccaccctgttc

SEQ ID NO: 41203 - DNA, 20 bp, Human T-lymphotropic virus 1
gaaatgcagctggcccatat

SEQ ID NO: 41204 - DNA, 20 bp, Human T-lymphotropic virus 1
ggcaagccttcccccaatgc

SEQ ID NO: 41205 - DNA, 20 bp, Human T-lymphotropic virus 1
ccccaatgcactattcttca

SEQ ID NO: 41206 - DNA, 20 bp, Human T-lymphotropic virus 1
aagccctacttggcgagatt

SEQ ID NO: 41207 - DNA, 20 bp, Human T-lymphotropic virus 1
gcgagattcagtgggtctcc

SEQ ID NO: 41208 - DNA, 20 bp, Human T-lymphotropic virus 1
agtgggtctccaaaggaact

SEQ ID NO: 41209 - DNA, 20 bp, Human T-lymphotropic virus 1
cgccagccccttcacagtct

SEQ ID NO: 41210 - DNA, 20 bp, Human T-lymphotropic virus 1
acagtctctactgtgcctta

SEQ ID NO: 41211 - DNA, 20 bp, Human T-lymphotropic virus 1
tctggctacatgccccccta

SEQ ID NO: 41212 - DNA, 20 bp, Human T-lymphotropic virus 1
cctcagctgtgttattactc

SEQ ID NO: 41213 - DNA, 20 bp, Human T-lymphotropic virus 1
ttactcgacaaatacacctt

SEQ ID NO: 41214 - DNA, 20 bp, Human T-lymphotropic virus 1
ctcgacaaatacaccttgca

SEQ ID NO: 41215 - DNA, 20 bp, Human T-lymphotropic virus 1
caaggtgtatttgtcgagta

SEQ ID NO: 41216 - DNA, 20 bp, Human T-lymphotropic virus 1
caggccctcctgccccgctt

SEQ ID NO: 41217 - DNA, 20 bp, Human T-lymphotropic virus 1
aggccctcctgccccgctta

SEQ ID NO: 41218 - DNA, 20 bp, Human T-lymphotropic virus 1
ctatcgcgtaaggtcgtcta

SEQ ID NO: 41219 - DNA, 20 bp, Human T-lymphotropic virus 1
gcaccacgttcgcagccata

SEQ ID NO: 41220 - DNA, 20 bp, Human T-lymphotropic virus 1
caccacgttcgcagccatac

SEQ ID NO: 41221 - DNA, 20 bp, Human T-lymphotropic virus 1
cccaagacttcctcaatatg

SEQ ID NO: 41222 - DNA, 20 bp, Human T-lymphotropic virus 1
ccaagacttcctcaatatgt

SEQ ID NO: 41223 - DNA, 20 bp, Human T-lymphotropic virus 1
ctcaatatgtgtacctccct

SEQ ID NO: 41224 - DNA, 20 bp, Human T-lymphotropic virus 1
ctattcgccatactacccat

SEQ ID NO: 41225 - DNA, 20 bp, Human T-lymphotropic virus 1
gccatactacccatgtcccc

SEQ ID NO: 41226 - DNA, 20 bp, Human T-lymphotropic virus 1
aagaagctgccggcgctgct

SEQ ID NO: 41227 - DNA, 20 bp, Human T-lymphotropic virus 1
tgcccagtggatcccgtgga

SEQ ID NO: 41228 - DNA, 20 bp, Human T-lymphotropic virus 1
aggagcctccacgggatcca

SEQ ID NO: 41229 - DNA, 20 bp, Human T-lymphotropic virus 1
ccgggatgagagcagcgccg

SEQ ID NO: 41230 - DNA, 20 bp, Human T-lymphotropic virus 1
gagtctcctcataccactct

SEQ ID NO: 41231 - DNA, 20 bp, Human T-lymphotropic virus 1
gttcatggaccctcgacctg

SEQ ID NO: 41232 - DNA, 20 bp, Human T-lymphotropic virus 1
ttcatggaccctcgacctgc

SEQ ID NO: 41233 - DNA, 20 bp, Human T-lymphotropic virus 1
atggaccctcgacctgctgg

SEQ ID NO: 41234 - DNA, 20 bp, Human T-lymphotropic virus 1
cagcagatcaggccctacag

SEQ ID NO: 41235 - DNA, 20 bp, Human T-lymphotropic virus 1
cttaaaatgcccatacctag

SEQ ID NO: 41236 - DNA, 20 bp, Human T-lymphotropic virus 1
aaatgcccatacctagggtg

SEQ ID NO: 41237 - DNA, 20 bp, Human T-lymphotropic virus 1
cagcaagatgtcaattttac

SEQ ID NO: 41238 - DNA, 20 bp, Human T-lymphotropic virus 1
agcaagatgtcaattttact

SEQ ID NO: 41239 - DNA, 20 bp, Human T-lymphotropic virus 1
agtaaaattgacatcttgct

SEQ ID NO: 41240 - DNA, 20 bp, Human T-lymphotropic virus 1
tccttgtcacctgttcccac

SEQ ID NO: 41241 - DNA, 20 bp, Human T-lymphotropic virus 1
ccttgtcacctgttcccacg

SEQ ID NO: 41242 - DNA, 20 bp, Human T-lymphotropic virus 1
cttgtcacctgttcccacgc

SEQ ID NO: 41243 - DNA, 20 bp, Human T-lymphotropic virus 1
tcacctgttcccacgctagg

SEQ ID NO: 41244 - DNA, 20 bp, Human T-lymphotropic virus 1
ccacgctaggatcccgctcc

SEQ ID NO: 41245 - DNA, 20 bp, Human T-lymphotropic virus 1
ttgcaaccacatcgcctcca

SEQ ID NO: 41246 - DNA, 20 bp, Human T-lymphotropic virus 1
caaccacatcgcctccagcc

SEQ ID NO: 41247 - DNA, 20 bp, Human T-lymphotropic virus 1
acctctcccatcaaatcctc

SEQ ID NO: 41248 - DNA, 20 bp, Human T-lymphotropic virus 1
tcctgcagcaacctcctccg

SEQ ID NO: 41249 - DNA, 20 bp, Human T-lymphotropic virus 1
gaggctgaacggaggaggtt

SEQ ID NO: 41250 - DNA, 20 bp, Human T-lymphotropic virus 1
tcctcttccttccttttcaa

SEQ ID NO: 41251 - DNA, 20 bp, Human T-lymphotropic virus 1
cttccttttcaaatactcag

SEQ ID NO: 41252 - DNA, 20 bp, Human T-lymphotropic virus 1
cttttcaaatactcagcaat

SEQ ID NO: 41253 - DNA, 20 bp, Human T-lymphotropic virus 1
tcaaatactcagcaatctgc

SEQ ID NO: 41254 - DNA, 20 bp, Human T-lymphotropic virus 1
caaatactcagcaatctgct

SEQ ID NO: 41255 - DNA, 20 bp, Human T-lymphotropic virus 1
ctccaccagcaggtcctccg

SEQ ID NO: 41256 - DNA, 20 bp, Human T-lymphotropic virus 1
accatgcttattatcagccc

SEQ ID NO: 41257 - DNA, 20 bp, Human T-lymphotropic virus 1
ttatcagcccacttcccagg

SEQ ID NO: 41258 - DNA, 20 bp, Human T-lymphotropic virus 1
tcagcccacttcccagggtt

SEQ ID NO: 41259 - DNA, 20 bp, Human T-lymphotropic virus 1
ccagggtttggacagagtct

SEQ ID NO: 41260 - DNA, 20 bp, Human T-lymphotropic virus 1
tcggctcagctctacagttc

SEQ ID NO: 41261 - DNA, 20 bp, Human T-lymphotropic virus 1
cttatccctcgactcccctc

SEQ ID NO: 41262 - DNA, 20 bp, Human T-lymphotropic virus 1
tccctcgactcccctccttc

SEQ ID NO: 41263 - DNA, 20 bp, Human T-lymphotropic virus 1
cccacccagagaacctctaa

SEQ ID NO: 41264 - DNA, 20 bp, Human T-lymphotropic virus 1
aggtccttaccccgccaatc

SEQ ID NO: 41265 - DNA, 20 bp, Human T-lymphotropic virus 1
ccgggccctgccctaaagat

SEQ ID NO: 41266 - DNA, 20 bp, Human T-lymphotropic virus 1
cgggccctgccctaaagatg

SEQ ID NO: 41267 - DNA, 20 bp, Human T-lymphotropic virus 1
agtactacagtcctcctcct

SEQ ID NO: 41268 - DNA, 20 bp, Human T-lymphotropic virus 1
gtactacagtcctcctcctt

SEQ ID NO: 41269 - DNA, 20 bp, Human T-lymphotropic virus 1
atatttcacaaatttcaaac

SEQ ID NO: 41270 - DNA, 20 bp, Human T-lymphotropic virus 1
ccggtggcttcccggaggtc

SEQ ID NO: 41271 - DNA, 20 bp, Human T-lymphotropic virus 1
ccggaggtctgagcttatga

SEQ ID NO: 41272 - DNA, 20 bp, Human T-lymphotropic virus 1
tgatttgtctttagggggac

SEQ ID NO: 41273 - DNA, 20 bp, Human T-lymphotropic virus 1
gtctttagggggacacgtca

SEQ ID NO: 41274 - DNA, 20 bp, Human T-lymphotropic virus 1
tctttagggggacacgtcag

SEQ ID NO: 41275 - DNA, 20 bp, Human T-lymphotropic virus 1
aggagggggctcgcatctct

SEQ ID NO: 41276 - DNA, 20 bp, Human T-lymphotropic virus 1
acgcgcccgccgccttacct

SEQ ID NO: 41277 - DNA, 20 bp, Human T-lymphotropic virus 1
cctgaggccgccatccacgc

SEQ ID NO: 41278 - DNA, 20 bp, Human T-lymphotropic virus 1
agtcgcgttctgccgcctcc

SEQ ID NO: 41279 - DNA, 20 bp, Human T-lymphotropic virus 1
tgccgcctcccgcctgtggt

SEQ ID NO: 41280 - DNA, 20 bp, Influenza A virus
agaagtacacatcagggaga

SEQ ID NO: 41281 - DNA, 20 bp, Influenza A virus
catcctaagtgacgggttct

SEQ ID NO: 41282 - DNA, 20 bp, Influenza A virus
atcctaagtgacgggttctt

SEQ ID NO: 41283 - DNA, 20 bp, Influenza A virus
ttttcctgtctccctgatgt

SEQ ID NO: 41284 - DNA, 20 bp, Influenza A virus
tcctgtctccctgatgtgta

SEQ ID NO: 41285 - DNA, 20 bp, Influenza A virus
ggcagtgacatggtggaata

SEQ ID NO: 41286 - DNA, 20 bp, Influenza A virus
gcagtgacatggtggaatag

SEQ ID NO: 41287 - DNA, 20 bp, Influenza A virus
attatccaaaaatctacaag

SEQ ID NO: 41288 - DNA, 20 bp, Influenza A virus
tccaaaaatctacaagactt

SEQ ID NO: 41289 - DNA, 20 bp, Influenza A virus
ttttgagaaagtcgaaaggt

SEQ ID NO: 41290 - DNA, 20 bp, Influenza A virus
acaataaccaaagagaaaaa

SEQ ID NO: 41291 - DNA, 20 bp, Influenza A virus
caaaatttctcctttgatgg

SEQ ID NO: 41292 - DNA, 20 bp, Influenza A virus
ctcctttgatggttgcatac

SEQ ID NO: 41293 - DNA, 20 bp, Influenza A virus
tcctttgatggttgcataca

SEQ ID NO: 41294 - DNA, 20 bp, Influenza A virus
gatggttgcatacatgttag

SEQ ID NO: 41295 - DNA, 20 bp, Influenza A virus
attggagatgtgccacagca

SEQ ID NO: 41296 - DNA, 20 bp, Influenza A virus
ttggagatgtgccacagcac

SEQ ID NO: 41297 - DNA, 20 bp, Influenza A virus
gagatgtgccacagcacaca

SEQ ID NO: 41298 - DNA, 20 bp, Influenza A virus
tcccgccaatctgtgtgctg

SEQ ID NO: 41299 - DNA, 20 bp, Influenza A virus
cgggcaatctccaaacattg

SEQ ID NO: 41300 - DNA, 20 bp, Influenza A virus
aaaataagggtgcatgaggg

SEQ ID NO: 41301 - DNA, 20 bp, Influenza A virus
acaatggtggggaaaagggc

SEQ ID NO: 41302 - DNA, 20 bp, Influenza A virus
gttcagctgatagtgagtgg

SEQ ID NO: 41303 - DNA, 20 bp, Influenza A virus
cactcactatcagctgaacc

SEQ ID NO: 41304 - DNA, 20 bp, Influenza A virus
aatcccatgcatcaactttt

SEQ ID NO: 41305 - DNA, 20 bp, Influenza A virus
taagacattttcagaaagat

SEQ ID NO: 41306 - DNA, 20 bp, Influenza A virus
aagacattttcagaaagatg

SEQ ID NO: 41307 - DNA, 20 bp, Influenza A virus
agacattttcagaaagatgc

SEQ ID NO: 41308 - DNA, 20 bp, Influenza A virus
tcagaaagatgcaaaagtgc

SEQ ID NO: 41309 - DNA, 20 bp, Influenza A virus
gagaccaacgaggaaatgta

SEQ ID NO: 41310 - DNA, 20 bp, Influenza A virus
ctcatcgtcaatgatgtggg

SEQ ID NO: 41311 - DNA, 20 bp, Influenza A virus
acgatgagtaagttattgtc

SEQ ID NO: 41312 - DNA, 20 bp, Influenza A virus
ttgtcagtttctctgtcccc

SEQ ID NO: 41313 - DNA, 20 bp, Influenza A virus
tcagtttctctgtcccctgt

SEQ ID NO: 41314 - DNA, 20 bp, Influenza A virus
gaggccaatacagtggattt

SEQ ID NO: 41315 - DNA, 20 bp, Influenza A virus
gttaggactctattccaaca

SEQ ID NO: 41316 - DNA, 20 bp, Influenza A virus
ttaggactctattccaacaa

SEQ ID NO: 41317 - DNA, 20 bp, Influenza A virus
ggactctattccaacaaatg

SEQ ID NO: 41318 - DNA, 20 bp, Influenza A virus
caacaaatgagggatgtact

SEQ ID NO: 41319 - DNA, 20 bp, Influenza A virus
aactgaagacccagatgaag

SEQ ID NO: 41320 - DNA, 20 bp, Influenza A virus
actgaagacccagatgaagg

SEQ ID NO: 41321 - DNA, 20 bp, Influenza A virus
tgagaggattcctcattctg

SEQ ID NO: 41322 - DNA, 20 bp, Influenza A virus
ctcattctgggcaaggaaga

SEQ ID NO: 41323 - DNA, 20 bp, Influenza A virus
tgggcaaggaagatagaaga

SEQ ID NO: 41324 - DNA, 20 bp, Influenza A virus
gtatcagaatggaccaggcg

SEQ ID NO: 41325 - DNA, 20 bp, Influenza A virus
tatcagaatggaccaggcga

SEQ ID NO: 41326 - DNA, 20 bp, Influenza A virus
cagtatgatgtttttatcca

SEQ ID NO: 41327 - DNA, 20 bp, Influenza A virus
agtatgatgtttttatccat

SEQ ID NO: 41328 - DNA, 20 bp, Influenza A virus
ttatccatgatcgcctggtc

SEQ ID NO: 41329 - DNA, 20 bp, Influenza A virus
gagtcctcatcggaggactt

SEQ ID NO: 41330 - DNA, 20 bp, Influenza A virus
aatggaatgataacacagtt

SEQ ID NO: 41331 - DNA, 20 bp, Influenza A virus
gagtctctgaaactctacag

SEQ ID NO: 41332 - DNA, 20 bp, Influenza A virus
tccaagcgaatctctgtaga

SEQ ID NO: 41333 - DNA, 20 bp, Influenza A virus
cagagactcgaactgtgtta

SEQ ID NO: 41334 - DNA, 20 bp, Influenza A virus
ccttatactggagatcctcc

SEQ ID NO: 41335 - DNA, 20 bp, Influenza A virus
tactggagatcctccataca

SEQ ID NO: 41336 - DNA, 20 bp, Influenza A virus
gtgtgttctgtttactgtgt

SEQ ID NO: 41337 - DNA, 20 bp, Influenza A virus
tgtttactgtgtccatggtg

SEQ ID NO: 41338 - DNA, 20 bp, Influenza A virus
actgtgtccatggtgtatcc

SEQ ID NO: 41339 - DNA, 20 bp, Influenza A virus
gagaattcatgccttgaaac

SEQ ID NO: 41340 - DNA, 20 bp, Influenza A virus
agaattcatgccttgaaaca

SEQ ID NO: 41341 - DNA, 20 bp, Influenza A virus
atgccttgaaacaatggaag

SEQ ID NO: 41342 - DNA, 20 bp, Influenza A virus
aaacaatggaagttgttcaa

SEQ ID NO: 41343 - DNA, 20 bp, Influenza A virus
ttcaacaaacaagggtagat

SEQ ID NO: 41344 - DNA, 20 bp, Influenza A virus
aatacgatgaccaaagatgc

SEQ ID NO: 41345 - DNA, 20 bp, Influenza A virus
cctctctctgcatctttggt

SEQ ID NO: 41346 - DNA, 20 bp, Influenza A virus
ggtcatcgtatttaatgtca

SEQ ID NO: 41347 - DNA, 20 bp, Influenza A virus
gtcatcgtatttaatgtcag

SEQ ID NO: 41348 - DNA, 20 bp, Influenza A virus
aatgtcagtgctcttattag

SEQ ID NO: 41349 - DNA, 20 bp, Influenza A virus
tgagaaagatgatgactaat

SEQ ID NO: 41350 - DNA, 20 bp, Influenza A virus
acaagacacagagatttctt

SEQ ID NO: 41351 - DNA, 20 bp, Influenza A virus
ctttcacaatcactggggac

SEQ ID NO: 41352 - DNA, 20 bp, Influenza A virus
tttcacaatcactggggaca

SEQ ID NO: 41353 - DNA, 20 bp, Influenza A virus
cacaatcactggggacaaca

SEQ ID NO: 41354 - DNA, 20 bp, Influenza A virus
gagagtaaaagaatgaagat

SEQ ID NO: 41355 - DNA, 20 bp, Influenza A virus
gaacacaaataccagcagaa

SEQ ID NO: 41356 - DNA, 20 bp, Influenza A virus
acctgaagtacttcaatgaa

SEQ ID NO: 41357 - DNA, 20 bp, Influenza A virus
aatgaatcaacaaagaagaa

SEQ ID NO: 41358 - DNA, 20 bp, Influenza A virus
tcttctttgttgattcattg

SEQ ID NO: 41359 - DNA, 20 bp, Influenza A virus
tgctctcatagtgaatgcac

SEQ ID NO: 41360 - DNA, 20 bp, Influenza A virus
gctctcatagtgaatgcacc

SEQ ID NO: 41361 - DNA, 20 bp, Influenza A virus
ctctcatagtgaatgcacca

SEQ ID NO: 41362 - DNA, 20 bp, Influenza A virus
tattccctcatggtttggtg

SEQ ID NO: 41363 - DNA, 20 bp, Influenza A virus
cctcatggtttggtgcattc

SEQ ID NO: 41364 - DNA, 20 bp, Influenza A virus
gagtaacagtgataaagaac

SEQ ID NO: 41365 - DNA, 20 bp, Influenza A virus
gacctgcaacggcccagatg

SEQ ID NO: 41366 - DNA, 20 bp, Influenza A virus
aattgttcatcaaagactac

SEQ ID NO: 41367 - DNA, 20 bp, Influenza A virus
ttcatcaaagactacagata

SEQ ID NO: 41368 - DNA, 20 bp, Influenza A virus
atcaaagactacagatacac

SEQ ID NO: 41369 - DNA, 20 bp, Human herpesvirus 5
ggaaccatgggccgccaacc

SEQ ID NO: 41370 - DNA, 20 bp, Human herpesvirus 5
ctgttggcgcgccaacgcga

SEQ ID NO: 41371 - DNA, 20 bp, Human herpesvirus 5
gcgcgccaacgcgacggcct

SEQ ID NO: 41372 - DNA, 20 bp, Human herpesvirus 5
cgcggcagcgtacgacgttc

SEQ ID NO: 41373 - DNA, 20 bp, Human herpesvirus 5
cagtcagcgaggccgtcgcg

SEQ ID NO: 41374 - DNA, 20 bp, Human herpesvirus 5
gaacgaccatccgcgggaga

SEQ ID NO: 41375 - DNA, 20 bp, Human herpesvirus 5
ccacgcatccggatcacccc

SEQ ID NO: 41376 - DNA, 20 bp, Human herpesvirus 5
tgggcgtggagatgtggaga

SEQ ID NO: 41377 - DNA, 20 bp, Human herpesvirus 5
gggcgtggagatgtggagat

SEQ ID NO: 41378 - DNA, 20 bp, Human herpesvirus 5
ggcgtggagatgtggagatg

SEQ ID NO: 41379 - DNA, 20 bp, Human herpesvirus 5
tacaccctcagccacggttc

SEQ ID NO: 41380 - DNA, 20 bp, Human herpesvirus 5
acaatccccgaaactacgcc

SEQ ID NO: 41381 - DNA, 20 bp, Human herpesvirus 5
acgccgaaacgacccgcaca

SEQ ID NO: 41382 - DNA, 20 bp, Human herpesvirus 5
cggcgtgaagttggacggcg

SEQ ID NO: 41383 - DNA, 20 bp, Human herpesvirus 5
ggcgtgaagttggacggcgt

SEQ ID NO: 41384 - DNA, 20 bp, Human herpesvirus 5
cgccgccacgctgcttcacc

SEQ ID NO: 41385 - DNA, 20 bp, Human herpesvirus 5
gccgccacgctgcttcaccg

SEQ ID NO: 41386 - DNA, 20 bp, Human herpesvirus 5
accgatatccaataaaccca

SEQ ID NO: 41387 - DNA, 20 bp, Human herpesvirus 5
attggatatcggtgaagcag

SEQ ID NO: 41388 - DNA, 20 bp, Human herpesvirus 5
ttggatatcggtgaagcagc

SEQ ID NO: 41389 - DNA, 20 bp, Human herpesvirus 5
cccaatactctccaacaacg

SEQ ID NO: 41390 - DNA, 20 bp, Human herpesvirus 5
tacaccacatcgttggataa

SEQ ID NO: 41391 - DNA, 20 bp, Human herpesvirus 5
gataatacgactacagacat

SEQ ID NO: 41392 - DNA, 20 bp, Human herpesvirus 5
cgctggacgttatgtctgta

SEQ ID NO: 41393 - DNA, 20 bp, Human herpesvirus 5
gctggacgttatgtctgtag

SEQ ID NO: 41394 - DNA, 20 bp, Human herpesvirus 5
ttgcgttatcatctgctccc

SEQ ID NO: 41395 - DNA, 20 bp, Human herpesvirus 5
cgttatcatctgctcccgct

SEQ ID NO: 41396 - DNA, 20 bp, Human herpesvirus 5
tcatctgctcccgctgctac

SEQ ID NO: 41397 - DNA, 20 bp, Human herpesvirus 5
caagtcagagcggcgtcggt

SEQ ID NO: 41398 - DNA, 20 bp, Human herpesvirus 5
tgacacggcgaaacgccgtt

SEQ ID NO: 41399 - DNA, 20 bp, Human herpesvirus 5
cgccgtgtcataaccgacgc

SEQ ID NO: 41400 - DNA, 20 bp, Human herpesvirus 5
gccgtgtcataaccgacgcc

SEQ ID NO: 41401 - DNA, 20 bp, Human herpesvirus 5
gaatccggcgtgctgcatag

SEQ ID NO: 41402 - DNA, 20 bp, Human herpesvirus 5
gtgccgtcgccgcactgcgt

SEQ ID NO: 41403 - DNA, 20 bp, Human herpesvirus 5
tcactcgcgtcgtggctgac

SEQ ID NO: 41404 - DNA, 20 bp, Human herpesvirus 5
ctgcagtgtgtggtgattcg

SEQ ID NO: 41405 - DNA, 20 bp, Human herpesvirus 5
tgcagtgtgtggtgattcgg

SEQ ID NO: 41406 - DNA, 20 bp, Human herpesvirus 5
ggcacgttctgcgtccgcgt

SEQ ID NO: 41407 - DNA, 20 bp, Human herpesvirus 5
cgaggacggcggcgcggcgc

SEQ ID NO: 41408 - DNA, 20 bp, Human herpesvirus 5
gaggacggcggcgcggcgca

SEQ ID NO: 41409 - DNA, 20 bp, Human herpesvirus 5
cgtctcatcaccgagaccgc

SEQ ID NO: 41410 - DNA, 20 bp, Human herpesvirus 5
gtctcatcaccgagaccgcg

SEQ ID NO: 41411 - DNA, 20 bp, Human herpesvirus 5
cccagcacgcaggtgtaggt

SEQ ID NO: 41412 - DNA, 20 bp, Human herpesvirus 5
cggatcgcgctcacagacgc

SEQ ID NO: 41413 - DNA, 20 bp, Human herpesvirus 5
ggatcgcgctcacagacgcg

SEQ ID NO: 41414 - DNA, 20 bp, Human herpesvirus 5
cgcagtataaactgcggttg

SEQ ID NO: 41415 - DNA, 20 bp, Human herpesvirus 5
atactgcgcaacctggaggg

SEQ ID NO: 41416 - DNA, 20 bp, Human herpesvirus 5
tactgcgcaacctggaggga

SEQ ID NO: 41417 - DNA, 20 bp, Human herpesvirus 5
atcagccagagcatcgcgga

SEQ ID NO: 41418 - DNA, 20 bp, Human herpesvirus 5
ttgtccgcgatgctctggct

SEQ ID NO: 41419 - DNA, 20 bp, Human herpesvirus 5
tccgcgatgctctggctgat

SEQ ID NO: 41420 - DNA, 20 bp, Human herpesvirus 5
cgaatcgtaccggcgtctga

SEQ ID NO: 41421 - DNA, 20 bp, Human herpesvirus 5
tcccgcggcagtttcctccg

SEQ ID NO: 41422 - DNA, 20 bp, Human herpesvirus 5
cctccgccgcctcgttttcc

SEQ ID NO: 41423 - DNA, 20 bp, Human herpesvirus 5
ctccgccgcctcgttttcct

SEQ ID NO: 41424 - DNA, 20 bp, Human herpesvirus 5
tcctcttcggtgttcagacg

SEQ ID NO: 41425 - DNA, 20 bp, Human herpesvirus 5
acggtatttagccatgcagc

SEQ ID NO: 41426 - DNA, 20 bp, Human herpesvirus 5
agccatgcagcgtgcggcgc

SEQ ID NO: 41427 - DNA, 20 bp, Human herpesvirus 5
gccatgcagcgtgcggcgcc

SEQ ID NO: 41428 - DNA, 20 bp, Human herpesvirus 5
catagacgcagttccgttcc

SEQ ID NO: 41429 - DNA, 20 bp, Human herpesvirus 5
cgttcccggcgggtacgtca

SEQ ID NO: 41430 - DNA, 20 bp, Human herpesvirus 5
ccggcgggtacgtcaacggc

SEQ ID NO: 41431 - DNA, 20 bp, Human herpesvirus 5
atcatccgccaccacgggca

SEQ ID NO: 41432 - DNA, 20 bp, Human herpesvirus 5
atgccgttgacgtacccgcc

SEQ ID NO: 41433 - DNA, 20 bp, Human herpesvirus 5
cgggccaggtagtagacggc

SEQ ID NO: 41434 - DNA, 20 bp, Human herpesvirus 5
tttgctatgtacgcgaggac

SEQ ID NO: 41435 - DNA, 20 bp, Human herpesvirus 5
ttgctatgtacgcgaggaca

SEQ ID NO: 41436 - DNA, 20 bp, Human herpesvirus 5
tgctatgtacgcgaggacac

SEQ ID NO: 41437 - DNA, 20 bp, Human herpesvirus 5
gctatgtacgcgaggacacc

SEQ ID NO: 41438 - DNA, 20 bp, Human herpesvirus 5
gcgaaaccgcgacagttctc

SEQ ID NO: 41439 - DNA, 20 bp, Human herpesvirus 5
cgaaaccgcgacagttctcg

SEQ ID NO: 41440 - DNA, 20 bp, Human herpesvirus 5
tcgacgttgcacggggttct

SEQ ID NO: 41441 - DNA, 20 bp, Human herpesvirus 5
cacggggttctgagcgagtc

SEQ ID NO: 41442 - DNA, 20 bp, Human herpesvirus 5
tgagcgagtcccttgcgcag

SEQ ID NO: 41443 - DNA, 20 bp, Human herpesvirus 5
ctcgattacaagacctttgg

SEQ ID NO: 41444 - DNA, 20 bp, Human herpesvirus 5
caagacctttgggacgcgca

SEQ ID NO: 41445 - DNA, 20 bp, Human herpesvirus 5
gggacgcgcacccattactt

SEQ ID NO: 41446 - DNA, 20 bp, Human herpesvirus 5
ggacgcgcacccattacttg

SEQ ID NO: 41447 - DNA, 20 bp, Human herpesvirus 5
cttgcggcagctatgctcga

SEQ ID NO: 41448 - DNA, 20 bp, Human herpesvirus 5
acggcgcgagagcccgtcgt

SEQ ID NO: 41449 - DNA, 20 bp, Human herpesvirus 5
gtgcacgatctccggggcat

SEQ ID NO: 41450 - DNA, 20 bp, Human herpesvirus 5
tgcacgatctccggggcatg

SEQ ID NO: 41451 - DNA, 20 bp, Human herpesvirus 5
tgccgcgcgggtcgcgtgtt

SEQ ID NO: 41452 - DNA, 20 bp, Human herpesvirus 5
gccgcgcgggtcgcgtgttg

SEQ ID NO: 41453 - DNA, 20 bp, Human herpesvirus 5
atcagactgcgtacgctttg

SEQ ID NO: 41454 - DNA, 20 bp, Human herpesvirus 5
ggagcgtcagacccagggcg

SEQ ID NO: 41455 - DNA, 20 bp, Human herpesvirus 5
gagcgtcagacccagggcgc

SEQ ID NO: 41456 - DNA, 20 bp, Human herpesvirus 5
gaggactttgccgcctttta

SEQ ID NO: 41457 - DNA, 20 bp, Human herpesvirus 5
gccgccttttatcgcaccct

SEQ ID NO: 41458 - DNA, 20 bp, Human herpesvirus 5
accgttcggcctcgcacctg

SEQ ID NO: 41459 - DNA, 20 bp, Human herpesvirus 5
gcgtggcgcacgcagcggcc

SEQ ID NO: 41460 - DNA, 20 bp, Human herpesvirus 5
tcgcggtccgcgtcgcgtag

SEQ ID NO: 41461 - DNA, 20 bp, Human herpesvirus 5
acgacgaggaaaccatgcgg

SEQ ID NO: 41462 - DNA, 20 bp, Human herpesvirus 5
cgacgaggaaaccatgcggc

SEQ ID NO: 41463 - DNA, 20 bp, Human herpesvirus 5
tctgcacacacaactggtca

SEQ ID NO: 41464 - DNA, 20 bp, Human herpesvirus 5
ctgcacacacaactggtcat

SEQ ID NO: 41465 - DNA, 20 bp, Human herpesvirus 5
tgcacacacaactggtcatg

SEQ ID NO: 41466 - DNA, 20 bp, Human herpesvirus 5
tccttctacctgctgacgag

SEQ ID NO: 41467 - DNA, 20 bp, Human herpesvirus 5
ccttctacctgctgacgagc

SEQ ID NO: 41468 - DNA, 20 bp, Human herpesvirus 5
cttctacctgctgacgagcg

SEQ ID NO: 41469 - DNA, 20 bp, Human herpesvirus 5
tacctgctgacgagcgcgca

SEQ ID NO: 41470 - DNA, 20 bp, Human herpesvirus 5
agccgcaacccgtcactctt

SEQ ID NO: 41471 - DNA, 20 bp, Human herpesvirus 5
ttgctgcgggatgttcaagg

SEQ ID NO: 41472 - DNA, 20 bp, Human herpesvirus 5
ctgcgggatgttcaagggac

SEQ ID NO: 41473 - DNA, 20 bp, Human herpesvirus 5
aagggaccgctggtcggttt

SEQ ID NO: 41474 - DNA, 20 bp, Human herpesvirus 5
ctgactgcccgaggataaca

SEQ ID NO: 41475 - DNA, 20 bp, Human herpesvirus 5
tgactgcccgaggataacag

SEQ ID NO: 41476 - DNA, 20 bp, Human herpesvirus 5
gccagaatgaccgcgcttac

SEQ ID NO: 41477 - DNA, 20 bp, Human herpesvirus 5
cgagcgcgcgctccacgatc

SEQ ID NO: 41478 - DNA, 20 bp, Human herpesvirus 5
gatacggacgtgcgccacga

SEQ ID NO: 41479 - DNA, 20 bp, Human herpesvirus 5
tggccaagatgtcggtgcgc

SEQ ID NO: 41480 - DNA, 20 bp, Human herpesvirus 5
aaccagctggttttcacggc

SEQ ID NO: 41481 - DNA, 20 bp, Human herpesvirus 5
tcacggcccagctgcgccac

SEQ ID NO: 41482 - DNA, 20 bp, Human herpesvirus 5
cacggcccagctgcgccact

SEQ ID NO: 41483 - DNA, 20 bp, Human herpesvirus 5
acggcccagctgcgccacta

SEQ ID NO: 41484 - DNA, 20 bp, Human herpesvirus 5
ggtcaactcgtcgcgcgcgt

SEQ ID NO: 41485 - DNA, 20 bp, Human herpesvirus 5
gtggggctgctcaactttgg

SEQ ID NO: 41486 - DNA, 20 bp, Human herpesvirus 5
tggggctgctcaactttggc

SEQ ID NO: 41487 - DNA, 20 bp, Human herpesvirus 5
ggcgtgcccagccccgtata

SEQ ID NO: 41488 - DNA, 20 bp, Human herpesvirus 5
gcgtgcccagccccgtatac

SEQ ID NO: 41489 - DNA, 20 bp, Human herpesvirus 5
gtggacttccaggtgcgcaa

SEQ ID NO: 41490 - DNA, 20 bp, Human herpesvirus 5
agacgcggctgcttagaggg

SEQ ID NO: 41491 - DNA, 20 bp, Human herpesvirus 5
gagggctcatccgactctgc

SEQ ID NO: 41492 - DNA, 20 bp, Human herpesvirus 5
acgccggtttgcgcagcgcg

SEQ ID NO: 41493 - DNA, 20 bp, Human herpesvirus 5
gcgcagcgcggcagagtcgg

SEQ ID NO: 41494 - DNA, 20 bp, Human herpesvirus 5
cgcagcgcggcagagtcgga

SEQ ID NO: 41495 - DNA, 20 bp, Human herpesvirus 5
aggccctgtgtgacagccca

SEQ ID NO: 41496 - DNA, 20 bp, Human herpesvirus 5
cagtagtcgtcatactgcac

SEQ ID NO: 41497 - DNA, 20 bp, Human herpesvirus 5
tctgcggcatggctttcgtc

SEQ ID NO: 41498 - DNA, 20 bp, Human herpesvirus 5
ctgcggcatggctttcgtca

SEQ ID NO: 41499 - DNA, 20 bp, Human herpesvirus 5
tgcggcatggctttcgtcac

SEQ ID NO: 41500 - DNA, 20 bp, Human herpesvirus 5
cgtcactgcgaccacttcca

SEQ ID NO: 41501 - DNA, 20 bp, Human herpesvirus 5
accgacttggcaaaagtgcg

SEQ ID NO: 41502 - DNA, 20 bp, Human herpesvirus 5
gcaaaagtgcgcggcccctc

SEQ ID NO: 41503 - DNA, 20 bp, Human herpesvirus 5
ttgtcgcgacgcgcttccag

SEQ ID NO: 41504 - DNA, 20 bp, Human herpesvirus 5
tcgcgacgcgcttccagcac

SEQ ID NO: 41505 - DNA, 20 bp, Human herpesvirus 5
tgccaagtcggtgaacagct

SEQ ID NO: 41506 - DNA, 20 bp, Human herpesvirus 5
caatactccagcactatggc

SEQ ID NO: 41507 - DNA, 20 bp, Human herpesvirus 5
gcctacgactccggtatcct

SEQ ID NO: 41508 - DNA, 20 bp, Human herpesvirus 5
ttcctggcgcccagcatggc

SEQ ID NO: 41509 - DNA, 20 bp, Human herpesvirus 5
tcctggcgcccagcatggcg

SEQ ID NO: 41510 - DNA, 20 bp, Human herpesvirus 5
cctggcgcccagcatggcgc

SEQ ID NO: 41511 - DNA, 20 bp, Human herpesvirus 5
acgcacagtttccgagtacg

SEQ ID NO: 41512 - DNA, 20 bp, Human herpesvirus 5
ccgagtacgcgcgtctcgga

SEQ ID NO: 41513 - DNA, 20 bp, Human herpesvirus 5
cgagtacgcgcgtctcggag

SEQ ID NO: 41514 - DNA, 20 bp, Human herpesvirus 5
tcccctatccgcgtgagttg

SEQ ID NO: 41515 - DNA, 20 bp, Human herpesvirus 5
ggtggttcaccgtcaggtgc

SEQ ID NO: 41516 - DNA, 20 bp, Human herpesvirus 5
ctggaggtctggcggcagca

SEQ ID NO: 41517 - DNA, 20 bp, Human herpesvirus 5
ccacgccaccgccgccacca

SEQ ID NO: 41518 - DNA, 20 bp, Human herpesvirus 5
cacgccaccgccgccaccac

SEQ ID NO: 41519 - DNA, 20 bp, Human herpesvirus 5
ttcgcgcagcggcgcgtagt

SEQ ID NO: 41520 - DNA, 20 bp, Human herpesvirus 5
gcgcagcggcgcgtagttgc

SEQ ID NO: 41521 - DNA, 20 bp, Human herpesvirus 5
cgcaggccctcctgcacgaa

SEQ ID NO: 41522 - DNA, 20 bp, Human herpesvirus 5
ccgcggcttcgtgcaggagg

SEQ ID NO: 41523 - DNA, 20 bp, Human herpesvirus 5
cgcggcttcgtgcaggaggg

SEQ ID NO: 41524 - DNA, 20 bp, Human herpesvirus 5
ccctcctcctggtgctgctc

SEQ ID NO: 41525 - DNA, 20 bp, Human herpesvirus 5
accacgggcacgcgcagcgg

SEQ ID NO: 41526 - DNA, 20 bp, Human herpesvirus 5
cgcgtggttggagcagcacc

SEQ ID NO: 41527 - DNA, 20 bp, Human herpesvirus 5
gagcagcaccaggaggaggg

SEQ ID NO: 41528 - DNA, 20 bp, Human herpesvirus 5
cgcaatccgaactcgagcat

SEQ ID NO: 41529 - DNA, 20 bp, Human herpesvirus 5
ggattgcgcaactgtcagtt

SEQ ID NO: 41530 - DNA, 20 bp, Human herpesvirus 5
cgcaactgtcagtttctggc

SEQ ID NO: 41531 - DNA, 20 bp, Human herpesvirus 5
ctggcggtgggtcccgacga

SEQ ID NO: 41532 - DNA, 20 bp, Human herpesvirus 5
tggcggtgggtcccgacgac

SEQ ID NO: 41533 - DNA, 20 bp, Human herpesvirus 5
ttccagcgcgctctctaccc

SEQ ID NO: 41534 - DNA, 20 bp, Human herpesvirus 5
tccagcgcgctctctaccca

SEQ ID NO: 41535 - DNA, 20 bp, Human herpesvirus 5
ccagcgcgctctctacccac

SEQ ID NO: 41536 - DNA, 20 bp, Human herpesvirus 5
cagcgcgctctctacccacc

SEQ ID NO: 41537 - DNA, 20 bp, Human herpesvirus 5
ggacgccgacattagcgcgt

SEQ ID NO: 41538 - DNA, 20 bp, Human herpesvirus 5
gcgacacaccttatccaaac

SEQ ID NO: 41539 - DNA, 20 bp, Human herpesvirus 5
tccaaacacaaaatggccgc

SEQ ID NO: 41540 - DNA, 20 bp, Human herpesvirus 5
cacaaaacgcgccgtctcct

SEQ ID NO: 41541 - DNA, 20 bp, Human herpesvirus 5
tgtggaattggccggttgct

SEQ ID NO: 41542 - DNA, 20 bp, Human herpesvirus 5
gtggaattggccggttgctg

SEQ ID NO: 41543 - DNA, 20 bp, Human herpesvirus 5
acaaagctacagcgctcgcg

SEQ ID NO: 41544 - DNA, 20 bp, Human herpesvirus 5
cacgcggaaagttcgcccgc

SEQ ID NO: 41545 - DNA, 20 bp, Human herpesvirus 5
gcccgcgagcgctgtagctt

SEQ ID NO: 41546 - DNA, 20 bp, Human herpesvirus 5
gtcaaccgtcgcatcacgcg

SEQ ID NO: 41547 - DNA, 20 bp, Human herpesvirus 5
tcaaccgtcgcatcacgcgc

SEQ ID NO: 41548 - DNA, 20 bp, Human herpesvirus 5
ccgttctaccacaacggggc

SEQ ID NO: 41549 - DNA, 20 bp, Human herpesvirus 5
taccacaacggggccacgct

SEQ ID NO: 41550 - DNA, 20 bp, Human herpesvirus 5
ccagaagctgttgcagaccc

SEQ ID NO: 41551 - DNA, 20 bp, Human herpesvirus 5
cagaagctgttgcagaccct

SEQ ID NO: 41552 - DNA, 20 bp, Human herpesvirus 5
tggaaagccgtcagcgtggc

SEQ ID NO: 41553 - DNA, 20 bp, Human herpesvirus 5
gtagaacagttgcgcgagct

SEQ ID NO: 41554 - DNA, 20 bp, Human herpesvirus 5
cgcgagctggttcgccgcga

SEQ ID NO: 41555 - DNA, 20 bp, Human herpesvirus 5
gccgcgatcggctgttggcc

SEQ ID NO: 41556 - DNA, 20 bp, Human herpesvirus 5
gccgagaatctgcgcggctt

SEQ ID NO: 41557 - DNA, 20 bp, Human herpesvirus 5
aacgagcgcctgctgagtgt

SEQ ID NO: 41558 - DNA, 20 bp, Human herpesvirus 5
aataggtcgctcgcggccag

SEQ ID NO: 41559 - DNA, 20 bp, Human herpesvirus 5
ataggtcgctcgcggccagg

SEQ ID NO: 41560 - DNA, 20 bp, Human herpesvirus 5
gtagcgcgcacccaggacct

SEQ ID NO: 41561 - DNA, 20 bp, Human herpesvirus 5
gactttctgcggtacgcgca

SEQ ID NO: 41562 - DNA, 20 bp, Human herpesvirus 5
ctgcggtacgcgcacgccaa

SEQ ID NO: 41563 - DNA, 20 bp, Human herpesvirus 5
tgcggtacgcgcacgccaaa

SEQ ID NO: 41564 - DNA, 20 bp, Human herpesvirus 5
ggcgtgcgcgtaccgcagaa

SEQ ID NO: 41565 - DNA, 20 bp, Human herpesvirus 5
gcgtgcgcgtaccgcagaaa

SEQ ID NO: 41566 - DNA, 20 bp, Human herpesvirus 5
ggcgtgcagctgtcgcccgc

SEQ ID NO: 41567 - DNA, 20 bp, Human herpesvirus 5
ctactatgaggccctttttc

SEQ ID NO: 41568 - DNA, 20 bp, Human herpesvirus 5
tactatgaggccctttttct

SEQ ID NO: 41569 - DNA, 20 bp, Human herpesvirus 5
tgaaagcgctgcagccgttg

SEQ ID NO: 41570 - DNA, 20 bp, Human herpesvirus 5
gacgacaacgccaagcagga

SEQ ID NO: 41571 - DNA, 20 bp, Human herpesvirus 5
cccaggcgaaagagttcctg

SEQ ID NO: 41572 - DNA, 20 bp, Human herpesvirus 5
ctgcttggcgttgtcgtcca

SEQ ID NO: 41573 - DNA, 20 bp, Human herpesvirus 5
gcgttgtcgtccaacggctg

SEQ ID NO: 41574 - DNA, 20 bp, Human herpesvirus 5
gtagaggcggcttagcgcga

SEQ ID NO: 41575 - DNA, 20 bp, Human herpesvirus 5
gcgcgagttgcgcgttctgt

SEQ ID NO: 41576 - DNA, 20 bp, Human herpesvirus 5
cgcgttctgtaggcgctgct

SEQ ID NO: 41577 - DNA, 20 bp, Human herpesvirus 5
tgtaggcgctgctgcacttc

SEQ ID NO: 41578 - DNA, 20 bp, Human herpesvirus 5
gggtagctgcaggccgccta

SEQ ID NO: 41579 - DNA, 20 bp, Human herpesvirus 5
ggcctagatcaacgcgccca

SEQ ID NO: 41580 - DNA, 20 bp, Human herpesvirus 5
aaccaggacttgctgtcggc

SEQ ID NO: 41581 - DNA, 20 bp, Human herpesvirus 5
ctgtcggcgctgcagcagct

SEQ ID NO: 41582 - DNA, 20 bp, Human herpesvirus 5
tttgctcagctgctgcagcg

SEQ ID NO: 41583 - DNA, 20 bp, Human herpesvirus 5
ttgctcagctgctgcagcgc

SEQ ID NO: 41584 - DNA, 20 bp, Human herpesvirus 5
tccatcagcgccttggcgtc

SEQ ID NO: 41585 - DNA, 20 bp, Human herpesvirus 5
ccatcagcgccttggcgtcg

SEQ ID NO: 41586 - DNA, 20 bp, Human herpesvirus 5
catcagcgccttggcgtcgg

SEQ ID NO: 41587 - DNA, 20 bp, Human herpesvirus 5
gcgtcgggggtggtcacgtc

SEQ ID NO: 41588 - DNA, 20 bp, Human herpesvirus 5
tgtggcgcgtgaccagatca

SEQ ID NO: 41589 - DNA, 20 bp, Human herpesvirus 5
cgcaaatcaccgcggaccct

SEQ ID NO: 41590 - DNA, 20 bp, Human herpesvirus 5
ctgttgcaggttccggtagt

SEQ ID NO: 41591 - DNA, 20 bp, Human herpesvirus 5
caggttccggtagtgggtcc

SEQ ID NO: 41592 - DNA, 20 bp, Human herpesvirus 5
cggtagtgggtcctgcttcc

SEQ ID NO: 41593 - DNA, 20 bp, Human herpesvirus 5
cgtgatgcgggtgcgtaggg

SEQ ID NO: 41594 - DNA, 20 bp, Human herpesvirus 5
aaccagcgcgcagcctcgac

SEQ ID NO: 41595 - DNA, 20 bp, Human herpesvirus 5
accagcgcgcagcctcgaca

SEQ ID NO: 41596 - DNA, 20 bp, Human herpesvirus 5
gctttccaaacagctgtcgc

SEQ ID NO: 41597 - DNA, 20 bp, Human herpesvirus 5
ccaaacagctgtcgcggtac

SEQ ID NO: 41598 - DNA, 20 bp, Human herpesvirus 5
caaacagctgtcgcggtact

SEQ ID NO: 41599 - DNA, 20 bp, Human herpesvirus 5
gccatgaccgcgccacagca

SEQ ID NO: 41600 - DNA, 20 bp, Human herpesvirus 5
tgctggtgctggctctgctg

SEQ ID NO: 41601 - DNA, 20 bp, Human herpesvirus 5
tcgtactcgccctcgttttc

SEQ ID NO: 41602 - DNA, 20 bp, Human herpesvirus 5
tcgggtccgaaggcgatgag

SEQ ID NO: 41603 - DNA, 20 bp, Human herpesvirus 5
cgggtccgaaggcgatgagc

SEQ ID NO: 41604 - DNA, 20 bp, Human herpesvirus 5
gggtccgaaggcgatgagct

SEQ ID NO: 41605 - DNA, 20 bp, Human herpesvirus 5
aacaccgacgccgaattgga

SEQ ID NO: 41606 - DNA, 20 bp, Human herpesvirus 5
tcctcctctccgtcgtcatc

SEQ ID NO: 41607 - DNA, 20 bp, Human herpesvirus 5
cctcctctccgtcgtcatcg

SEQ ID NO: 41608 - DNA, 20 bp, Human herpesvirus 5
ctcctctccgtcgtcatcgt

SEQ ID NO: 41609 - DNA, 20 bp, Human herpesvirus 5
ctggacgatgacgacggaga

SEQ ID NO: 41610 - DNA, 20 bp, Human herpesvirus 5
tggacgatgacgacggagag

SEQ ID NO: 41611 - DNA, 20 bp, Human herpesvirus 5
ccgcgccctcttctttgccg

SEQ ID NO: 41612 - DNA, 20 bp, Human herpesvirus 5
cgcgccctcttctttgccgg

SEQ ID NO: 41613 - DNA, 20 bp, Human herpesvirus 5
tttgccggctctcctcctct

SEQ ID NO: 41614 - DNA, 20 bp, Human herpesvirus 5
gccggctctcctcctctcct

SEQ ID NO: 41615 - DNA, 20 bp, Human herpesvirus 5
ccggctctcctcctctcctg

SEQ ID NO: 41616 - DNA, 20 bp, Human herpesvirus 5
tcgttggaaacgccgacgcc

SEQ ID NO: 41617 - DNA, 20 bp, Human herpesvirus 5
gaaacgccgacgccgccact

SEQ ID NO: 41618 - DNA, 20 bp, Human herpesvirus 5
tcagcgtcggctccggcagt

SEQ ID NO: 41619 - DNA, 20 bp, Human herpesvirus 5
cagcgtcggctccggcagta

SEQ ID NO: 41620 - DNA, 20 bp, Human herpesvirus 5
agcgtcggctccggcagtag

SEQ ID NO: 41621 - DNA, 20 bp, Human herpesvirus 5
ggtgacacggcaacactatt

SEQ ID NO: 41622 - DNA, 20 bp, Human herpesvirus 5
ccgtgtcacctaacgccgct

SEQ ID NO: 41623 - DNA, 20 bp, Human herpesvirus 5
tgtggcggctatgtttcaga

SEQ ID NO: 41624 - DNA, 20 bp, Human herpesvirus 5
gtgttcgtcgcagttgcgca

SEQ ID NO: 41625 - DNA, 20 bp, Human herpesvirus 5
gtcgcagttgcgcacccgta

SEQ ID NO: 41626 - DNA, 20 bp, Human herpesvirus 5
cgcacccgtaagccgttttc

SEQ ID NO: 41627 - DNA, 20 bp, Human herpesvirus 5
tcgctgccgtcgccgtcctg

SEQ ID NO: 41628 - DNA, 20 bp, Human herpesvirus 5
cgctgccgtcgccgtcctgc

SEQ ID NO: 41629 - DNA, 20 bp, Human herpesvirus 5
cggcggtagctgatacggtg

SEQ ID NO: 41630 - DNA, 20 bp, Human herpesvirus 5
ctgctgttgttgcggtctga

SEQ ID NO: 41631 - DNA, 20 bp, Human herpesvirus 5
ttgcggtctgaaaagcggcc

SEQ ID NO: 41632 - DNA, 20 bp, Human herpesvirus 5
cggtctgaaaagcggccacg

SEQ ID NO: 41633 - DNA, 20 bp, Human herpesvirus 5
tcagaccgcaacaacagcag

SEQ ID NO: 41634 - DNA, 20 bp, Human herpesvirus 5
tgagcgtgcgtgaggagatc

SEQ ID NO: 41635 - DNA, 20 bp, Human herpesvirus 5
gagcgtgcgtgaggagatcc

SEQ ID NO: 41636 - DNA, 20 bp, Human herpesvirus 5
agcgtgcgtgaggagatccc

SEQ ID NO: 41637 - DNA, 20 bp, Human herpesvirus 5
ttcgtggatggctgcgaggc

SEQ ID NO: 41638 - DNA, 20 bp, Human herpesvirus 5
gtggatggctgcgaggcgct

SEQ ID NO: 41639 - DNA, 20 bp, Human herpesvirus 5
ttgagcgccgaaaagacggc

SEQ ID NO: 41640 - DNA, 20 bp, Human herpesvirus 5
agcgccgaaaagacggccac

SEQ ID NO: 41641 - DNA, 20 bp, Human herpesvirus 5
tgccgtgcgcgctaaaggta

SEQ ID NO: 41642 - DNA, 20 bp, Human herpesvirus 5
gccgtgcgcgctaaaggtat

SEQ ID NO: 41643 - DNA, 20 bp, Human herpesvirus 5
ccgtgcgcgctaaaggtatc

SEQ ID NO: 41644 - DNA, 20 bp, Human herpesvirus 5
tggcgggcgtcctcgcacag

SEQ ID NO: 41645 - DNA, 20 bp, Human herpesvirus 5
taccgaggatcacggagacg

SEQ ID NO: 41646 - DNA, 20 bp, Human herpesvirus 5
accgaggatcacggagacgt

SEQ ID NO: 41647 - DNA, 20 bp, Human herpesvirus 5
ccgaggatcacggagacgtg

SEQ ID NO: 41648 - DNA, 20 bp, Human herpesvirus 5
gaggcctacacgcccgaggc

SEQ ID NO: 41649 - DNA, 20 bp, Human herpesvirus 5
ctcgagcgtggtgatcgctc

SEQ ID NO: 41650 - DNA, 20 bp, Human herpesvirus 5
gcggggctcacggtggaggc

SEQ ID NO: 41651 - DNA, 20 bp, Human herpesvirus 5
cggcgtctctgtgcgtacgc

SEQ ID NO: 41652 - DNA, 20 bp, Human herpesvirus 5
ggcgtctctgtgcgtacgcc

SEQ ID NO: 41653 - DNA, 20 bp, Human herpesvirus 5
gtaagaaaagctaaccgcta

SEQ ID NO: 41654 - DNA, 20 bp, Human herpesvirus 5
tcgcgggcgggtgcgtcggc

SEQ ID NO: 41655 - DNA, 20 bp, Human herpesvirus 5
cgcgggcgggtgcgtcggct

SEQ ID NO: 41656 - DNA, 20 bp, Human herpesvirus 5
gcgggcgggtgcgtcggcta

SEQ ID NO: 41657 - DNA, 20 bp, Human herpesvirus 5
gcttttcttacgaattgctg

SEQ ID NO: 41658 - DNA, 20 bp, Human herpesvirus 5
ccttcccgggtctcggacga

SEQ ID NO: 41659 - DNA, 20 bp, Human herpesvirus 5
ccgggtctcggacgagtcga

SEQ ID NO: 41660 - DNA, 20 bp, Human herpesvirus 5
ggttgccgtcgtactgtgat

SEQ ID NO: 41661 - DNA, 20 bp, Human herpesvirus 5
ccgtcgtactgtgattaccg

SEQ ID NO: 41662 - DNA, 20 bp, Human herpesvirus 5
ccgttggcggactgcaccgg

SEQ ID NO: 41663 - DNA, 20 bp, Human herpesvirus 5
gcggactgcaccgggatgat

SEQ ID NO: 41664 - DNA, 20 bp, Human herpesvirus 5
tggggaacctggggtggact

SEQ ID NO: 41665 - DNA, 20 bp, Human herpesvirus 5
cgggaaggcggtggggacct

SEQ ID NO: 41666 - DNA, 20 bp, Human herpesvirus 5
ccgcaagatcatcagccgcg

SEQ ID NO: 41667 - DNA, 20 bp, Human herpesvirus 5
ggtgggcacgcgcttttgaa

SEQ ID NO: 41668 - DNA, 20 bp, Human herpesvirus 5
tgaagaaatagaccgggtgc

SEQ ID NO: 41669 - DNA, 20 bp, Human herpesvirus 5
gaagaaatagaccgggtgcc

SEQ ID NO: 41670 - DNA, 20 bp, Human herpesvirus 5
aagaaatagaccgggtgccg

SEQ ID NO: 41671 - DNA, 20 bp, Human herpesvirus 5
ggctacacgcaccccgaccg

SEQ ID NO: 41672 - DNA, 20 bp, Human herpesvirus 5
cggaggccacggcgcagaag

SEQ ID NO: 41673 - DNA, 20 bp, Human herpesvirus 5
ggaggccacggcgcagaaga

SEQ ID NO: 41674 - DNA, 20 bp, Human herpesvirus 5
tgcgccgtggcctccgaaac

SEQ ID NO: 41675 - DNA, 20 bp, Human herpesvirus 5
ccgcgcgacctgctccgtca

SEQ ID NO: 41676 - DNA, 20 bp, Human herpesvirus 5
cgcgcgacctgctccgtcac

SEQ ID NO: 41677 - DNA, 20 bp, Human herpesvirus 5
gcgcgtacactgcgcttcgg

SEQ ID NO: 41678 - DNA, 20 bp, Human herpesvirus 5
gggcgccgcgtcagcgtcgt

SEQ ID NO: 41679 - DNA, 20 bp, Human herpesvirus 5
ctcgagtaccggcgcgtggt

SEQ ID NO: 41680 - DNA, 20 bp, Human herpesvirus 5
cgacgctgacgcggcgcccg

SEQ ID NO: 41681 - DNA, 20 bp, Human herpesvirus 5
ggctcacattaacaccgtct

SEQ ID NO: 41682 - DNA, 20 bp, Human herpesvirus 5
gctcacattaacaccgtctc

SEQ ID NO: 41683 - DNA, 20 bp, Human herpesvirus 5
acaccgtctcctgtcccacc

SEQ ID NO: 41684 - DNA, 20 bp, Human herpesvirus 5
tgaggttcgaccagcggctg

SEQ ID NO: 41685 - DNA, 20 bp, Human herpesvirus 5
gaccagcggctgctggaaga

SEQ ID NO: 41686 - DNA, 20 bp, Human herpesvirus 5
cctcacgtgcgtaagcggat

SEQ ID NO: 41687 - DNA, 20 bp, Human herpesvirus 5
cgcttaccgatccgcttacg

SEQ ID NO: 41688 - DNA, 20 bp, Human herpesvirus 5
ccgatccgcttacgcacgtg

SEQ ID NO: 41689 - DNA, 20 bp, Human herpesvirus 5
cgcacgtgaggcaatctccg

SEQ ID NO: 41690 - DNA, 20 bp, Human herpesvirus 5
agtgagctgcctcagctgtt

SEQ ID NO: 41691 - DNA, 20 bp, Human herpesvirus 5
ccgcgtctggccgacgacgt

SEQ ID NO: 41692 - DNA, 20 bp, Human herpesvirus 5
tgatcgtcacgtgctggtgc

SEQ ID NO: 41693 - DNA, 20 bp, Human herpesvirus 5
gatcgtcacgtgctggtgcg

SEQ ID NO: 41694 - DNA, 20 bp, Human herpesvirus 5
atcgtcacgtgctggtgcgg

SEQ ID NO: 41695 - DNA, 20 bp, Human herpesvirus 5
tccacaaacgcggcgttctt

SEQ ID NO: 41696 - DNA, 20 bp, Human herpesvirus 5
ccacaaacgcggcgttcttc

SEQ ID NO: 41697 - DNA, 20 bp, Human herpesvirus 5
tcttcgtcgcgggccatcat

SEQ ID NO: 41698 - DNA, 20 bp, Human herpesvirus 5
gtcgcgggccatcatcgttc

SEQ ID NO: 41699 - DNA, 20 bp, Human herpesvirus 5
gctcggtgagcgggtagcga

SEQ ID NO: 41700 - DNA, 20 bp, Human herpesvirus 5
tcgtcaccgtcgctacccgc

SEQ ID NO: 41701 - DNA, 20 bp, Human herpesvirus 5
ctgttgccgcgggacgtagt

SEQ ID NO: 41702 - DNA, 20 bp, Human herpesvirus 5
ccgcgggacgtagtggagca

SEQ ID NO: 41703 - DNA, 20 bp, Human herpesvirus 5
cacgcgcagggccagggaca

SEQ ID NO: 41704 - DNA, 20 bp, Human herpesvirus 5
gttgtcggtcgcgctcccgc

SEQ ID NO: 41705 - DNA, 20 bp, Human herpesvirus 5
tcggtcgcgctcccgctcaa

SEQ ID NO: 41706 - DNA, 20 bp, Human herpesvirus 5
ctccctcggagccggcagag

SEQ ID NO: 41707 - DNA, 20 bp, Human herpesvirus 5
tccctcggagccggcagagg

SEQ ID NO: 41708 - DNA, 20 bp, Human herpesvirus 5
ccgccgctacggctcctcca

SEQ ID NO: 41709 - DNA, 20 bp, Human herpesvirus 5
cgagcccgcgccgtctttgc

SEQ ID NO: 41710 - DNA, 20 bp, Human herpesvirus 5
gcatccgtcttatcccgtgc

SEQ ID NO: 41711 - DNA, 20 bp, Human herpesvirus 5
catccgtcttatcccgtgcc

SEQ ID NO: 41712 - DNA, 20 bp, Human herpesvirus 5
tcccgtgccgccgccaccat

SEQ ID NO: 41713 - DNA, 20 bp, Human herpesvirus 5
gtccgaggacgacgacgacg

SEQ ID NO: 41714 - DNA, 20 bp, Human herpesvirus 5
ccttacggcgtttgttgtgt

SEQ ID NO: 41715 - DNA, 20 bp, Human herpesvirus 5
cttacggcgtttgttgtgtc

SEQ ID NO: 41716 - DNA, 20 bp, Human herpesvirus 5
cggcgtttgttgtgtccgcc

SEQ ID NO: 41717 - DNA, 20 bp, Human herpesvirus 5
gttgtgtccgccgctgcccc

SEQ ID NO: 41718 - DNA, 20 bp, Human herpesvirus 5
ttaccgcttcgacgtctttg

SEQ ID NO: 41719 - DNA, 20 bp, Human herpesvirus 5
ccgcttcgacgtctttgtcc

SEQ ID NO: 41720 - DNA, 20 bp, Human herpesvirus 5
gacgtctttgtccggtcagg

SEQ ID NO: 41721 - DNA, 20 bp, Human herpesvirus 5
gtccggtcaggatcagtgcc

SEQ ID NO: 41722 - DNA, 20 bp, Human herpesvirus 5
tccggtcaggatcagtgccc

SEQ ID NO: 41723 - DNA, 20 bp, Human herpesvirus 5
caaatgaacggcctgatcgc

SEQ ID NO: 41724 - DNA, 20 bp, Human herpesvirus 5
gcacacgatcgggtagcggg

SEQ ID NO: 41725 - DNA, 20 bp, Human herpesvirus 5
atttggaacaccgacagccg

SEQ ID NO: 41726 - DNA, 20 bp, Human herpesvirus 5
ggaacaccgacagccgctag

SEQ ID NO: 41727 - DNA, 20 bp, Human herpesvirus 5
gaacaccgacagccgctagg

SEQ ID NO: 41728 - DNA, 20 bp, Human herpesvirus 5
ttttctgagcctggcgtcag

SEQ ID NO: 41729 - DNA, 20 bp, Human herpesvirus 5
tctgagcctggcgtcaggcg

SEQ ID NO: 41730 - DNA, 20 bp, Human herpesvirus 5
ctgagcctggcgtcaggcgt

SEQ ID NO: 41731 - DNA, 20 bp, Human herpesvirus 5
tgagcctggcgtcaggcgtc

SEQ ID NO: 41732 - DNA, 20 bp, Human herpesvirus 5
ttgaggtccaccagcagtcg

SEQ ID NO: 41733 - DNA, 20 bp, Human herpesvirus 5
gtacgcaggtccaggagtcg

SEQ ID NO: 41734 - DNA, 20 bp, Human herpesvirus 5
cagcgagccgccttccacgt

SEQ ID NO: 41735 - DNA, 20 bp, Human herpesvirus 5
cccgacgcgtgaataacagc

SEQ ID NO: 41736 - DNA, 20 bp, Human herpesvirus 5
ttcacgcgtcgggcaagcag

SEQ ID NO: 41737 - DNA, 20 bp, Human herpesvirus 5
acgcgtcgggcaagcagatg

SEQ ID NO: 41738 - DNA, 20 bp, Human herpesvirus 5
gctggggcagatgcttcggc

SEQ ID NO: 41739 - DNA, 20 bp, Human herpesvirus 5
ggcccgtggggttgtgcacg

SEQ ID NO: 41740 - DNA, 20 bp, Human herpesvirus 5
tgcacgttgaccgacacgtt

SEQ ID NO: 41741 - DNA, 20 bp, Human herpesvirus 5
accgacacgttctccacctc

SEQ ID NO: 41742 - DNA, 20 bp, Human herpesvirus 5
tccacctcgctgcccgtaaa

SEQ ID NO: 41743 - DNA, 20 bp, Human herpesvirus 5
cgacggcgaatgggacgtgg

SEQ ID NO: 41744 - DNA, 20 bp, Human herpesvirus 5
gccgtcgcaacagcagctct

SEQ ID NO: 41745 - DNA, 20 bp, Human herpesvirus 5
catcgcgctggaggacctgc

SEQ ID NO: 41746 - DNA, 20 bp, Human herpesvirus 5
ttcagcgtcaattcgtaagg

SEQ ID NO: 41747 - DNA, 20 bp, Human herpesvirus 5
tcagcgtcaattcgtaaggg

SEQ ID NO: 41748 - DNA, 20 bp, Human herpesvirus 5
cagcgtcaattcgtaaggga

SEQ ID NO: 41749 - DNA, 20 bp, Human herpesvirus 5
agcgtcaattcgtaagggac

SEQ ID NO: 41750 - DNA, 20 bp, Human herpesvirus 5
gtaagggacgcgcacctcca

SEQ ID NO: 41751 - DNA, 20 bp, Human herpesvirus 5
cactcgatgccagcacagcg

SEQ ID NO: 41752 - DNA, 20 bp, Human herpesvirus 5
cgcacgtaggtcatggtcag

SEQ ID NO: 41753 - DNA, 20 bp, Human herpesvirus 5
gccaccatggacatggagag

SEQ ID NO: 41754 - DNA, 20 bp, Human herpesvirus 5
gcgctagaggacagctccat

SEQ ID NO: 41755 - DNA, 20 bp, Human herpesvirus 5
acctcctcgtacgaacggtc

SEQ ID NO: 41756 - DNA, 20 bp, Human herpesvirus 5
cctcctcgtacgaacggtcg

SEQ ID NO: 41757 - DNA, 20 bp, Human herpesvirus 5
atttccagcgccagtggcat

SEQ ID NO: 41758 - DNA, 20 bp, Human herpesvirus 5
tcgctcgaccgttcgtacga

SEQ ID NO: 41759 - DNA, 20 bp, Human herpesvirus 5
gtacgaggaggtaaaggctg

SEQ ID NO: 41760 - DNA, 20 bp, Human herpesvirus 5
tgctctctttcgacgtcgta

SEQ ID NO: 41761 - DNA, 20 bp, Human herpesvirus 5
cgacgtcgtacctgacgtgg

SEQ ID NO: 41762 - DNA, 20 bp, Human herpesvirus 5
gacgtcgtacctgacgtgga

SEQ ID NO: 41763 - DNA, 20 bp, Human herpesvirus 5
taccgaccggcgtttctcct

SEQ ID NO: 41764 - DNA, 20 bp, Human herpesvirus 5
accgaccggcgtttctcctg

SEQ ID NO: 41765 - DNA, 20 bp, Human herpesvirus 5
acgtaagccgatagcggttc

SEQ ID NO: 41766 - DNA, 20 bp, Human herpesvirus 5
ctcagccagttgaccgttgt

SEQ ID NO: 41767 - DNA, 20 bp, Human herpesvirus 5
accgttgttaagtcccggca

SEQ ID NO: 41768 - DNA, 20 bp, Human herpesvirus 5
acaacggtcaactggctgag

SEQ ID NO: 41769 - DNA, 20 bp, Human herpesvirus 5
cgtgaacgcgctgcacgacc

SEQ ID NO: 41770 - DNA, 20 bp, Human herpesvirus 5
ctgctgaaaacgacactcga

SEQ ID NO: 41771 - DNA, 20 bp, Human herpesvirus 5
catggcgggttccgagggtg

SEQ ID NO: 41772 - DNA, 20 bp, Human herpesvirus 5
cgagggtggtccgcgttccg

SEQ ID NO: 41773 - DNA, 20 bp, Human herpesvirus 5
cgtgaaggtctgtagacagg

SEQ ID NO: 41774 - DNA, 20 bp, Human herpesvirus 5
acggaacgcggaccaccctc

SEQ ID NO: 41775 - DNA, 20 bp, Human herpesvirus 5
acgtgcgtcagaaagtcagt

SEQ ID NO: 41776 - DNA, 20 bp, Human herpesvirus 5
aggcaggagctcgagcgccg

SEQ ID NO: 41777 - DNA, 20 bp, Human herpesvirus 5
ggcaggagctcgagcgccga

SEQ ID NO: 41778 - DNA, 20 bp, Human herpesvirus 5
tccatcgcggcggcggcgtg

SEQ ID NO: 41779 - DNA, 20 bp, Human herpesvirus 5
ccactgactttctgacgcac

SEQ ID NO: 41780 - DNA, 20 bp, Human herpesvirus 5
ctgggacccgtggccgtacc

SEQ ID NO: 41781 - DNA, 20 bp, Human herpesvirus 5
ttgcgacggtgaagtggagg

SEQ ID NO: 41782 - DNA, 20 bp, Human herpesvirus 5
tgcgacggtgaagtggaggg

SEQ ID NO: 41783 - DNA, 20 bp, Human herpesvirus 5
gcgacggtgaagtggagggc

SEQ ID NO: 41784 - DNA, 20 bp, Human herpesvirus 5
cgacggtgaagtggagggcc

SEQ ID NO: 41785 - DNA, 20 bp, Human herpesvirus 5
tcgaaaaccacgtggccacg

SEQ ID NO: 41786 - DNA, 20 bp, Human herpesvirus 5
ctctcgctgacggaatggaa

SEQ ID NO: 41787 - DNA, 20 bp, Human herpesvirus 5
cattccgtcagcgagagcaa

SEQ ID NO: 41788 - DNA, 20 bp, Human herpesvirus 5
cgtcagcgagagcaatccgc

SEQ ID NO: 41789 - DNA, 20 bp, Human herpesvirus 5
tcgagaacgtggtaggacag

SEQ ID NO: 41790 - DNA, 20 bp, Human herpesvirus 5
cggcgaacggacacgcgctg

SEQ ID NO: 41791 - DNA, 20 bp, Human herpesvirus 5
ggcgaacggacacgcgctgt

SEQ ID NO: 41792 - DNA, 20 bp, Human herpesvirus 5
caccgcgctcccgacgacga

SEQ ID NO: 41793 - DNA, 20 bp, Human herpesvirus 5
tgacccgcgctcgtcgtcgg

SEQ ID NO: 41794 - DNA, 20 bp, Human herpesvirus 5
gactttacggggcagcagct

SEQ ID NO: 41795 - DNA, 20 bp, Human herpesvirus 5
actttacggggcagcagctg

SEQ ID NO: 41796 - DNA, 20 bp, Human herpesvirus 5
acggggcagcagctgcgccg

SEQ ID NO: 41797 - DNA, 20 bp, Human herpesvirus 5
cggggcagcagctgcgccgg

SEQ ID NO: 41798 - DNA, 20 bp, Human herpesvirus 5
cagcgtctcttcctcctcct

SEQ ID NO: 41799 - DNA, 20 bp, Human herpesvirus 5
tggtcgggcgtgtggtagaa

SEQ ID NO: 41800 - DNA, 20 bp, Human herpesvirus 5
taccacacgcccgaccagaa

SEQ ID NO: 41801 - DNA, 20 bp, Human herpesvirus 5
tgcagtcggtagcaaggaca

SEQ ID NO: 41802 - DNA, 20 bp, Human herpesvirus 5
tccgtgaagctgtgcaggtg

SEQ ID NO: 41803 - DNA, 20 bp, Human herpesvirus 5
acggagaagggcgacgccac

SEQ ID NO: 41804 - DNA, 20 bp, Human herpesvirus 5
ctaccgactgcacaagccca

SEQ ID NO: 41805 - DNA, 20 bp, Human herpesvirus 5
cttgtctccacgacgttcac

SEQ ID NO: 41806 - DNA, 20 bp, Human herpesvirus 5
tctccacgacgttcacgtcc

SEQ ID NO: 41807 - DNA, 20 bp, Human herpesvirus 5
acgtccgggtggctgcaggc

SEQ ID NO: 41808 - DNA, 20 bp, Human herpesvirus 5
acgtcgtccagtgcggcctc

SEQ ID NO: 41809 - DNA, 20 bp, Human herpesvirus 5
cacgagtgggccagcccgag

SEQ ID NO: 41810 - DNA, 20 bp, Human herpesvirus 5
ggggtgcatcatctggtagc

SEQ ID NO: 41811 - DNA, 20 bp, Human herpesvirus 5
cggcacagcgccgccacatt

SEQ ID NO: 41812 - DNA, 20 bp, Human herpesvirus 5
accaatgtggcggcgctgtg

SEQ ID NO: 41813 - DNA, 20 bp, Human herpesvirus 5
ggcggcagcggcgagaggag

SEQ ID NO: 41814 - DNA, 20 bp, Human herpesvirus 5
ttcctctcctctcgccgctg

SEQ ID NO: 41815 - DNA, 20 bp, Human herpesvirus 5
tcctctcctctcgccgctgc

SEQ ID NO: 41816 - DNA, 20 bp, Human herpesvirus 5
cctctcctctcgccgctgcc

SEQ ID NO: 41817 - DNA, 20 bp, Human herpesvirus 5
ctctcctctcgccgctgccg

SEQ ID NO: 41818 - DNA, 20 bp, Human herpesvirus 5
ctcggcgtcaggctcagacg

SEQ ID NO: 41819 - DNA, 20 bp, Human herpesvirus 5
ctccgcctctcctctcagtt

SEQ ID NO: 41820 - DNA, 20 bp, Human herpesvirus 5
ccccgtctcctctccctcaa

SEQ ID NO: 41821 - DNA, 20 bp, Human herpesvirus 5
cccgtctcctctccctcaac

SEQ ID NO: 41822 - DNA, 20 bp, Human herpesvirus 5
agggagaggagacggggaaa

SEQ ID NO: 41823 - DNA, 20 bp, Human herpesvirus 5
ggacaaggagaaccagcgtc

SEQ ID NO: 41824 - DNA, 20 bp, Human herpesvirus 5
tccttgtccgaagccgcgtc

SEQ ID NO: 41825 - DNA, 20 bp, Human herpesvirus 5
tccgaagccgcgtcctcttt

SEQ ID NO: 41826 - DNA, 20 bp, Human herpesvirus 5
ccgacccatgccgctgcaga

SEQ ID NO: 41827 - DNA, 20 bp, Human herpesvirus 5
cgacccatgccgctgcagaa

SEQ ID NO: 41828 - DNA, 20 bp, Human herpesvirus 5
ccccgtagccggcctacggc

SEQ ID NO: 41829 - DNA, 20 bp, Human herpesvirus 5
cccgtagccggcctacggcg

SEQ ID NO: 41830 - DNA, 20 bp, Human herpesvirus 5
tgcagcggcatgggtcggaa

SEQ ID NO: 41831 - DNA, 20 bp, Human herpesvirus 5
ctctttaagcacgccggcgc

SEQ ID NO: 41832 - DNA, 20 bp, Human herpesvirus 5
aagcacgccggcgcggcctg

SEQ ID NO: 41833 - DNA, 20 bp, Human herpesvirus 5
agcacgccggcgcggcctgc

SEQ ID NO: 41834 - DNA, 20 bp, Human herpesvirus 5
gagaacggcaagctcacgca

SEQ ID NO: 41835 - DNA, 20 bp, Human herpesvirus 5
ccgttctccaacgcgcggca

SEQ ID NO: 41836 - DNA, 20 bp, Human herpesvirus 5
acggtgactgccgtcaactg

SEQ ID NO: 41837 - DNA, 20 bp, Human herpesvirus 5
cccgagtaacctggacgcgg

SEQ ID NO: 41838 - DNA, 20 bp, Human herpesvirus 5
ccgaggggaaaggcgacaga

SEQ ID NO: 41839 - DNA, 20 bp, Human herpesvirus 5
gtaccttctctgtcgccttt

SEQ ID NO: 41840 - DNA, 20 bp, Human herpesvirus 5
taccttctctgtcgcctttc

SEQ ID NO: 41841 - DNA, 20 bp, Human herpesvirus 5
ctcctcggacgaaggggagg

SEQ ID NO: 41842 - DNA, 20 bp, Human herpesvirus 5
tgttgccgctcctcgttatc

SEQ ID NO: 41843 - DNA, 20 bp, Human herpesvirus 5
ccgctcctcgttatcgtcat

SEQ ID NO: 41844 - DNA, 20 bp, Human herpesvirus 5
tcgtcatcctccccgtcgtc

SEQ ID NO: 41845 - DNA, 20 bp, Human herpesvirus 5
gtccgaggaggaagtcggag

SEQ ID NO: 41846 - DNA, 20 bp, Human herpesvirus 5
gtcttttccacgtagccaag

SEQ ID NO: 41847 - DNA, 20 bp, Human herpesvirus 5
tccacgtagccaagctagtg

SEQ ID NO: 41848 - DNA, 20 bp, Human herpesvirus 5
ccacgtagccaagctagtgg

SEQ ID NO: 41849 - DNA, 20 bp, Human herpesvirus 5
cacgtagccaagctagtggt

SEQ ID NO: 41850 - DNA, 20 bp, Human herpesvirus 5
gggatacgagccgatgacca

SEQ ID NO: 41851 - DNA, 20 bp, Human herpesvirus 5
cgcgtcggcactcacaagta

SEQ ID NO: 41852 - DNA, 20 bp, Human herpesvirus 5
gcgtcggcactcacaagtat

SEQ ID NO: 41853 - DNA, 20 bp, Human herpesvirus 5
gaggtgcgcgaggtgtgttt

SEQ ID NO: 41854 - DNA, 20 bp, Human herpesvirus 5
aggtgcgcgaggtgtgtttt

SEQ ID NO: 41855 - DNA, 20 bp, Human herpesvirus 5
tgagtgccgacgcgaaacga

SEQ ID NO: 41856 - DNA, 20 bp, Human herpesvirus 5
aagagagcgcgcccggcgtg

SEQ ID NO: 41857 - DNA, 20 bp, Human herpesvirus 5
gtctggggcgacgagcggtt

SEQ ID NO: 41858 - DNA, 20 bp, Human herpesvirus 5
aagggacccaccaaccgctc

SEQ ID NO: 41859 - DNA, 20 bp, Human herpesvirus 5
aacacgacaggtgggacccg

SEQ ID NO: 41860 - DNA, 20 bp, Human herpesvirus 5
tcggccttgacgatgccgca

SEQ ID NO: 41861 - DNA, 20 bp, Human herpesvirus 5
acgatgccgcagcggtgttt

SEQ ID NO: 41862 - DNA, 20 bp, Human herpesvirus 5
gagccgcagatccgagagcc

SEQ ID NO: 41863 - DNA, 20 bp, Human herpesvirus 5
agccgcagatccgagagcct

SEQ ID NO: 41864 - DNA, 20 bp, Human herpesvirus 5
ggtctcgagcaaaaacacgg

SEQ ID NO: 41865 - DNA, 20 bp, Human herpesvirus 5
tcgccgcgcaccgtaaagtc

SEQ ID NO: 41866 - DNA, 20 bp, Human herpesvirus 5
cggctccatgatcatcacat

SEQ ID NO: 41867 - DNA, 20 bp, Human herpesvirus 5
cactagacagaatgtgatga

SEQ ID NO: 41868 - DNA, 20 bp, Human herpesvirus 5
actagacagaatgtgatgat

SEQ ID NO: 41869 - DNA, 20 bp, Human herpesvirus 5
acggtgcgcggcgacaagct

SEQ ID NO: 41870 - DNA, 20 bp, Human herpesvirus 5
acaggaaaggtattgagcaa

SEQ ID NO: 41871 - DNA, 20 bp, Human herpesvirus 5
agcaactggcagatcttttg

SEQ ID NO: 41872 - DNA, 20 bp, Human herpesvirus 5
tggtggcggcagagcccgtc

SEQ ID NO: 41873 - DNA, 20 bp, Human herpesvirus 5
ggtggcggcagagcccgtcg

SEQ ID NO: 41874 - DNA, 20 bp, Human herpesvirus 5
gtggcggcagagcccgtcgt

SEQ ID NO: 41875 - DNA, 20 bp, Human herpesvirus 5
gtccagcgcgcggtagggaa

SEQ ID NO: 41876 - DNA, 20 bp, Human herpesvirus 5
cactcctcggccacgcgccg

SEQ ID NO: 41877 - DNA, 20 bp, Human herpesvirus 5
cacgcggcgttgtttcccta

SEQ ID NO: 41878 - DNA, 20 bp, Human herpesvirus 5
tttccctaccgcgcgctgga

SEQ ID NO: 41879 - DNA, 20 bp, Human herpesvirus 5
ccctaccgcgcgctggacga

SEQ ID NO: 41880 - DNA, 20 bp, Human herpesvirus 5
aatatgtgggagcgcaaggc

SEQ ID NO: 41881 - DNA, 20 bp, Human herpesvirus 5
ggcctccgccgcggccgcgg

SEQ ID NO: 41882 - DNA, 20 bp, Human herpesvirus 5
cgctcccacatatttaagca

SEQ ID NO: 41883 - DNA, 20 bp, Human herpesvirus 5
aagcatttgtccacgatgtc

SEQ ID NO: 41884 - DNA, 20 bp, Human herpesvirus 5
agcatttgtccacgatgtcg

SEQ ID NO: 41885 - DNA, 20 bp, Human herpesvirus 5
ttttactacttttacaacgc

SEQ ID NO: 41886 - DNA, 20 bp, Human herpesvirus 5
tttactacttttacaacgcc

SEQ ID NO: 41887 - DNA, 20 bp, Human herpesvirus 5
ttactacttttacaacgccc

SEQ ID NO: 41888 - DNA, 20 bp, Human herpesvirus 5
tactacttttacaacgccct

SEQ ID NO: 41889 - DNA, 20 bp, Human herpesvirus 5
actacttttacaacgccctg

SEQ ID NO: 41890 - DNA, 20 bp, Human herpesvirus 5
gacaggcaggggatgtcgtg

SEQ ID NO: 41891 - DNA, 20 bp, Human herpesvirus 5
gccatgttccatccgttgag

SEQ ID NO: 41892 - DNA, 20 bp, Human herpesvirus 5
cgcgacatttttctcaagcg

SEQ ID NO: 41893 - DNA, 20 bp, Human herpesvirus 5
ttctcaagcgctaccagctc

SEQ ID NO: 41894 - DNA, 20 bp, Human herpesvirus 5
tctcaagcgctaccagctca

SEQ ID NO: 41895 - DNA, 20 bp, Human herpesvirus 5
ctcaagcgctaccagctcat

SEQ ID NO: 41896 - DNA, 20 bp, Human herpesvirus 5
tcaagcgctaccagctcatg

SEQ ID NO: 41897 - DNA, 20 bp, Human herpesvirus 5
cgcatgtgtcgccggcgcag

SEQ ID NO: 41898 - DNA, 20 bp, Human herpesvirus 5
gcatgtgtcgccggcgcaga

SEQ ID NO: 41899 - DNA, 20 bp, Human herpesvirus 5
tcgctggtgtagccctcgag

SEQ ID NO: 41900 - DNA, 20 bp, Human herpesvirus 5
gtcgagtcggcgcagggcaa

SEQ ID NO: 41901 - DNA, 20 bp, Human herpesvirus 5
ccctgcgccgactcgacgaa

SEQ ID NO: 41902 - DNA, 20 bp, Human herpesvirus 5
ctcagcgtctgccagcctaa

SEQ ID NO: 41903 - DNA, 20 bp, Human herpesvirus 5
agcagcagcacgccgcgtcg

SEQ ID NO: 41904 - DNA, 20 bp, Human herpesvirus 5
accgtggtgcacggacagcc

SEQ ID NO: 41905 - DNA, 20 bp, Human herpesvirus 5
ggctggcagacgctgagtaa

SEQ ID NO: 41906 - DNA, 20 bp, Human herpesvirus 5
cgggccctgctgacgctgtt

SEQ ID NO: 41907 - DNA, 20 bp, Human herpesvirus 5
agctcggacacagcgccgcg

SEQ ID NO: 41908 - DNA, 20 bp, Human herpesvirus 5
atgtgccgccgcccggattg

SEQ ID NO: 41909 - DNA, 20 bp, Human herpesvirus 5
cggcttctctttctcacctg

SEQ ID NO: 41910 - DNA, 20 bp, Human herpesvirus 5
tctttctcacctggaccggt

SEQ ID NO: 41911 - DNA, 20 bp, Human herpesvirus 5
ctcacctggaccggtgatac

SEQ ID NO: 41912 - DNA, 20 bp, Human herpesvirus 5
tcacctggaccggtgatact

SEQ ID NO: 41913 - DNA, 20 bp, Human herpesvirus 5
gtcgtggcggcggcagcggt

SEQ ID NO: 41914 - DNA, 20 bp, Human herpesvirus 5
tcgtggcggcggcagcggtg

SEQ ID NO: 41915 - DNA, 20 bp, Human herpesvirus 5
ccagtaccaccgctgccgcc

SEQ ID NO: 41916 - DNA, 20 bp, Human herpesvirus 5
ggatcctggtgaaagaattt

SEQ ID NO: 41917 - DNA, 20 bp, Human herpesvirus 5
aaattctttcaccaggatcc

SEQ ID NO: 41918 - DNA, 20 bp, Human herpesvirus 5
tttcaccaggatcccaaccg

SEQ ID NO: 41919 - DNA, 20 bp, Human herpesvirus 5
caccaggatcccaaccgcgt

SEQ ID NO: 41920 - DNA, 20 bp, Human herpesvirus 5
accaggatcccaaccgcgtt

SEQ ID NO: 41921 - DNA, 20 bp, Human herpesvirus 5
ccgtgtgacgagacggcgtg

SEQ ID NO: 41922 - DNA, 20 bp, Human herpesvirus 5
cgtgctggcgatcgcgctcg

SEQ ID NO: 41923 - DNA, 20 bp, Human herpesvirus 5
cgctcttgggcgacatgcac

SEQ ID NO: 41924 - DNA, 20 bp, Human herpesvirus 5
ctccccccgcccgtacatcc

SEQ ID NO: 41925 - DNA, 20 bp, Human herpesvirus 5
tccccccgcccgtacatccc

SEQ ID NO: 41926 - DNA, 20 bp, Human herpesvirus 5
tgcatcgcccatctacccac

SEQ ID NO: 41927 - DNA, 20 bp, Human herpesvirus 5
tcagacacataccctaccgc

SEQ ID NO: 41928 - DNA, 20 bp, Human herpesvirus 5
cagacacataccctaccgcc

SEQ ID NO: 41929 - DNA, 20 bp, Human herpesvirus 5
agacacataccctaccgcca

SEQ ID NO: 41930 - DNA, 20 bp, Human herpesvirus 5
tgcggcacactggtggtggt

SEQ ID NO: 41931 - DNA, 20 bp, Human herpesvirus 5
ctcctaacagtggaggccag

SEQ ID NO: 41932 - DNA, 20 bp, Human herpesvirus 5
aagaccagggggtcgcctcg

SEQ ID NO: 41933 - DNA, 20 bp, Human herpesvirus 5
gactactgagctaccgaggc

SEQ ID NO: 41934 - DNA, 20 bp, Human herpesvirus 5
aagcacactttctcgggtgt

SEQ ID NO: 41935 - DNA, 20 bp, Human herpesvirus 5
ctcgggtgtgcgtcgaccct

SEQ ID NO: 41936 - DNA, 20 bp, Human herpesvirus 5
tcgggtgtgcgtcgaccctt

SEQ ID NO: 41937 - DNA, 20 bp, Human herpesvirus 5
tgccgattgagcaacactgt

SEQ ID NO: 41938 - DNA, 20 bp, Human herpesvirus 5
gccgattgagcaacactgtt

SEQ ID NO: 41939 - DNA, 20 bp, Human herpesvirus 5
ccgattgagcaacactgttg

SEQ ID NO: 41940 - DNA, 20 bp, Human herpesvirus 5
agcaacactgttggcatctc

SEQ ID NO: 41941 - DNA, 20 bp, Human herpesvirus 5
gcatctctcactccgatagg

SEQ ID NO: 41942 - DNA, 20 bp, Human herpesvirus 5
ctgtcgttgcttgtgatgtt

SEQ ID NO: 41943 - DNA, 20 bp, Human herpesvirus 5
cttgtgatgttggacgcctg

SEQ ID NO: 41944 - DNA, 20 bp, Human herpesvirus 5
tgatgttggacgcctggagt

SEQ ID NO: 41945 - DNA, 20 bp, Human herpesvirus 5
gacgcctggagtggaaaagt

SEQ ID NO: 41946 - DNA, 20 bp, Human herpesvirus 5
ttaggcgcgcatacggtatt

SEQ ID NO: 41947 - DNA, 20 bp, Human herpesvirus 5
gtcgggccggctgagcgtct

SEQ ID NO: 41948 - DNA, 20 bp, Human herpesvirus 5
ctgcacgccggcgttaggtc

SEQ ID NO: 41949 - DNA, 20 bp, Human herpesvirus 5
ggtcgctactcgctgggaga

SEQ ID NO: 41950 - DNA, 20 bp, Human herpesvirus 5
ctctccctcggcgaccaaca

SEQ ID NO: 41951 - DNA, 20 bp, Human herpesvirus 5
gtcgccgagggagagcaagt

SEQ ID NO: 41952 - DNA, 20 bp, Human herpesvirus 5
ccatcccctgcacggtcatg

SEQ ID NO: 41953 - DNA, 20 bp, Human herpesvirus 5
tgtacagcactcgcgcggga

SEQ ID NO: 41954 - DNA, 20 bp, Human herpesvirus 5
gtacagcactcgcgcgggaa

SEQ ID NO: 41955 - DNA, 20 bp, Human herpesvirus 5
tacagcactcgcgcgggaac

SEQ ID NO: 41956 - DNA, 20 bp, Human herpesvirus 5
cgtagcgggagatacggcgt

SEQ ID NO: 41957 - DNA, 20 bp, Human herpesvirus 5
tcccgcgggccacttacttg

SEQ ID NO: 41958 - DNA, 20 bp, Human herpesvirus 5
ccccgccagcacctccgccg

SEQ ID NO: 41959 - DNA, 20 bp, Human herpesvirus 5
ctatcgtcgccggtttcggg

SEQ ID NO: 41960 - DNA, 20 bp, Human herpesvirus 5
cgggcgatgacagcgccggc

SEQ ID NO: 41961 - DNA, 20 bp, Human herpesvirus 5
gggcgatgacagcgccggcg

SEQ ID NO: 41962 - DNA, 20 bp, Human herpesvirus 5
ccggcggaggtgctggcggg

SEQ ID NO: 41963 - DNA, 20 bp, Human herpesvirus 5
cgcggtggcttttgtggcgt

SEQ ID NO: 41964 - DNA, 20 bp, Human herpesvirus 5
tgtggcgtcggcgttttcgg

SEQ ID NO: 41965 - DNA, 20 bp, Human herpesvirus 5
gtggcgtcggcgttttcggg

SEQ ID NO: 41966 - DNA, 20 bp, Human herpesvirus 5
tggcgtcggcgttttcggga

SEQ ID NO: 41967 - DNA, 20 bp, Human herpesvirus 5
tcgggaagggcctgggcgtc

SEQ ID NO: 41968 - DNA, 20 bp, Human herpesvirus 5
ccgtgatcgcgtcgtgcgcg

SEQ ID NO: 41969 - DNA, 20 bp, Human herpesvirus 5
tattattgcgatgagaggga

SEQ ID NO: 41970 - DNA, 20 bp, Human herpesvirus 5
attattgcgatgagagggag

SEQ ID NO: 41971 - DNA, 20 bp, Human herpesvirus 5
ttattgcgatgagagggagg

SEQ ID NO: 41972 - DNA, 20 bp, Human herpesvirus 5
ttgcgatgagagggaggatg

SEQ ID NO: 41973 - DNA, 20 bp, Human herpesvirus 5
gcctgatggtggaagtcggc

SEQ ID NO: 41974 - DNA, 20 bp, Human herpesvirus 5
gaccttcgtgcgttgtctcg

SEQ ID NO: 41975 - DNA, 20 bp, Human herpesvirus 5
gtgcgttgtctcgcctatca

SEQ ID NO: 41976 - DNA, 20 bp, Human herpesvirus 5
tctcgcctatcagcgttcct

SEQ ID NO: 41977 - DNA, 20 bp, Human herpesvirus 5
cttccccgtgcttacagcct

SEQ ID NO: 41978 - DNA, 20 bp, Human herpesvirus 5
ggcaccgcgtggcgtacctc

SEQ ID NO: 41979 - DNA, 20 bp, Human herpesvirus 5
gatggtccacgacgtcgcga

SEQ ID NO: 41980 - DNA, 20 bp, Human herpesvirus 5
agtccgggtttcgcgtccag

SEQ ID NO: 41981 - DNA, 20 bp, Human herpesvirus 5
cgcgtccagtcggacgtgtg

SEQ ID NO: 41982 - DNA, 20 bp, Human herpesvirus 5
gcgtccagtcggacgtgtga

SEQ ID NO: 41983 - DNA, 20 bp, Human herpesvirus 5
ggcaacggaacggcgtttca

SEQ ID NO: 41984 - DNA, 20 bp, Human herpesvirus 5
cactgccaaaattgtatcgg

SEQ ID NO: 41985 - DNA, 20 bp, Human herpesvirus 5
aaggaagccctctgggatgt

SEQ ID NO: 41986 - DNA, 20 bp, Human herpesvirus 5
gaagtgccgcgttgggcgtg

SEQ ID NO: 41987 - DNA, 20 bp, Human herpesvirus 5
ggcgtggcagggctggaaga

SEQ ID NO: 41988 - DNA, 20 bp, Human herpesvirus 5
cgccacctcttccagccctg

SEQ ID NO: 41989 - DNA, 20 bp, Human herpesvirus 5
cagccctgccacgcccaacg

SEQ ID NO: 41990 - DNA, 20 bp, Human herpesvirus 5
aacgtctgtggttggcagcc

SEQ ID NO: 41991 - DNA, 20 bp, Human herpesvirus 5
gcagccaggggctgggtgtg

SEQ ID NO: 41992 - DNA, 20 bp, Human herpesvirus 5
cacaccggtttcgcacaccc

SEQ ID NO: 41993 - DNA, 20 bp, Human herpesvirus 5
cgcacacccagcccctggct

SEQ ID NO: 41994 - DNA, 20 bp, Human herpesvirus 5
gcacacccagcccctggctg

SEQ ID NO: 41995 - DNA, 20 bp, Human herpesvirus 5
tgagcagacgacgttggatg

SEQ ID NO: 41996 - DNA, 20 bp, Human herpesvirus 5
gatgcgggacgtcggagcac

SEQ ID NO: 41997 - DNA, 20 bp, Human herpesvirus 5
cgcgtgttcctccgggttcc

SEQ ID NO: 41998 - DNA, 20 bp, Human herpesvirus 5
ctccgggttcctgccttttc

SEQ ID NO: 41999 - DNA, 20 bp, Human herpesvirus 5
ctgccttttccagtcgagtg

SEQ ID NO: 42000 - DNA, 20 bp, Human herpesvirus 5
tccagtcgagtgcgtcgtcg

SEQ ID NO: 42001 - DNA, 20 bp, Human herpesvirus 5
ccagtcgagtgcgtcgtcgg

SEQ ID NO: 42002 - DNA, 20 bp, Human herpesvirus 5
ggtcctcggggacagccgac

SEQ ID NO: 42003 - DNA, 20 bp, Human herpesvirus 5
cggcgcctcgtcgttgagtg

SEQ ID NO: 42004 - DNA, 20 bp, Human herpesvirus 5
ggcgcctcgtcgttgagtgg

SEQ ID NO: 42005 - DNA, 20 bp, Human herpesvirus 5
agtggccttcagcagtctgc

SEQ ID NO: 42006 - DNA, 20 bp, Human herpesvirus 5
agcagtctgcgttgttttat

SEQ ID NO: 42007 - DNA, 20 bp, Human herpesvirus 5
tccccgactccgcggtccgc

SEQ ID NO: 42008 - DNA, 20 bp, Human herpesvirus 5
gtgacggcgatcagcagccg

SEQ ID NO: 42009 - DNA, 20 bp, Human herpesvirus 5
gttctcctccacccgaaagt

SEQ ID NO: 42010 - DNA, 20 bp, Human herpesvirus 5
tcctccacccgaaagtgggc

SEQ ID NO: 42011 - DNA, 20 bp, Human herpesvirus 5
gatctccgataccaccacat

SEQ ID NO: 42012 - DNA, 20 bp, Human herpesvirus 5
atctccgataccaccacatt

SEQ ID NO: 42013 - DNA, 20 bp, Human herpesvirus 5
aggggccggggcaccgagtc

SEQ ID NO: 42014 - DNA, 20 bp, Human herpesvirus 5
caacaccgggacttttcaca

SEQ ID NO: 42015 - DNA, 20 bp, Human herpesvirus 5
aacaccgggacttttcacac

SEQ ID NO: 42016 - DNA, 20 bp, Human herpesvirus 5
tcacacggtgatttcggcac

SEQ ID NO: 42017 - DNA, 20 bp, Human herpesvirus 5
cacacggtgatttcggcacc

SEQ ID NO: 42018 - DNA, 20 bp, Human herpesvirus 5
acacggtgatttcggcaccg

SEQ ID NO: 42019 - DNA, 20 bp, Human herpesvirus 5
gtggtcgtgtcgcgacatgg

SEQ ID NO: 42020 - DNA, 20 bp, Human herpesvirus 5
cgaaacggcgattatatatg

SEQ ID NO: 42021 - DNA, 20 bp, Human herpesvirus 5
tatatgttctcaacaatacc

SEQ ID NO: 42022 - DNA, 20 bp, Human herpesvirus 5
tcaacaataccgccctacgt

SEQ ID NO: 42023 - DNA, 20 bp, Human herpesvirus 5
tatgatgtaacgtgtgacgt

SEQ ID NO: 42024 - DNA, 20 bp, Human herpesvirus 5
catcatacaacgtagggcgg

SEQ ID NO: 42025 - DNA, 20 bp, Human herpesvirus 5
ccacgcacaagccaggcggc

SEQ ID NO: 42026 - DNA, 20 bp, Human herpesvirus 5
ggacacggaactggagacac

SEQ ID NO: 42027 - DNA, 20 bp, Human herpesvirus 5
cgtgtccgaatgttacgtcc

SEQ ID NO: 42028 - DNA, 20 bp, Human herpesvirus 5
cgtccagcacggggtactcg

SEQ ID NO: 42029 - DNA, 20 bp, Human herpesvirus 5
tgcgtggcaacttctccgat

SEQ ID NO: 42030 - DNA, 20 bp, Human herpesvirus 5
gggtagcagagtagtttcgg

SEQ ID NO: 42031 - DNA, 20 bp, Human herpesvirus 5
cggggtcggtttccttccgg

SEQ ID NO: 42032 - DNA, 20 bp, Human herpesvirus 5
ggggtcggtttccttccggc

SEQ ID NO: 42033 - DNA, 20 bp, Human herpesvirus 5
ccttccggcgacgacagttc

SEQ ID NO: 42034 - DNA, 20 bp, Human herpesvirus 5
cttccggcgacgacagttcc

SEQ ID NO: 42035 - DNA, 20 bp, Human herpesvirus 5
ggatgaggctggaaacgccg

SEQ ID NO: 42036 - DNA, 20 bp, Human herpesvirus 5
agcccggcggtggtgaacga

SEQ ID NO: 42037 - DNA, 20 bp, Human herpesvirus 5
gcactgtatgtggcgcttct

SEQ ID NO: 42038 - DNA, 20 bp, Human herpesvirus 5
cactgtatgtggcgcttctc

SEQ ID NO: 42039 - DNA, 20 bp, Human herpesvirus 5
tctcgttcaccaccgccggg

SEQ ID NO: 42040 - DNA, 20 bp, Human herpesvirus 5
cagcgtactcattagcgcgc

SEQ ID NO: 42041 - DNA, 20 bp, Human herpesvirus 5
agcgtactcattagcgcgct

SEQ ID NO: 42042 - DNA, 20 bp, Human herpesvirus 5
gcgcgctggtttggctgggt

SEQ ID NO: 42043 - DNA, 20 bp, Human herpesvirus 5
ggctgggttacccctcactg

SEQ ID NO: 42044 - DNA, 20 bp, Human herpesvirus 5
gctgggttacccctcactgg

SEQ ID NO: 42045 - DNA, 20 bp, Human herpesvirus 5
gatcccggggggcacgtaga

SEQ ID NO: 42046 - DNA, 20 bp, Human herpesvirus 5
aaaccctttttctcttctca

SEQ ID NO: 42047 - DNA, 20 bp, Human herpesvirus 5
caagtacccaccgatggcac

SEQ ID NO: 42048 - DNA, 20 bp, Human herpesvirus 5
aagtacccaccgatggcacg

SEQ ID NO: 42049 - DNA, 20 bp, Human herpesvirus 5
cgctgagcgagaaccggtcg

SEQ ID NO: 42050 - DNA, 20 bp, Human herpesvirus 5
gctgagcgagaaccggtcgc

SEQ ID NO: 42051 - DNA, 20 bp, Human herpesvirus 5
gtgtatttccgctatgagcg

SEQ ID NO: 42052 - DNA, 20 bp, Human herpesvirus 5
ccgctatgagcgaccggttc

SEQ ID NO: 42053 - DNA, 20 bp, Human herpesvirus 5
cgctatgagcgaccggttct

SEQ ID NO: 42054 - DNA, 20 bp, Human herpesvirus 5
gacgcgcggtcatatagcct

SEQ ID NO: 42055 - DNA, 20 bp, Human herpesvirus 5
cccaccgcgacccagcgaca

SEQ ID NO: 42056 - DNA, 20 bp, Human herpesvirus 5
ccaccgcgacccagcgacag

SEQ ID NO: 42057 - DNA, 20 bp, Human herpesvirus 5
atcgcgtttgccgtgcagca

SEQ ID NO: 42058 - DNA, 20 bp, Human herpesvirus 5
gccgtgcagcagggccaaac

SEQ ID NO: 42059 - DNA, 20 bp, Human herpesvirus 5
ccgtgcagcagggccaaaca

SEQ ID NO: 42060 - DNA, 20 bp, Human herpesvirus 5
ggccctgctgcacggcaaac

SEQ ID NO: 42061 - DNA, 20 bp, Human herpesvirus 5
gccctgctgcacggcaaacg

SEQ ID NO: 42062 - DNA, 20 bp, Human herpesvirus 5
tagcgggacgacatgaagca

SEQ ID NO: 42063 - DNA, 20 bp, Human herpesvirus 5
tataggcattaggacttccc

SEQ ID NO: 42064 - DNA, 20 bp, Human herpesvirus 5
ataggcattaggacttcccc

SEQ ID NO: 42065 - DNA, 20 bp, Human herpesvirus 5
taggcattaggacttccccg

SEQ ID NO: 42066 - DNA, 20 bp, Human herpesvirus 5
ggacttccccgtcgtactgg

SEQ ID NO: 42067 - DNA, 20 bp, Human herpesvirus 5
gcagagcgagcgtgaggaac

SEQ ID NO: 42068 - DNA, 20 bp, Human herpesvirus 5
ccagcgacgtcggtcacggc

SEQ ID NO: 42069 - DNA, 20 bp, Human herpesvirus 5
cagcgacgtcggtcacggcc

SEQ ID NO: 42070 - DNA, 20 bp, Human herpesvirus 5
ctaggtggccgtgaccgacg

SEQ ID NO: 42071 - DNA, 20 bp, Human herpesvirus 5
taggtggccgtgaccgacgt

SEQ ID NO: 42072 - DNA, 20 bp, Human herpesvirus 5
tgctcgccggccgcgctgta

SEQ ID NO: 42073 - DNA, 20 bp, Human herpesvirus 5
gctcgccggccgcgctgtaa

SEQ ID NO: 42074 - DNA, 20 bp, Human herpesvirus 5
ctcgccggccgcgctgtaac

SEQ ID NO: 42075 - DNA, 20 bp, Human herpesvirus 5
ctctgtggtcggcgagtctt

SEQ ID NO: 42076 - DNA, 20 bp, Human herpesvirus 5
tctgtggtcggcgagtcttc

SEQ ID NO: 42077 - DNA, 20 bp, Human herpesvirus 5
gcgcatcactaggaaccagt

SEQ ID NO: 42078 - DNA, 20 bp, Human herpesvirus 5
gcggggttgcgcagtgctac

SEQ ID NO: 42079 - DNA, 20 bp, Human herpesvirus 5
cgcagtgctacggtggttcc

SEQ ID NO: 42080 - DNA, 20 bp, Human herpesvirus 5
cctggtggcgctgcacgtag

SEQ ID NO: 42081 - DNA, 20 bp, Human herpesvirus 5
ctagtgatgcgcgaacaggc

SEQ ID NO: 42082 - DNA, 20 bp, Human herpesvirus 5
actttaccatgttcgacagc

SEQ ID NO: 42083 - DNA, 20 bp, Human herpesvirus 5
accatgttcgacagcggcgt

SEQ ID NO: 42084 - DNA, 20 bp, Human herpesvirus 5
ccatgttcgacagcggcgta

SEQ ID NO: 42085 - DNA, 20 bp, Human herpesvirus 5
gacagcggcgtagaccgcga

SEQ ID NO: 42086 - DNA, 20 bp, Human herpesvirus 5
gccaacgcaggcggccaacg

SEQ ID NO: 42087 - DNA, 20 bp, Human herpesvirus 5
gccgcctgcgttggcgaaca

SEQ ID NO: 42088 - DNA, 20 bp, Human herpesvirus 5
tgcggaatgccgagcgacaa

SEQ ID NO: 42089 - DNA, 20 bp, Human herpesvirus 5
cggacccagtcgcgaagcac

SEQ ID NO: 42090 - DNA, 20 bp, Human herpesvirus 5
gcgactgggtccgtaaccac

SEQ ID NO: 42091 - DNA, 20 bp, Human herpesvirus 5
tcgctcggcattccgcacaa

SEQ ID NO: 42092 - DNA, 20 bp, Human herpesvirus 5
cgcacaactggttcctgcag

SEQ ID NO: 42093 - DNA, 20 bp, Human herpesvirus 5
cgcgacactctcagccggac

SEQ ID NO: 42094 - DNA, 20 bp, Human herpesvirus 5
tggccctgacggcgctgcag

SEQ ID NO: 42095 - DNA, 20 bp, Human herpesvirus 5
tgccgccggagctccccgcg

SEQ ID NO: 42096 - DNA, 20 bp, Human herpesvirus 5
cctgctgttggctacctctc

SEQ ID NO: 42097 - DNA, 20 bp, Human herpesvirus 5
gctacctctcggatttcaaa

SEQ ID NO: 42098 - DNA, 20 bp, Human herpesvirus 5
caaaaaagagcacgtgccga

SEQ ID NO: 42099 - DNA, 20 bp, Human herpesvirus 5
aaaaaagagcacgtgccgat

SEQ ID NO: 42100 - DNA, 20 bp, Human herpesvirus 5
tttgaaatccgagaggtagc

SEQ ID NO: 42101 - DNA, 20 bp, Human herpesvirus 5
cgtggttagcagcggcgtgc

SEQ ID NO: 42102 - DNA, 20 bp, Human herpesvirus 5
gcagcggcgtgcgcatctgc

SEQ ID NO: 42103 - DNA, 20 bp, Human herpesvirus 5
cactgcgaggccatctacgg

SEQ ID NO: 42104 - DNA, 20 bp, Human herpesvirus 5
ccgggatacgagcacgcttc

SEQ ID NO: 42105 - DNA, 20 bp, Human herpesvirus 5
cgagggctggcggttttgca

SEQ ID NO: 42106 - DNA, 20 bp, Human herpesvirus 5
ccgtcgattgcaaaaccgcc

SEQ ID NO: 42107 - DNA, 20 bp, Human herpesvirus 5
caaaaccgccagccctcgga

SEQ ID NO: 42108 - DNA, 20 bp, Human herpesvirus 5
cgcggtgggggcgtgccccg

SEQ ID NO: 42109 - DNA, 20 bp, Human herpesvirus 5
gttcggcgttcaggccttaa

SEQ ID NO: 42110 - DNA, 20 bp, Human herpesvirus 5
ggcgttcaggccttaatact

SEQ ID NO: 42111 - DNA, 20 bp, Human herpesvirus 5
aggcctgaacgccgaacgaa

SEQ ID NO: 42112 - DNA, 20 bp, Human herpesvirus 5
ctggcgccgccttggggccg

SEQ ID NO: 42113 - DNA, 20 bp, Human herpesvirus 5
gggccgtgcagtctggaagg

SEQ ID NO: 42114 - DNA, 20 bp, Human herpesvirus 5
tccagtcgagtgcgtcgtcg

SEQ ID NO: 42115 - DNA, 20 bp, Human herpesvirus 5
ccagtcgagtgcgtcgtcgg

SEQ ID NO: 42116 - DNA, 20 bp, Human herpesvirus 5
cagtcgagtgcgtcgtcggc

SEQ ID NO: 42117 - DNA, 20 bp, Human herpesvirus 5
cgggccgtgtgctgggtccc

SEQ ID NO: 42118 - DNA, 20 bp, Human herpesvirus 5
tctgcgggggggtgaaattt

SEQ ID NO: 42119 - DNA, 20 bp, Human herpesvirus 5
ctgcgggggggtgaaatttg

SEQ ID NO: 42120 - DNA, 20 bp, Human herpesvirus 5
tgcgggggggtgaaatttgg

SEQ ID NO: 42121 - DNA, 20 bp, Human herpesvirus 5
ggagttgcgtgtgtggacgg

SEQ ID NO: 42122 - DNA, 20 bp, Influenza A virus
aatccaatgattgtcgagct

SEQ ID NO: 42123 - DNA, 20 bp, Influenza A virus
tcgagcttgcggaaaagaca

SEQ ID NO: 42124 - DNA, 20 bp, Influenza A virus
cggaaaagacaatgaaggaa

SEQ ID NO: 42125 - DNA, 20 bp, Influenza A virus
aaacaaataagttcgctgca

SEQ ID NO: 42126 - DNA, 20 bp, Influenza A virus
gctgcaatatgcacacactt

SEQ ID NO: 42127 - DNA, 20 bp, Influenza A virus
cttccggatctatacgacta

SEQ ID NO: 42128 - DNA, 20 bp, Influenza A virus
ttccggatctatacgactac

SEQ ID NO: 42129 - DNA, 20 bp, Influenza A virus
cggatctatacgactacaag

SEQ ID NO: 42130 - DNA, 20 bp, Influenza A virus
actgaaattggtgtgacacg

SEQ ID NO: 42131 - DNA, 20 bp, Influenza A virus
gtgtgacacggagggaagtt

SEQ ID NO: 42132 - DNA, 20 bp, Influenza A virus
ctttcgtcagtccgagagag

SEQ ID NO: 42133 - DNA, 20 bp, Influenza A virus
cgtcagtccgagagaggcga

SEQ ID NO: 42134 - DNA, 20 bp, Influenza A virus
gtcagtccgagagaggcgaa

SEQ ID NO: 42135 - DNA, 20 bp, Influenza A virus
aagaaagatttgaaatcaca

SEQ ID NO: 42136 - DNA, 20 bp, Influenza A virus
gaaatcacagggaccatgcg

SEQ ID NO: 42137 - DNA, 20 bp, Influenza A virus
gactttgaggactgcaaaga

SEQ ID NO: 42138 - DNA, 20 bp, Influenza A virus
gaggactgcaaagatattgg

SEQ ID NO: 42139 - DNA, 20 bp, Influenza A virus
aggactgcaaagatattggc

SEQ ID NO: 42140 - DNA, 20 bp, Influenza A virus
gcgatctgaaacagtatcaa

SEQ ID NO: 42141 - DNA, 20 bp, Influenza A virus
gatactgtttcagatcgcca

SEQ ID NO: 42142 - DNA, 20 bp, Influenza A virus
ccccaattgagcacattgca

SEQ ID NO: 42143 - DNA, 20 bp, Influenza A virus
agcacattgcaagcatgaga

SEQ ID NO: 42144 - DNA, 20 bp, Influenza A virus
caagcatgagaaggaactac

SEQ ID NO: 42145 - DNA, 20 bp, Influenza A virus
acagcggaagtgtctcattg

SEQ ID NO: 42146 - DNA, 20 bp, Influenza A virus
cagggccactgagtacataa

SEQ ID NO: 42147 - DNA, 20 bp, Influenza A virus
gagaaatgatactgacgtgg

SEQ ID NO: 42148 - DNA, 20 bp, Influenza A virus
agaaatgatactgacgtggt

SEQ ID NO: 42149 - DNA, 20 bp, Influenza A virus
gtgagtatggaattctccct

SEQ ID NO: 42150 - DNA, 20 bp, Influenza A virus
tgagtatggaattctccctt

SEQ ID NO: 42151 - DNA, 20 bp, Influenza A virus
tcccttactgacccaaggct

SEQ ID NO: 42152 - DNA, 20 bp, Influenza A virus
aacagattgagagcatgatc

SEQ ID NO: 42153 - DNA, 20 bp, Influenza A virus
agagcatgatcgaggctgag

SEQ ID NO: 42154 - DNA, 20 bp, Influenza A virus
tatcaaagagaaagacatga

SEQ ID NO: 42155 - DNA, 20 bp, Influenza A virus
tttgaaaacagatcggagac

SEQ ID NO: 42156 - DNA, 20 bp, Influenza A virus
gaaaacagatcggagacatg

SEQ ID NO: 42157 - DNA, 20 bp, Influenza A virus
gaagaatggttagcggcatt

SEQ ID NO: 42158 - DNA, 20 bp, Influenza A virus
gcggcattgggagattctac

SEQ ID NO: 42159 - DNA, 20 bp, Influenza A virus
ggagattctacatacagatg

SEQ ID NO: 42160 - DNA, 20 bp, Influenza A virus
tacatacagatgtgtacaga

SEQ ID NO: 42161 - DNA, 20 bp, Influenza A virus
tcactgagtttgagttctgt

SEQ ID NO: 42162 - DNA, 20 bp, Influenza A virus
ggcgacaagcgaacaatgga

SEQ ID NO: 42163 - DNA, 20 bp, Influenza A virus
gcgacaagcgaacaatggag

SEQ ID NO: 42164 - DNA, 20 bp, Influenza A virus
catcctctccattgttcgct

SEQ ID NO: 42165 - DNA, 20 bp, Influenza A virus
ttcgcttgtcgccaaattct

SEQ ID NO: 42166 - DNA, 20 bp, Influenza A virus
gcttgtcgccaaattctcct

SEQ ID NO: 42167 - DNA, 20 bp, Influenza A virus
ctggagaggcgaaaatggaa

SEQ ID NO: 42168 - DNA, 20 bp, Influenza A virus
tggagaggcgaaaatggaag

SEQ ID NO: 42169 - DNA, 20 bp, Influenza A virus
catatgagagaatgtgcaac

SEQ ID NO: 42170 - DNA, 20 bp, Influenza A virus
ccctttgaggatgttgcaca

SEQ ID NO: 42171 - DNA, 20 bp, Influenza A virus
cctttgaggatgttgcacat

SEQ ID NO: 42172 - DNA, 20 bp, Influenza A virus
aaattgcttcaaatgagaac

SEQ ID NO: 42173 - DNA, 20 bp, Influenza A virus
cttcaaatgagaacatggaa

SEQ ID NO: 42174 - DNA, 20 bp, Influenza A virus
aaatgagaacatggaagcaa

SEQ ID NO: 42175 - DNA, 20 bp, Influenza A virus
tcagttcaagagtattggag

SEQ ID NO: 42176 - DNA, 20 bp, Influenza A virus
aagagtattggagtccattg

SEQ ID NO: 42177 - DNA, 20 bp, Human adenovirus
tttgtgcaaattttgtgttt

SEQ ID NO: 42178 - DNA, 20 bp, Human adenovirus
gtgcaaattttgtgttttag

SEQ ID NO: 42179 - DNA, 20 bp, Human adenovirus
tgcaaattttgtgttttagg

SEQ ID NO: 42180 - DNA, 20 bp, Human adenovirus
tgtgttttaggcgcgaaaac

SEQ ID NO: 42181 - DNA, 20 bp, Human adenovirus
gtgttttaggcgcgaaaact

SEQ ID NO: 42182 - DNA, 20 bp, Human adenovirus
gtcctgtcgtatcaggaagc

SEQ ID NO: 42183 - DNA, 20 bp, Human adenovirus
gagcatttggtggacaactt

SEQ ID NO: 42184 - DNA, 20 bp, Human adenovirus
ggtggacaacttttttaacg

SEQ ID NO: 42185 - DNA, 20 bp, Human adenovirus
gtggacaacttttttaacga

SEQ ID NO: 42186 - DNA, 20 bp, Human adenovirus
tttaacgaggtacccagtga

SEQ ID NO: 42187 - DNA, 20 bp, Human adenovirus
attgtgctacgagatgggct

SEQ ID NO: 42188 - DNA, 20 bp, Human adenovirus
ttgtgctacgagatgggctt

SEQ ID NO: 42189 - DNA, 20 bp, Human adenovirus
tgctacgagatgggctttcc

SEQ ID NO: 42190 - DNA, 20 bp, Human adenovirus
ccctgtagcgattcggaaga

SEQ ID NO: 42191 - DNA, 20 bp, Human adenovirus
cctgtagcgattcggaagac

SEQ ID NO: 42192 - DNA, 20 bp, Human adenovirus
tggatttgattcaagaggaa

SEQ ID NO: 42193 - DNA, 20 bp, Human adenovirus
ggatttgattcaagaggaag

SEQ ID NO: 42194 - DNA, 20 bp, Human adenovirus
gatttgattcaagaggaaga

SEQ ID NO: 42195 - DNA, 20 bp, Human adenovirus
gattcaagaggaagaaagag

SEQ ID NO: 42196 - DNA, 20 bp, Human adenovirus
attcaagaggaagaaagaga

SEQ ID NO: 42197 - DNA, 20 bp, Human adenovirus
tcagagcgttcgccagctct

SEQ ID NO: 42198 - DNA, 20 bp, Human adenovirus
cagagcgttcgccagctctt

SEQ ID NO: 42199 - DNA, 20 bp, Human adenovirus
agagcgttcgccagctcttg

SEQ ID NO: 42200 - DNA, 20 bp, Human adenovirus
gccagctcttgcagtatacc

SEQ ID NO: 42201 - DNA, 20 bp, Human adenovirus
cagtatacctctaaaaacac

SEQ ID NO: 42202 - DNA, 20 bp, Human adenovirus
gcatttactcgctggcgcgg

SEQ ID NO: 42203 - DNA, 20 bp, Human adenovirus
catttactcgctggcgcggc

SEQ ID NO: 42204 - DNA, 20 bp, Human adenovirus
actcgctggcgcggcctttg

SEQ ID NO: 42205 - DNA, 20 bp, Human adenovirus
ctcgctggcgcggcctttga

SEQ ID NO: 42206 - DNA, 20 bp, Human adenovirus
gaccatgccgccgctgccga

SEQ ID NO: 42207 - DNA, 20 bp, Human adenovirus
cgtcctgattgtagctacag

SEQ ID NO: 42208 - DNA, 20 bp, Human adenovirus
tagctacagaattactaaaa

SEQ ID NO: 42209 - DNA, 20 bp, Human adenovirus
ctaaaacagtaaccattact

SEQ ID NO: 42210 - DNA, 20 bp, Human adenovirus
cttcatgcgcctatattata

SEQ ID NO: 42211 - DNA, 20 bp, Human adenovirus
atgcgcctatattataggta

SEQ ID NO: 42212 - DNA, 20 bp, Human adenovirus
ggcataatgcagcttcagaa

SEQ ID NO: 42213 - DNA, 20 bp, Human adenovirus
agaaaatgcctgttttgtat

SEQ ID NO: 42214 - DNA, 20 bp, Human adenovirus
tgtattattgaagggaatgg

SEQ ID NO: 42215 - DNA, 20 bp, Human adenovirus
gtattattgaagggaatggc

SEQ ID NO: 42216 - DNA, 20 bp, Human adenovirus
tattattgaagggaatggct

SEQ ID NO: 42217 - DNA, 20 bp, Human adenovirus
tgctggaacctgaagtgttt

SEQ ID NO: 42218 - DNA, 20 bp, Human adenovirus
tctagagtgtgtttaaatgg

SEQ ID NO: 42219 - DNA, 20 bp, Human adenovirus
ctagagtgtgtttaaatggg

SEQ ID NO: 42220 - DNA, 20 bp, Human adenovirus
tagagtgtgtttaaatgggg

SEQ ID NO: 42221 - DNA, 20 bp, Human adenovirus
aaatggggtatttgatttat

SEQ ID NO: 42222 - DNA, 20 bp, Human adenovirus
atcaacattaacctatgcaa

SEQ ID NO: 42223 - DNA, 20 bp, Human adenovirus
acctatgcaactattggacc

SEQ ID NO: 42224 - DNA, 20 bp, Human adenovirus
gaccctcgcctttggatacc

SEQ ID NO: 42225 - DNA, 20 bp, Human adenovirus
ggataccgccgccgccgctg

SEQ ID NO: 42226 - DNA, 20 bp, Human adenovirus
gataccgccgccgccgctgc

SEQ ID NO: 42227 - DNA, 20 bp, Human adenovirus
cctatcattaagaacacggt

SEQ ID NO: 42228 - DNA, 20 bp, Human adenovirus
agaacacggtgaatgtgttc

SEQ ID NO: 42229 - DNA, 20 bp, Human adenovirus
cagtattttgtaaagatgag

SEQ ID NO: 42230 - DNA, 20 bp, Human adenovirus
tgtaaagatgagcctgtata

SEQ ID NO: 42231 - DNA, 20 bp, Human adenovirus
gtaaagatgagcctgtatat

SEQ ID NO: 42232 - DNA, 20 bp, Human adenovirus
cctgccaaatctcttcttgg

SEQ ID NO: 42233 - DNA, 20 bp, Human adenovirus
ttggattcatattgtggaga

SEQ ID NO: 42234 - DNA, 20 bp, Human adenovirus
gattcatattgtggagaacc

SEQ ID NO: 42235 - DNA, 20 bp, Human adenovirus
atattgtggagaaccacgaa

SEQ ID NO: 42236 - DNA, 20 bp, Human adenovirus
tggagaaccacgaaaacggt

SEQ ID NO: 42237 - DNA, 20 bp, Human adenovirus
cgcaacaactgagacttccc

SEQ ID NO: 42238 - DNA, 20 bp, Human adenovirus
ccacagccagtgggtccata

SEQ ID NO: 42239 - DNA, 20 bp, Human adenovirus
ccccaattacaggttgcaag

SEQ ID NO: 42240 - DNA, 20 bp, Human adenovirus
caggttgcaagtgatagttt

SEQ ID NO: 42241 - DNA, 20 bp, Human adenovirus
caagtgatagtttaacgagg

SEQ ID NO: 42242 - DNA, 20 bp, Human adenovirus
tattttctatgccatctcga

SEQ ID NO: 42243 - DNA, 20 bp, Human adenovirus
tctatgccatctcgatccag

SEQ ID NO: 42244 - DNA, 20 bp, Human adenovirus
ctatgccatctcgatccagc

SEQ ID NO: 42245 - DNA, 20 bp, Human adenovirus
tatgccatctcgatccagca

SEQ ID NO: 42246 - DNA, 20 bp, Human adenovirus
ctcgttgcgggggtttggct

SEQ ID NO: 42247 - DNA, 20 bp, Human adenovirus
agcccgtatttttcctttgg

SEQ ID NO: 42248 - DNA, 20 bp, Human adenovirus
gcccgtatttttcctttgga

SEQ ID NO: 42249 - DNA, 20 bp, Human adenovirus
ttcctttggaggtgctcccg

SEQ ID NO: 42250 - DNA, 20 bp, Human adenovirus
tcctttggaggtgctcccgc

SEQ ID NO: 42251 - DNA, 20 bp, Human adenovirus
cctttggaggtgctcccgca

SEQ ID NO: 42252 - DNA, 20 bp, Human adenovirus
agtggtattccgcggtcctc

SEQ ID NO: 42253 - DNA, 20 bp, Human adenovirus
cgcggtcctcctcgtacagg

SEQ ID NO: 42254 - DNA, 20 bp, Human adenovirus
tgaccactctgacacaaaag

SEQ ID NO: 42255 - DNA, 20 bp, Human adenovirus
ccatgtggcttcctttgtac

SEQ ID NO: 42256 - DNA, 20 bp, Human adenovirus
ctttgtacttgcttggacta

SEQ ID NO: 42257 - DNA, 20 bp, Human adenovirus
cttctgcttcgctgtttacg

SEQ ID NO: 42258 - DNA, 20 bp, Human adenovirus
ttctgcttcgctgtttacga

SEQ ID NO: 42259 - DNA, 20 bp, Human adenovirus
tgcttcgctgtttacgagcg

SEQ ID NO: 42260 - DNA, 20 bp, Human adenovirus
gctgtttacgagcgccaact

SEQ ID NO: 42261 - DNA, 20 bp, Human adenovirus
acgagcgccaactggttggg

SEQ ID NO: 42262 - DNA, 20 bp, Human adenovirus
cacatattcgcgtgccaggc

SEQ ID NO: 42263 - DNA, 20 bp, Human adenovirus
gcgtgccaggcatttccagg

SEQ ID NO: 42264 - DNA, 20 bp, Human adenovirus
ccaggtggggaaaatggtgg

SEQ ID NO: 42265 - DNA, 20 bp, Human adenovirus
caggtggggaaaatggtggt

SEQ ID NO: 42266 - DNA, 20 bp, Human adenovirus
tgcagtgtaaccagatctac

SEQ ID NO: 42267 - DNA, 20 bp, Human adenovirus
aggggaggaccccaaggcat

SEQ ID NO: 42268 - DNA, 20 bp, Human adenovirus
tagtactcctatgtaagtag

SEQ ID NO: 42269 - DNA, 20 bp, Human adenovirus
agtactcctatgtaagtagg

SEQ ID NO: 42270 - DNA, 20 bp, Human adenovirus
gtactcctatgtaagtagga

SEQ ID NO: 42271 - DNA, 20 bp, Human adenovirus
gcgccagcattcgtggcggc

SEQ ID NO: 42272 - DNA, 20 bp, Human adenovirus
cagtactcctccaggggaaa

SEQ ID NO: 42273 - DNA, 20 bp, Human adenovirus
gcatctgcacggtaagaacc

SEQ ID NO: 42274 - DNA, 20 bp, Human adenovirus
catctgcacggtaagaacca

SEQ ID NO: 42275 - DNA, 20 bp, Human adenovirus
accgccttgtacggacaaca

SEQ ID NO: 42276 - DNA, 20 bp, Human adenovirus
ccgccttgtacggacaacat

SEQ ID NO: 42277 - DNA, 20 bp, Human adenovirus
gaataaaatttctagaaatt

SEQ ID NO: 42278 - DNA, 20 bp, Human adenovirus
ctagaaattttaaagggtcc

SEQ ID NO: 42279 - DNA, 20 bp, Human adenovirus
tagaaattttaaagggtcca

SEQ ID NO: 42280 - DNA, 20 bp, Human adenovirus
taaagggtccagggacgtcc

SEQ ID NO: 42281 - DNA, 20 bp, Human adenovirus
aaagggtccagggacgtcca

SEQ ID NO: 42282 - DNA, 20 bp, Human adenovirus
accgaccttcattttttctg

SEQ ID NO: 42283 - DNA, 20 bp, Human adenovirus
attttttctggggttaagca

SEQ ID NO: 42284 - DNA, 20 bp, Human adenovirus
tttctggggttaagcagtag

SEQ ID NO: 42285 - DNA, 20 bp, Human adenovirus
ttctggggttaagcagtaga

SEQ ID NO: 42286 - DNA, 20 bp, Human adenovirus
tctggggttaagcagtagaa

SEQ ID NO: 42287 - DNA, 20 bp, Human adenovirus
atgctgatgtttgtaaaagc

SEQ ID NO: 42288 - DNA, 20 bp, Human adenovirus
gtaaaagcgtgcgcagtgtt

SEQ ID NO: 42289 - DNA, 20 bp, Human adenovirus
taaaagcgtgcgcagtgttc

SEQ ID NO: 42290 - DNA, 20 bp, Human adenovirus
gcatcgttgcacgggctgta

SEQ ID NO: 42291 - DNA, 20 bp, Human adenovirus
cacgggctgtatctgttgaa

SEQ ID NO: 42292 - DNA, 20 bp, Human adenovirus
ggatcctcgaaagcgagaac

SEQ ID NO: 42293 - DNA, 20 bp, Human adenovirus
gatcctcgaaagcgagaacg

SEQ ID NO: 42294 - DNA, 20 bp, Human adenovirus
cagcacgagaggggcggaaa

SEQ ID NO: 42295 - DNA, 20 bp, Human adenovirus
agcacgagaggggcggaaac

SEQ ID NO: 42296 - DNA, 20 bp, Human adenovirus
cccgtttccgcccctctcgt

SEQ ID NO: 42297 - DNA, 20 bp, Human adenovirus
tccaatgcgcctgcttaaaa

SEQ ID NO: 42298 - DNA, 20 bp, Human adenovirus
ccaatgcgcctgcttaaaat

SEQ ID NO: 42299 - DNA, 20 bp, Human adenovirus
caatgcgcctgcttaaaatc

SEQ ID NO: 42300 - DNA, 20 bp, Human adenovirus
aaatcggcggcgcggacgag

SEQ ID NO: 42301 - DNA, 20 bp, Human adenovirus
gggtcctgcgggaagcgggg

SEQ ID NO: 42302 - DNA, 20 bp, Human adenovirus
attgatcaatttcttcctcc

SEQ ID NO: 42303 - DNA, 20 bp, Human adenovirus
atcaatttcttcctcctgga

SEQ ID NO: 42304 - DNA, 20 bp, Human adenovirus
cttcctcctggaggtctcca

SEQ ID NO: 42305 - DNA, 20 bp, Human adenovirus
ttcctcctggaggtctccat

SEQ ID NO: 42306 - DNA, 20 bp, Human adenovirus
ctcctggaggtctccatgtc

SEQ ID NO: 42307 - DNA, 20 bp, Human adenovirus
gacgccggcgaacgggcagc

SEQ ID NO: 42308 - DNA, 20 bp, Human adenovirus
caatcatttcgccgcgacgg

SEQ ID NO: 42309 - DNA, 20 bp, Human adenovirus
aatcatttcgccgcgacggc

SEQ ID NO: 42310 - DNA, 20 bp, Human adenovirus
cgccgcgacggcggcgcata

SEQ ID NO: 42311 - DNA, 20 bp, Human adenovirus
gccgcgacggcggcgcatag

SEQ ID NO: 42312 - DNA, 20 bp, Human adenovirus
tgtttcttctaaagtaccag

SEQ ID NO: 42313 - DNA, 20 bp, Human adenovirus
gtttcttctaaagtaccagg

SEQ ID NO: 42314 - DNA, 20 bp, Human adenovirus
tttcttctaaagtaccagga

SEQ ID NO: 42315 - DNA, 20 bp, Human adenovirus
cttctaaagtaccaggaagc

SEQ ID NO: 42316 - DNA, 20 bp, Human adenovirus
ttctaaagtaccaggaagct

SEQ ID NO: 42317 - DNA, 20 bp, Human adenovirus
gggtaagggtggttgcaaag

SEQ ID NO: 42318 - DNA, 20 bp, Human adenovirus
ggtaagggtggttgcaaagt

SEQ ID NO: 42319 - DNA, 20 bp, Human adenovirus
caaagtcatccacatctaca

SEQ ID NO: 42320 - DNA, 20 bp, Human adenovirus
atggtgtagctgcagtttgt

SEQ ID NO: 42321 - DNA, 20 bp, Human adenovirus
gtcattactgaccaattaac

SEQ ID NO: 42322 - DNA, 20 bp, Human adenovirus
atatatgtatctggacatcc

SEQ ID NO: 42323 - DNA, 20 bp, Human adenovirus
ttgctcgcataaattcgcgg

SEQ ID NO: 42324 - DNA, 20 bp, Human adenovirus
ctcgcataaattcgcgggct

SEQ ID NO: 42325 - DNA, 20 bp, Human adenovirus
gcgggctcggttccaaatat

SEQ ID NO: 42326 - DNA, 20 bp, Human adenovirus
caaatattgcgcaggggtaa

SEQ ID NO: 42327 - DNA, 20 bp, Human adenovirus
gaaaccggcaggatccgcta

SEQ ID NO: 42328 - DNA, 20 bp, Human adenovirus
cgcgttgaacccggccaagg

SEQ ID NO: 42329 - DNA, 20 bp, Human adenovirus
aacccggccaaggaccccca

SEQ ID NO: 42330 - DNA, 20 bp, Human adenovirus
gccgggttcaacgcgcaagc

SEQ ID NO: 42331 - DNA, 20 bp, Human adenovirus
aacgcgcaagcgcctcactt

SEQ ID NO: 42332 - DNA, 20 bp, Human adenovirus
gtgcctcgtcagaacatgtt

SEQ ID NO: 42333 - DNA, 20 bp, Human adenovirus
tgcctcgtcagaacatgttt

SEQ ID NO: 42334 - DNA, 20 bp, Human adenovirus
cgcgacaacagcggggagga

SEQ ID NO: 42335 - DNA, 20 bp, Human adenovirus
gcgacaacagcggggaggaa

SEQ ID NO: 42336 - DNA, 20 bp, Human adenovirus
cctcagcttcctccccgctg

SEQ ID NO: 42337 - DNA, 20 bp, Human adenovirus
gtttaatgcatctttgggac

SEQ ID NO: 42338 - DNA, 20 bp, Human adenovirus
aatgcatctttgggactttg

SEQ ID NO: 42339 - DNA, 20 bp, Human adenovirus
atgcatctttgggactttgt

SEQ ID NO: 42340 - DNA, 20 bp, Human adenovirus
gggactttgtagaagcttat

SEQ ID NO: 42341 - DNA, 20 bp, Human adenovirus
ggactttgtagaagcttatg

SEQ ID NO: 42342 - DNA, 20 bp, Human adenovirus
tttgatatgggcgcagacct

SEQ ID NO: 42343 - DNA, 20 bp, Human adenovirus
gatatgggcgcagacctacg

SEQ ID NO: 42344 - DNA, 20 bp, Human adenovirus
atatgggcgcagacctacgg

SEQ ID NO: 42345 - DNA, 20 bp, Human adenovirus
ggaggcagctggagtggcgt

SEQ ID NO: 42346 - DNA, 20 bp, Human adenovirus
gaggcagctggagtggcgtc

SEQ ID NO: 42347 - DNA, 20 bp, Human adenovirus
accattgtaaatgctttgtt

SEQ ID NO: 42348 - DNA, 20 bp, Human adenovirus
taaatgctttgttggatagc

SEQ ID NO: 42349 - DNA, 20 bp, Human adenovirus
gttggatagcaaagccatcc

SEQ ID NO: 42350 - DNA, 20 bp, Human adenovirus
ttggatagcaaagccatccg

SEQ ID NO: 42351 - DNA, 20 bp, Human adenovirus
gatagcaaagccatccgcaa

SEQ ID NO: 42352 - DNA, 20 bp, Human adenovirus
ctgaagtgcctcaaagtgaa

SEQ ID NO: 42353 - DNA, 20 bp, Human adenovirus
cttttttcaaacgtccaggc

SEQ ID NO: 42354 - DNA, 20 bp, Human adenovirus
tttcaaacgtccaggcaggg

SEQ ID NO: 42355 - DNA, 20 bp, Human adenovirus
ttcaaacgtccaggcagggt

SEQ ID NO: 42356 - DNA, 20 bp, Human adenovirus
tcaaacgtccaggcagggtt

SEQ ID NO: 42357 - DNA, 20 bp, Human adenovirus
atggattaccttcaccgcgc

SEQ ID NO: 42358 - DNA, 20 bp, Human adenovirus
ccttcaccgcgctgcggcca

SEQ ID NO: 42359 - DNA, 20 bp, Human adenovirus
accgcgctgcggccatgaac

SEQ ID NO: 42360 - DNA, 20 bp, Human adenovirus
acaaatgcaattctaaatcc

SEQ ID NO: 42361 - DNA, 20 bp, Human adenovirus
caaatgcaattctaaatccg

SEQ ID NO: 42362 - DNA, 20 bp, Human adenovirus
gccctcctaggcaacgttgg

SEQ ID NO: 42363 - DNA, 20 bp, Human adenovirus
gcagcgacgcaaaaaagggg

SEQ ID NO: 42364 - DNA, 20 bp, Human adenovirus
cttcatcccccgcatgtgcc

SEQ ID NO: 42365 - DNA, 20 bp, Human adenovirus
atcccccgcatgtgcccctt

SEQ ID NO: 42366 - DNA, 20 bp, Human adenovirus
tttgcgtcgctgccaacgtt

SEQ ID NO: 42367 - DNA, 20 bp, Human adenovirus
gatgaaaggtctagatgggg

SEQ ID NO: 42368 - DNA, 20 bp, Human adenovirus
atgaaaggtctagatggggt

SEQ ID NO: 42369 - DNA, 20 bp, Human adenovirus
aaaaaccatcttacatacca

SEQ ID NO: 42370 - DNA, 20 bp, Human adenovirus
aaaaccatcttacataccaa

SEQ ID NO: 42371 - DNA, 20 bp, Human adenovirus
cataccaacatgccaaacgt

SEQ ID NO: 42372 - DNA, 20 bp, Human adenovirus
gagttaagtttgacaccaga

SEQ ID NO: 42373 - DNA, 20 bp, Human adenovirus
agtttgacaccagaaacttt

SEQ ID NO: 42374 - DNA, 20 bp, Human adenovirus
gacaccagaaactttcgtct

SEQ ID NO: 42375 - DNA, 20 bp, Human adenovirus
acaccagaaactttcgtctg

SEQ ID NO: 42376 - DNA, 20 bp, Human adenovirus
cgtctgggttgggaccccga

SEQ ID NO: 42377 - DNA, 20 bp, Human adenovirus
aaccggttgaaacagacccc

SEQ ID NO: 42378 - DNA, 20 bp, Human adenovirus
aaacagaccccaaaggacgc

SEQ ID NO: 42379 - DNA, 20 bp, Human adenovirus
caacttgcttccagacaaaa

SEQ ID NO: 42380 - DNA, 20 bp, Human adenovirus
cttccagacaaaaaaaatac

SEQ ID NO: 42381 - DNA, 20 bp, Human adenovirus
cagacaaaaaaaatactaaa

SEQ ID NO: 42382 - DNA, 20 bp, Human adenovirus
ccgagctccatggggcgcgc

SEQ ID NO: 42383 - DNA, 20 bp, Human adenovirus
gctagaccttgttttagctc

SEQ ID NO: 42384 - DNA, 20 bp, Human adenovirus
ttttagctcctccatacatg

SEQ ID NO: 42385 - DNA, 20 bp, Human adenovirus
tagctcctccatacatgcgg

SEQ ID NO: 42386 - DNA, 20 bp, Human adenovirus
agctcctccatacatgcggg

SEQ ID NO: 42387 - DNA, 20 bp, Human adenovirus
gacgggccaggcgcattggg

SEQ ID NO: 42388 - DNA, 20 bp, Human adenovirus
ggcggcgagctatgatgcgg

SEQ ID NO: 42389 - DNA, 20 bp, Human adenovirus
caaacctagctgctccgcga

SEQ ID NO: 42390 - DNA, 20 bp, Human adenovirus
cctcgtcgcggagcagctag

SEQ ID NO: 42391 - DNA, 20 bp, Human adenovirus
ctcgtcgcggagcagctagg

SEQ ID NO: 42392 - DNA, 20 bp, Human adenovirus
aaaaacgggaaaaaaaagag

SEQ ID NO: 42393 - DNA, 20 bp, Human adenovirus
gtgcgctcatttgcgcccag

SEQ ID NO: 42394 - DNA, 20 bp, Human adenovirus
tgcgctcatttgcgcccaga

SEQ ID NO: 42395 - DNA, 20 bp, Human adenovirus
gcgcccagacgtagggtaca

SEQ ID NO: 42396 - DNA, 20 bp, Human adenovirus
cgcccagacgtagggtacag

SEQ ID NO: 42397 - DNA, 20 bp, Human adenovirus
cagcctacaatgcaactgat

SEQ ID NO: 42398 - DNA, 20 bp, Human adenovirus
gaggacgtactagagcacat

SEQ ID NO: 42399 - DNA, 20 bp, Human adenovirus
catctggctgtacgctagga

SEQ ID NO: 42400 - DNA, 20 bp, Human adenovirus
atgtgctctagtacgtcctc

SEQ ID NO: 42401 - DNA, 20 bp, Human adenovirus
tgccgcttaggcaccatcag

SEQ ID NO: 42402 - DNA, 20 bp, Human adenovirus
tcagcgccgagccacagccc

SEQ ID NO: 42403 - DNA, 20 bp, Human adenovirus
cagcgccgagccacagcccc

SEQ ID NO: 42404 - DNA, 20 bp, Human adenovirus
agcgccgagccacagcccct

SEQ ID NO: 42405 - DNA, 20 bp, Human adenovirus
gcgtcgacgtctacggcgtg

SEQ ID NO: 42406 - DNA, 20 bp, Human adenovirus
cgtcgacgtctacggcgtga

SEQ ID NO: 42407 - DNA, 20 bp, Human adenovirus
caaccaaaggagaaaagcgg

SEQ ID NO: 42408 - DNA, 20 bp, Human adenovirus
ctaaggtttcctctgcatcc

SEQ ID NO: 42409 - DNA, 20 bp, Human adenovirus
cctctgcatccggccgtggc

SEQ ID NO: 42410 - DNA, 20 bp, Human adenovirus
ctctgcatccggccgtggcc

SEQ ID NO: 42411 - DNA, 20 bp, Human adenovirus
tctcctttggttggaacgga

SEQ ID NO: 42412 - DNA, 20 bp, Human adenovirus
caagatggccactccctcga

SEQ ID NO: 42413 - DNA, 20 bp, Human adenovirus
aagatggccactccctcgat

SEQ ID NO: 42414 - DNA, 20 bp, Human adenovirus
aaagcgctggtggtgactgc

SEQ ID NO: 42415 - DNA, 20 bp, Human adenovirus
gacatggctagttcttactt

SEQ ID NO: 42416 - DNA, 20 bp, Human adenovirus
ttactttgacattcgagggg

SEQ ID NO: 42417 - DNA, 20 bp, Human adenovirus
ctttgacattcgaggggtac

SEQ ID NO: 42418 - DNA, 20 bp, Human adenovirus
gacattcgaggggtactgga

SEQ ID NO: 42419 - DNA, 20 bp, Human adenovirus
acattcgaggggtactggat

SEQ ID NO: 42420 - DNA, 20 bp, Human adenovirus
aacttaagttctttgattca

SEQ ID NO: 42421 - DNA, 20 bp, Human adenovirus
agttctttgattcagctaac

SEQ ID NO: 42422 - DNA, 20 bp, Human adenovirus
tttgattcagctaacaatgc

SEQ ID NO: 42423 - DNA, 20 bp, Human adenovirus
gattcagctaacaatgcagc

SEQ ID NO: 42424 - DNA, 20 bp, Human adenovirus
attcagctaacaatgcagca

SEQ ID NO: 42425 - DNA, 20 bp, Human adenovirus
gggagacagaacacggtact

SEQ ID NO: 42426 - DNA, 20 bp, Human adenovirus
ggagacagaacacggtactt

SEQ ID NO: 42427 - DNA, 20 bp, Human adenovirus
tccttgtggaattccgcagt

SEQ ID NO: 42428 - DNA, 20 bp, Human adenovirus
ccttgtggaattccgcagtg

SEQ ID NO: 42429 - DNA, 20 bp, Human adenovirus
cttgtggaattccgcagtgg

SEQ ID NO: 42430 - DNA, 20 bp, Human adenovirus
tacctaccagacgacttaaa

SEQ ID NO: 42431 - DNA, 20 bp, Human adenovirus
aaatacactccaggaaacat

SEQ ID NO: 42432 - DNA, 20 bp, Human adenovirus
atgtactcgtaggtgttctt

SEQ ID NO: 42433 - DNA, 20 bp, Human adenovirus
ttgttatcaggtagttttat

SEQ ID NO: 42434 - DNA, 20 bp, Human adenovirus
ttatcaggtagttttatgtt

SEQ ID NO: 42435 - DNA, 20 bp, Human adenovirus
cgaatggaactttagaaagg

SEQ ID NO: 42436 - DNA, 20 bp, Human adenovirus
agaaaggatgtaaacatgat

SEQ ID NO: 42437 - DNA, 20 bp, Human adenovirus
gaaaggatgtaaacatgatt

SEQ ID NO: 42438 - DNA, 20 bp, Human adenovirus
ttcagagcacactgggaaat

SEQ ID NO: 42439 - DNA, 20 bp, Human adenovirus
agagcacactgggaaatgat

SEQ ID NO: 42440 - DNA, 20 bp, Human adenovirus
gtatactctggaaccattcc

SEQ ID NO: 42441 - DNA, 20 bp, Human adenovirus
tatactctggaaccattccc

SEQ ID NO: 42442 - DNA, 20 bp, Human adenovirus
cctatttagacggcaccttt

SEQ ID NO: 42443 - DNA, 20 bp, Human adenovirus
agacggcaccttttacctaa

SEQ ID NO: 42444 - DNA, 20 bp, Human adenovirus
gacggcaccttttacctaaa

SEQ ID NO: 42445 - DNA, 20 bp, Human adenovirus
caacataacaactcaggatt

SEQ ID NO: 42446 - DNA, 20 bp, Human adenovirus
aacataacaactcaggattc

SEQ ID NO: 42447 - DNA, 20 bp, Human adenovirus
gtgggatacctgggccccac

SEQ ID NO: 42448 - DNA, 20 bp, Human adenovirus
ccccgccaactatccctacc

SEQ ID NO: 42449 - DNA, 20 bp, Human adenovirus
gcggggtaagcttgtccctc

SEQ ID NO: 42450 - DNA, 20 bp, Human adenovirus
aagcgaacaggagctgacgg

SEQ ID NO: 42451 - DNA, 20 bp, Human adenovirus
ttcgagatctaggctgtgga

SEQ ID NO: 42452 - DNA, 20 bp, Human adenovirus
gagatctaggctgtggaccc

SEQ ID NO: 42453 - DNA, 20 bp, Human adenovirus
tttgggaacctttgacaaac

SEQ ID NO: 42454 - DNA, 20 bp, Human adenovirus
ttgggaacctttgacaaacg

SEQ ID NO: 42455 - DNA, 20 bp, Human adenovirus
tctgcagcgtgcggcctgtt

SEQ ID NO: 42456 - DNA, 20 bp, Human adenovirus
ctgcagcgtgcggcctgttt

SEQ ID NO: 42457 - DNA, 20 bp, Human adenovirus
tgcagcgtgcggcctgtttt

SEQ ID NO: 42458 - DNA, 20 bp, Human adenovirus
tgttgtatgttcttacacgc

SEQ ID NO: 42459 - DNA, 20 bp, Human adenovirus
gttgtatgttcttacacgct

SEQ ID NO: 42460 - DNA, 20 bp, Human adenovirus
ctgtactgcaaacgctgatg

SEQ ID NO: 42461 - DNA, 20 bp, Human adenovirus
tgtactgcaaacgctgatgc

SEQ ID NO: 42462 - DNA, 20 bp, Human adenovirus
aattctggaataacaagcct

SEQ ID NO: 42463 - DNA, 20 bp, Human adenovirus
tggaataacaagcctagggg

SEQ ID NO: 42464 - DNA, 20 bp, Human adenovirus
tctccccacagctggcgcac

SEQ ID NO: 42465 - DNA, 20 bp, Human adenovirus
ttgcccatgtcgcatgtgag

SEQ ID NO: 42466 - DNA, 20 bp, Human adenovirus
tgcccatgtcgcatgtgagg

SEQ ID NO: 42467 - DNA, 20 bp, Human adenovirus
gcccatgtcgcatgtgaggg

SEQ ID NO: 42468 - DNA, 20 bp, Human adenovirus
cccatgtcgcatgtgagggt

SEQ ID NO: 42469 - DNA, 20 bp, Human adenovirus
aatttgcctaaaagctattt

SEQ ID NO: 42470 - DNA, 20 bp, Human adenovirus
gcgctcggtacacttatgct

SEQ ID NO: 42471 - DNA, 20 bp, Human adenovirus
tgctcccacacgcagcaacc

SEQ ID NO: 42472 - DNA, 20 bp, Human adenovirus
ccaggaattctgttggacac

SEQ ID NO: 42473 - DNA, 20 bp, Human adenovirus
tgttggacaccggcataagc

SEQ ID NO: 42474 - DNA, 20 bp, Human adenovirus
gacaccggcataagcttgca

SEQ ID NO: 42475 - DNA, 20 bp, Human adenovirus
ccaagctgaaactaggggct

SEQ ID NO: 42476 - DNA, 20 bp, Human adenovirus
ccggattgcgaacaacaaca

SEQ ID NO: 42477 - DNA, 20 bp, Human adenovirus
cgaacaacaacaacattctt

SEQ ID NO: 42478 - DNA, 20 bp, Human adenovirus
ttttcattttcgtcgctgtt

SEQ ID NO: 42479 - DNA, 20 bp, Human adenovirus
tcattttcgtcgctgttttg

SEQ ID NO: 42480 - DNA, 20 bp, Human adenovirus
agcagaacttgggctacgag

SEQ ID NO: 42481 - DNA, 20 bp, Human adenovirus
ggctacgagactccccccga

SEQ ID NO: 42482 - DNA, 20 bp, Human adenovirus
gaaggctttcttcaaatcca

SEQ ID NO: 42483 - DNA, 20 bp, Human adenovirus
aaggctttcttcaaatccaa

SEQ ID NO: 42484 - DNA, 20 bp, Human adenovirus
cttcaaatccaaaagcaacc

SEQ ID NO: 42485 - DNA, 20 bp, Human adenovirus
tctttaaaaatcacaaaata

SEQ ID NO: 42486 - DNA, 20 bp, Human adenovirus
ctttaaaaatcacaaaatac

SEQ ID NO: 42487 - DNA, 20 bp, Human adenovirus
tttaaaaatcacaaaatacc

SEQ ID NO: 42488 - DNA, 20 bp, Human adenovirus
aaaaatcacaaaatacccct

SEQ ID NO: 42489 - DNA, 20 bp, Human adenovirus
aaaatcacaaaataccccta

SEQ ID NO: 42490 - DNA, 20 bp, Human adenovirus
agcgagcccaacccattgac

SEQ ID NO: 42491 - DNA, 20 bp, Human adenovirus
acaaagatgcaaacttgcaa

SEQ ID NO: 42492 - DNA, 20 bp, Human adenovirus
caagacccggaggcaacaga

SEQ ID NO: 42493 - DNA, 20 bp, Human adenovirus
taagcgacgagcaattaact

SEQ ID NO: 42494 - DNA, 20 bp, Human adenovirus
actaagtggttgggaacaga

SEQ ID NO: 42495 - DNA, 20 bp, Human adenovirus
catacctggcaaactgggat

SEQ ID NO: 42496 - DNA, 20 bp, Human adenovirus
ggcagcaatgcttggaagaa

SEQ ID NO: 42497 - DNA, 20 bp, Human adenovirus
gcagcaatgcttggaagaaa

SEQ ID NO: 42498 - DNA, 20 bp, Human adenovirus
gaagaaaaaaaccttcgaga

SEQ ID NO: 42499 - DNA, 20 bp, Human adenovirus
gagaactaaacaaactgtta

SEQ ID NO: 42500 - DNA, 20 bp, Human adenovirus
gtaccttcgaaatgcaggga

SEQ ID NO: 42501 - DNA, 20 bp, Human adenovirus
gaaatgcagggaccgcagtc

SEQ ID NO: 42502 - DNA, 20 bp, Human adenovirus
cacgacgaacctaagactta

SEQ ID NO: 42503 - DNA, 20 bp, Human adenovirus
acgacgaacctaagacttac

SEQ ID NO: 42504 - DNA, 20 bp, Human adenovirus
cccctgggctttggacttct

SEQ ID NO: 42505 - DNA, 20 bp, Human adenovirus
gcagcatgtccccgaaagcc

SEQ ID NO: 42506 - DNA, 20 bp, Human adenovirus
cgcagcaacgctcaaagaaa

SEQ ID NO: 42507 - DNA, 20 bp, Human adenovirus
ttcctcccagatttcctgcc

SEQ ID NO: 42508 - DNA, 20 bp, Human adenovirus
ctcccagatttcctgccgtt

SEQ ID NO: 42509 - DNA, 20 bp, Human adenovirus
cctgccgttgctgctgtttc

SEQ ID NO: 42510 - DNA, 20 bp, Human adenovirus
ggtaagaatcgcaagcaggc

SEQ ID NO: 42511 - DNA, 20 bp, Human adenovirus
tagcctgctttcagcactgc

SEQ ID NO: 42512 - DNA, 20 bp, Human adenovirus
cagcactgcggggggaatat

SEQ ID NO: 42513 - DNA, 20 bp, Human adenovirus
agcactgcggggggaatatc

SEQ ID NO: 42514 - DNA, 20 bp, Human adenovirus
gcaaggcggtatttgctata

SEQ ID NO: 42515 - DNA, 20 bp, Human adenovirus
atatgctatttttcagcaga

SEQ ID NO: 42516 - DNA, 20 bp, Human adenovirus
tatgctatttttcagcagag

SEQ ID NO: 42517 - DNA, 20 bp, Human adenovirus
ttcagcagagtcgaggtcaa

SEQ ID NO: 42518 - DNA, 20 bp, Human adenovirus
tcagcagagtcgaggtcaag

SEQ ID NO: 42519 - DNA, 20 bp, Human adenovirus
cagcagagtcgaggtcaaga

SEQ ID NO: 42520 - DNA, 20 bp, Human adenovirus
accctccctcttggccagct

SEQ ID NO: 42521 - DNA, 20 bp, Human adenovirus
gccagctgccctgatatatc

SEQ ID NO: 42522 - DNA, 20 bp, Human adenovirus
tcctgatatatcagggcagc

SEQ ID NO: 42523 - DNA, 20 bp, Human adenovirus
cctgatatatcagggcagct

SEQ ID NO: 42524 - DNA, 20 bp, Human adenovirus
ctgatatatcagggcagctg

SEQ ID NO: 42525 - DNA, 20 bp, Human adenovirus
actttatattgcatttgtcc

SEQ ID NO: 42526 - DNA, 20 bp, Human adenovirus
atattgcatttgtcctgttc

SEQ ID NO: 42527 - DNA, 20 bp, Human adenovirus
tattgcatttgtcctgttcc

SEQ ID NO: 42528 - DNA, 20 bp, Human adenovirus
catttgtcctgttcccggat

SEQ ID NO: 42529 - DNA, 20 bp, Human adenovirus
gtcctgttcccggattacat

SEQ ID NO: 42530 - DNA, 20 bp, Human adenovirus
tttgttgctccagttattga

SEQ ID NO: 42531 - DNA, 20 bp, Human adenovirus
ttgttgctccagttattgac

SEQ ID NO: 42532 - DNA, 20 bp, Human adenovirus
tgttgctccagttattgaca

SEQ ID NO: 42533 - DNA, 20 bp, Human adenovirus
gttgctccagttattgacaa

SEQ ID NO: 42534 - DNA, 20 bp, Human adenovirus
ttgctccagttattgacaaa

SEQ ID NO: 42535 - DNA, 20 bp, Human adenovirus
gtattcatactaacaatgct

SEQ ID NO: 42536 - DNA, 20 bp, Human adenovirus
tattcatactaacaatgctt

SEQ ID NO: 42537 - DNA, 20 bp, Human adenovirus
atactaacaatgctttccat

SEQ ID NO: 42538 - DNA, 20 bp, Human adenovirus
ccatttttcttttatttctc

SEQ ID NO: 42539 - DNA, 20 bp, Human adenovirus
catttttcttttatttctct

SEQ ID NO: 42540 - DNA, 20 bp, Human adenovirus
ccccaataaggttgtgttta

SEQ ID NO: 42541 - DNA, 20 bp, Human adenovirus
tgtttaataatgtcagtcga

SEQ ID NO: 42542 - DNA, 20 bp, Human adenovirus
aataatgtcagtcgatggta

SEQ ID NO: 42543 - DNA, 20 bp, Human adenovirus
ataatgtcagtcgatggtac

SEQ ID NO: 42544 - DNA, 20 bp, Human adenovirus
ccaactactttataactaac

SEQ ID NO: 42545 - DNA, 20 bp, Human adenovirus
cttactagttttcttttttc

SEQ ID NO: 42546 - DNA, 20 bp, Human adenovirus
ctagttttcttttttcttac

SEQ ID NO: 42547 - DNA, 20 bp, Human adenovirus
tcttttttcttacagtatgg

SEQ ID NO: 42548 - DNA, 20 bp, Human adenovirus
cttttttcttacagtatggt

SEQ ID NO: 42549 - DNA, 20 bp, Human adenovirus
ttttttcttacagtatggtg

SEQ ID NO: 42550 - DNA, 20 bp, Human adenovirus
attttagttggaataagtat

SEQ ID NO: 42551 - DNA, 20 bp, Human adenovirus
tagttggaataagtatactg

SEQ ID NO: 42552 - DNA, 20 bp, Human adenovirus
agttggaataagtatactga

SEQ ID NO: 42553 - DNA, 20 bp, Human adenovirus
gttggaataagtatactgat

SEQ ID NO: 42554 - DNA, 20 bp, Human adenovirus
gaataagtatactgatgatc

SEQ ID NO: 42555 - DNA, 20 bp, Human adenovirus
gctatgaatctttaccaggc

SEQ ID NO: 42556 - DNA, 20 bp, Human adenovirus
accaggcaaagaacatcaac

SEQ ID NO: 42557 - DNA, 20 bp, Human adenovirus
ccaggcaaagaacatcaact

SEQ ID NO: 42558 - DNA, 20 bp, Human adenovirus
cagtaaaggtttgtcgctga

SEQ ID NO: 42559 - DNA, 20 bp, Human adenovirus
gtcgctgagtgggcagcgtg

SEQ ID NO: 42560 - DNA, 20 bp, Human adenovirus
taaaatttccctcttcccaa

SEQ ID NO: 42561 - DNA, 20 bp, Human adenovirus
ccctcttcccaactgtcaaa

SEQ ID NO: 42562 - DNA, 20 bp, Human adenovirus
cctcttcccaactgtcaaac

SEQ ID NO: 42563 - DNA, 20 bp, Human adenovirus
ccaactgtcaaacctgacag

SEQ ID NO: 42564 - DNA, 20 bp, Human adenovirus
caaacagcaaactttctcca

SEQ ID NO: 42565 - DNA, 20 bp, Human adenovirus
cagctagtaataatatcaat

SEQ ID NO: 42566 - DNA, 20 bp, Human adenovirus
tggagccccttaccaacacc

SEQ ID NO: 42567 - DNA, 20 bp, Human adenovirus
ggagccccttaccaacacct

SEQ ID NO: 42568 - DNA, 20 bp, Human adenovirus
gagccccttaccaacacctc

SEQ ID NO: 42569 - DNA, 20 bp, Human adenovirus
ccaacacctcacaaggtctt

SEQ ID NO: 42570 - DNA, 20 bp, Human adenovirus
ctactgcagaccccataagt

SEQ ID NO: 42571 - DNA, 20 bp, Human adenovirus
gcaacaacgctcttacccta

SEQ ID NO: 42572 - DNA, 20 bp, Human adenovirus
ccctacctacggcagatccg

SEQ ID NO: 42573 - DNA, 20 bp, Human adenovirus
atggtgagctccgatgggtt

SEQ ID NO: 42574 - DNA, 20 bp, Human adenovirus
ggaataagtgtcactagtcc

SEQ ID NO: 42575 - DNA, 20 bp, Human adenovirus
ccgggggaatgagaacttct

SEQ ID NO: 42576 - DNA, 20 bp, Human adenovirus
tggcggtagaataattttag

SEQ ID NO: 42577 - DNA, 20 bp, Human adenovirus
tagatgttaattatcccttt

SEQ ID NO: 42578 - DNA, 20 bp, Human adenovirus
agatgttaattatccctttg

SEQ ID NO: 42579 - DNA, 20 bp, Human adenovirus
gatgttaattatccctttga

SEQ ID NO: 42580 - DNA, 20 bp, Human adenovirus
agtgtttgatgaacagggaa

SEQ ID NO: 42581 - DNA, 20 bp, Human adenovirus
gtgtttgatgaacagggaag

SEQ ID NO: 42582 - DNA, 20 bp, Human adenovirus
gatgaacagggaagattaat

SEQ ID NO: 42583 - DNA, 20 bp, Human adenovirus
atgaacagggaagattaatc

SEQ ID NO: 42584 - DNA, 20 bp, Human adenovirus
atcacatcaacccctactgc

SEQ ID NO: 42585 - DNA, 20 bp, Human adenovirus
tcttacattacccaagaata

SEQ ID NO: 42586 - DNA, 20 bp, Human adenovirus
cttacattacccaagaataa

SEQ ID NO: 42587 - DNA, 20 bp, Human adenovirus
ttacattacccaagaataaa

SEQ ID NO: 42588 - DNA, 20 bp, Human adenovirus
cattacccaagaataaaaac

SEQ ID NO: 42589 - DNA, 20 bp, Human adenovirus
cccaagaataaaaacacaca

SEQ ID NO: 42590 - DNA, 20 bp, Human adenovirus
cccatccaaaaccaggtcca

SEQ ID NO: 42591 - DNA, 20 bp, Human adenovirus
tatcctacaaaaagtaacaa

SEQ ID NO: 42592 - DNA, 20 bp, Human adenovirus
atcctacaaaaagtaacaac

SEQ ID NO: 42593 - DNA, 20 bp, Human adenovirus
tcctacaaaaagtaacaaca

SEQ ID NO: 42594 - DNA, 20 bp, Human adenovirus
tctcgttgattataatctcc

SEQ ID NO: 42595 - DNA, 20 bp, Human adenovirus
tgaaccagcgtcccaaaagc

SEQ ID NO: 42596 - DNA, 20 bp, Human adenovirus
gaaccagcgtcccaaaagca

SEQ ID NO: 42597 - DNA, 20 bp, Human adenovirus
aaccagcgtcccaaaagcat

SEQ ID NO: 42598 - DNA, 20 bp, Human adenovirus
ttcattgtcattgccagcgt

SEQ ID NO: 42599 - DNA, 20 bp, Human adenovirus
attgtcattgccagcgtccg

SEQ ID NO: 42600 - DNA, 20 bp, Human adenovirus
tccgaagtactcaacgtagc

SEQ ID NO: 42601 - DNA, 20 bp, Human adenovirus
ccgaagtactcaacgtagct

SEQ ID NO: 42602 - DNA, 20 bp, Human adenovirus
cgaagtactcaacgtagctt

SEQ ID NO: 42603 - DNA, 20 bp, Human adenovirus
tgactgttcctcacagggcg

SEQ ID NO: 42604 - DNA, 20 bp, Human adenovirus
gactgttcctcacagggcgg

SEQ ID NO: 42605 - DNA, 20 bp, Human adenovirus
gaatgcgtaaatctcgcagg

SEQ ID NO: 42606 - DNA, 20 bp, Human adenovirus
aatgcgtaaatctcgcaggt

SEQ ID NO: 42607 - DNA, 20 bp, Human adenovirus
caatttgatctggctgtgat

SEQ ID NO: 42608 - DNA, 20 bp, Human adenovirus
gatctggctgtgatctttca

SEQ ID NO: 42609 - DNA, 20 bp, Human adenovirus
atctggctgtgatctttcac

SEQ ID NO: 42610 - DNA, 20 bp, Human adenovirus
gtctcgcagctgacatctta

SEQ ID NO: 42611 - DNA, 20 bp, Human adenovirus
atgccagttgtataaaatca

SEQ ID NO: 42612 - DNA, 20 bp, Human adenovirus
tataaaatcatacaaatcag

SEQ ID NO: 42613 - DNA, 20 bp, Human adenovirus
acctccaggtacaagttccg

SEQ ID NO: 42614 - DNA, 20 bp, Human adenovirus
tacctggaggtgaactttct

SEQ ID NO: 42615 - DNA, 20 bp, Human adenovirus
aggttagcctgaaaaataaa

SEQ ID NO: 42616 - DNA, 20 bp, Human adenovirus
ggttagcctgaaaaataaaa

SEQ ID NO: 42617 - DNA, 20 bp, Human adenovirus
gcctgaaaaataaaaatatg

SEQ ID NO: 42618 - DNA, 20 bp, Human adenovirus
aattaaagatgcctggcaaa

SEQ ID NO: 42619 - DNA, 20 bp, Human adenovirus
aagatgcctggcaaacgggt

SEQ ID NO: 42620 - DNA, 20 bp, Human adenovirus
gcaggagaaaataacacata

SEQ ID NO: 42621 - DNA, 20 bp, Human adenovirus
gagtcgccctcttgtttagg

SEQ ID NO: 42622 - DNA, 20 bp, Human adenovirus
tttaggcaacatagccccag

SEQ ID NO: 42623 - DNA, 20 bp, Human adenovirus
aggcaacatagccccaggtc

SEQ ID NO: 42624 - DNA, 20 bp, Human adenovirus
ggcaacatagccccaggtcc

SEQ ID NO: 42625 - DNA, 20 bp, Human rhinovirus
acccgaggcgaaaagtgagg

SEQ ID NO: 42626 - DNA, 20 bp, Human rhinovirus
tcgttatccgcaaagtgcct

SEQ ID NO: 42627 - DNA, 20 bp, Human rhinovirus
tccgcaaagtgcctacgaga

SEQ ID NO: 42628 - DNA, 20 bp, Human rhinovirus
tgaagcctatggctggtcgc

SEQ ID NO: 42629 - DNA, 20 bp, Human rhinovirus
gaagcctatggctggtcgct

SEQ ID NO: 42630 - DNA, 20 bp, Human rhinovirus
actcaacccgtggctgatgt

SEQ ID NO: 42631 - DNA, 20 bp, Human rhinovirus
atgtctccctcagttgaggc

SEQ ID NO: 42632 - DNA, 20 bp, Human rhinovirus
aggcttgtgggttttccgat

SEQ ID NO: 42633 - DNA, 20 bp, Human rhinovirus
tgggttttccgataggctca

SEQ ID NO: 42634 - DNA, 20 bp, Human rhinovirus
tccgataggctcaagcaaat

SEQ ID NO: 42635 - DNA, 20 bp, Human rhinovirus
ttcacactcaatgcaacgcc

SEQ ID NO: 42636 - DNA, 20 bp, Human rhinovirus
acactcaatgcaacgccacc

SEQ ID NO: 42637 - DNA, 20 bp, Human rhinovirus
cacagtggatgtttgttggt

SEQ ID NO: 42638 - DNA, 20 bp, Human rhinovirus
acagtggatgtttgttggtg

SEQ ID NO: 42639 - DNA, 20 bp, Human rhinovirus
gttggtggcagtggtgcctg

SEQ ID NO: 42640 - DNA, 20 bp, Human rhinovirus
tcaggagctagacaggccat

SEQ ID NO: 42641 - DNA, 20 bp, Human rhinovirus
caggagctagacaggccatt

SEQ ID NO: 42642 - DNA, 20 bp, Human rhinovirus
aggagctagacaggccatta

SEQ ID NO: 42643 - DNA, 20 bp, Human rhinovirus
aagctaccgcacagggtcta

SEQ ID NO: 42644 - DNA, 20 bp, Human rhinovirus
atgacaacagaagatgaaca

SEQ ID NO: 42645 - DNA, 20 bp, Human rhinovirus
ttgtcccctggattagctcc

SEQ ID NO: 42646 - DNA, 20 bp, Human rhinovirus
tcccctggattagctcccat

SEQ ID NO: 42647 - DNA, 20 bp, Human rhinovirus
gctcccatttcttcagaaga

SEQ ID NO: 42648 - DNA, 20 bp, Human rhinovirus
cttcagaagaacaaagaaag

SEQ ID NO: 42649 - DNA, 20 bp, Human rhinovirus
ttcagaagaacaaagaaaga

SEQ ID NO: 42650 - DNA, 20 bp, Human rhinovirus
ctgggtaggtctgccctatg

SEQ ID NO: 42651 - DNA, 20 bp, Human rhinovirus
tgggtaggtctgccctatgg

SEQ ID NO: 42652 - DNA, 20 bp, Human rhinovirus
cacactagataggagcttca

SEQ ID NO: 42653 - DNA, 20 bp, Human rhinovirus
acactagataggagcttcaa

SEQ ID NO: 42654 - DNA, 20 bp, Human rhinovirus
aagagctggaaaataaactt

SEQ ID NO: 42655 - DNA, 20 bp, Human rhinovirus
gattcctcgaccacccagag

SEQ ID NO: 42656 - DNA, 20 bp, Human rhinovirus
ctcgaccacccagagccacc

SEQ ID NO: 42657 - DNA, 20 bp, Human rhinovirus
agtaccaattacaacaagca

SEQ ID NO: 42658 - DNA, 20 bp, Human rhinovirus
gtaccaattacaacaagcaa

SEQ ID NO: 42659 - DNA, 20 bp, Human rhinovirus
caacaagcaaaagccagata

SEQ ID NO: 42660 - DNA, 20 bp, Human rhinovirus
tggtggcaaattgttgtgtg

SEQ ID NO: 42661 - DNA, 20 bp, Human rhinovirus
ttgtgtgtacatggaaccat

SEQ ID NO: 42662 - DNA, 20 bp, Human rhinovirus
tgtgtacatggaaccatagg

SEQ ID NO: 42663 - DNA, 20 bp, Human rhinovirus
tctccacctgcagtcaccat

SEQ ID NO: 42664 - DNA, 20 bp, Human rhinovirus
ctccacctgcagtcaccatc

SEQ ID NO: 42665 - DNA, 20 bp, Human rhinovirus
tgcaatgcagctcgtggctt

SEQ ID NO: 42666 - DNA, 20 bp, Human rhinovirus
gcaatgcagctcgtggcttg

SEQ ID NO: 42667 - DNA, 20 bp, Human rhinovirus
caatgcagctcgtggcttgg

SEQ ID NO: 42668 - DNA, 20 bp, Human rhinovirus
gaatggattggtgacaagtt

SEQ ID NO: 42669 - DNA, 20 bp, Human rhinovirus
gtgacaagttatccaagttc

SEQ ID NO: 42670 - DNA, 20 bp, Human rhinovirus
gtcaaaatccagatggaaga

SEQ ID NO: 42671 - DNA, 20 bp, Human rhinovirus
tgtcagatggtttcaagcac

SEQ ID NO: 42672 - DNA, 20 bp, Human rhinovirus
gtcagatggtttcaagcact

SEQ ID NO: 42673 - DNA, 20 bp, Human rhinovirus
tcagatggtttcaagcactg

SEQ ID NO: 42674 - DNA, 20 bp, Human rhinovirus
caagcactgaattcataaca

SEQ ID NO: 42675 - DNA, 20 bp, Human rhinovirus
cagggtctgggagatgattc

SEQ ID NO: 42676 - DNA, 20 bp, Human rhinovirus
aactccggggttcattgtag

SEQ ID NO: 42677 - DNA, 20 bp, Human rhinovirus
attgtagatcttcttagtgc

SEQ ID NO: 42678 - DNA, 20 bp, Human rhinovirus
tagatcttcttagtgcctcc

SEQ ID NO: 42679 - DNA, 20 bp, Human rhinovirus
ttagtgcctccaaagaccca

SEQ ID NO: 42680 - DNA, 20 bp, Human rhinovirus
atggtgttgaaaccaaagtt

SEQ ID NO: 42681 - DNA, 20 bp, Human rhinovirus
aaaccaaagttctaaaacaa

SEQ ID NO: 42682 - DNA, 20 bp, Human rhinovirus
taaaacaaacaattgtcaca

SEQ ID NO: 42683 - DNA, 20 bp, Human rhinovirus
tcacagatgaaaatgatgtg

SEQ ID NO: 42684 - DNA, 20 bp, Human rhinovirus
tgtggctagatcgaaatgaa

SEQ ID NO: 42685 - DNA, 20 bp, Human rhinovirus
tatgatatattccccggtga

SEQ ID NO: 42686 - DNA, 20 bp, Human rhinovirus
atgatatattccccggtgaa

SEQ ID NO: 42687 - DNA, 20 bp, Human rhinovirus
tgatatattccccggtgaaa

SEQ ID NO: 42688 - DNA, 20 bp, Human rhinovirus
cccggtgaaaaagaacccgc

SEQ ID NO: 42689 - DNA, 20 bp, Human rhinovirus
acccagaaagatcctagact

SEQ ID NO: 42690 - DNA, 20 bp, Human rhinovirus
agaagggtgtttggtaatct

SEQ ID NO: 42691 - DNA, 20 bp, Human rhinovirus
ggtaatctctatgctggctt

SEQ ID NO: 42692 - DNA, 20 bp, Human rhinovirus
gtaatctctatgctggcttc

SEQ ID NO: 42693 - DNA, 20 bp, Human rhinovirus
catgcaaacccaggaatcct

SEQ ID NO: 42694 - DNA, 20 bp, Human rhinovirus
ctgggtttgcatggaagcca

SEQ ID NO: 42695 - DNA, 20 bp, Human rhinovirus
acccagcacagatagccgtt

SEQ ID NO: 42696 - DNA, 20 bp, Human rhinovirus
ctggcctcaaatatggattg

SEQ ID NO: 42697 - DNA, 20 bp, Human rhinovirus
tggcctcaaatatggattga

SEQ ID NO: 42698 - DNA, 20 bp, Human rhinovirus
acaataacacctgctgacaa

SEQ ID NO: 42699 - DNA, 20 bp, Human rhinovirus
cacaaattgatcagacttgt

SEQ ID NO: 42700 - DNA, 20 bp, Human papillomavirus type 4
gacgacttctgcagacgatt

SEQ ID NO: 42701 - DNA, 20 bp, Human papillomavirus type 4
tgcagacgattcgacatttc

SEQ ID NO: 42702 - DNA, 20 bp, Human papillomavirus type 4
gacatttccttttttgattt

SEQ ID NO: 42703 - DNA, 20 bp, Human papillomavirus type 4
ccttttttgatttgcgcctt

SEQ ID NO: 42704 - DNA, 20 bp, Human papillomavirus type 4
cttttttgatttgcgcctta

SEQ ID NO: 42705 - DNA, 20 bp, Human papillomavirus type 4
caatcttcagatgatgagta

SEQ ID NO: 42706 - DNA, 20 bp, Human papillomavirus type 4
agatgatgagtatgagatta

SEQ ID NO: 42707 - DNA, 20 bp, Human papillomavirus type 4
cagaggaggagtcggtggtt

SEQ ID NO: 42708 - DNA, 20 bp, Human papillomavirus type 4
catttagaatagacacctgt

SEQ ID NO: 42709 - DNA, 20 bp, Human papillomavirus type 4
agaatagacacctgttgcta

SEQ ID NO: 42710 - DNA, 20 bp, Human papillomavirus type 4
tgacttagaagggaataatt

SEQ ID NO: 42711 - DNA, 20 bp, Human papillomavirus type 4
gacttagaagggaataattg

SEQ ID NO: 42712 - DNA, 20 bp, Human papillomavirus type 4
acttagaagggaataattgg

SEQ ID NO: 42713 - DNA, 20 bp, Human papillomavirus type 4
gaagggaataattggtatat

SEQ ID NO: 42714 - DNA, 20 bp, Human papillomavirus type 4
gtatattgtccatgaagcag

SEQ ID NO: 42715 - DNA, 20 bp, Human papillomavirus type 4
agtccgcagttgcaggctgt

SEQ ID NO: 42716 - DNA, 20 bp, Human papillomavirus type 4
caggctgtgaaaataactcc

SEQ ID NO: 42717 - DNA, 20 bp, Human papillomavirus type 4
tttcaggacagtgggatttt

SEQ ID NO: 42718 - DNA, 20 bp, Human papillomavirus type 4
caggacagtgggattttcga

SEQ ID NO: 42719 - DNA, 20 bp, Human papillomavirus type 4
tgctgtgtctttcaggagtt

SEQ ID NO: 42720 - DNA, 20 bp, Human papillomavirus type 4
cgaagtgtacccacagcatt

SEQ ID NO: 42721 - DNA, 20 bp, Human papillomavirus type 4
tacttttataagcatgctat

SEQ ID NO: 42722 - DNA, 20 bp, Human papillomavirus type 4
tataagcatgctatgttaac

SEQ ID NO: 42723 - DNA, 20 bp, Human papillomavirus type 4
ataagcatgctatgttaaca

SEQ ID NO: 42724 - DNA, 20 bp, Human papillomavirus type 4
taagcatgctatgttaacag

SEQ ID NO: 42725 - DNA, 20 bp, Human papillomavirus type 4
cgatgcacttcaagaagcaa

SEQ ID NO: 42726 - DNA, 20 bp, Human papillomavirus type 4
gatgcacttcaagaagcaat

SEQ ID NO: 42727 - DNA, 20 bp, Human papillomavirus type 4
aagaagcaattctgactcat

SEQ ID NO: 42728 - DNA, 20 bp, Human papillomavirus type 4
tgactcatattgagtcacag

SEQ ID NO: 42729 - DNA, 20 bp, Human papillomavirus type 4
agtcacaggagagcactttg

SEQ ID NO: 42730 - DNA, 20 bp, Human papillomavirus type 4
cattatttagctctgatgct

SEQ ID NO: 42731 - DNA, 20 bp, Human papillomavirus type 4
tttagctctgatgctcaaag

SEQ ID NO: 42732 - DNA, 20 bp, Human papillomavirus type 4
agctctgatgctcaaagatt

SEQ ID NO: 42733 - DNA, 20 bp, Human papillomavirus type 4
gctctgatgctcaaagattt

SEQ ID NO: 42734 - DNA, 20 bp, Human papillomavirus type 4
agcagaactggactgtggac

SEQ ID NO: 42735 - DNA, 20 bp, Human papillomavirus type 4
ctcctcctcttcttcttttg

SEQ ID NO: 42736 - DNA, 20 bp, Human papillomavirus type 4
ttcttttgcggggggtttct

SEQ ID NO: 42737 - DNA, 20 bp, Human papillomavirus type 4
ttttgcggggggtttctcct

SEQ ID NO: 42738 - DNA, 20 bp, Human papillomavirus type 4
tgcggggggtttctcctgac

SEQ ID NO: 42739 - DNA, 20 bp, Human papillomavirus type 4
gcggggggtttctcctgacc

SEQ ID NO: 42740 - DNA, 20 bp, Human papillomavirus type 4
tttgaaatgttggagatata

SEQ ID NO: 42741 - DNA, 20 bp, Human papillomavirus type 4
gaaatgttggagatatagaa

SEQ ID NO: 42742 - DNA, 20 bp, Human papillomavirus type 4
aaatgttggagatatagaaa

SEQ ID NO: 42743 - DNA, 20 bp, Human papillomavirus type 4
gagatatagaaaagttaact

SEQ ID NO: 42744 - DNA, 20 bp, Human papillomavirus type 4
actcaaattgctgcaacttc

SEQ ID NO: 42745 - DNA, 20 bp, Human papillomavirus type 4
ctgatcgtttgctgagatgg

SEQ ID NO: 42746 - DNA, 20 bp, Human papillomavirus type 4
gctgagatggttgggaagtg

SEQ ID NO: 42747 - DNA, 20 bp, Human papillomavirus type 4
ctgagatggttgggaagtgt

SEQ ID NO: 42748 - DNA, 20 bp, Human papillomavirus type 4
ggaagtgtaatatacctagg

SEQ ID NO: 42749 - DNA, 20 bp, Human papillomavirus type 4
ggtattggtactgggagagg

SEQ ID NO: 42750 - DNA, 20 bp, Human papillomavirus type 4
gggaccctcagaaataatcc

SEQ ID NO: 42751 - DNA, 20 bp, Human papillomavirus type 4
ggaccctcagaaataatccc

SEQ ID NO: 42752 - DNA, 20 bp, Human papillomavirus type 4
tgttgtgccattagaggatc

SEQ ID NO: 42753 - DNA, 20 bp, Human papillomavirus type 4
tgccattagaggatctgacc

SEQ ID NO: 42754 - DNA, 20 bp, Human papillomavirus type 4
gaggatctgaccatcccaga

SEQ ID NO: 42755 - DNA, 20 bp, Human papillomavirus type 4
gatgtgtcccctatagaacc

SEQ ID NO: 42756 - DNA, 20 bp, Human papillomavirus type 4
gcaactaggggagcctcagc

SEQ ID NO: 42757 - DNA, 20 bp, Human papillomavirus type 4
ggttgtgccagatatgacac

SEQ ID NO: 42758 - DNA, 20 bp, Human papillomavirus type 4
tgccagatatgacacttaca

SEQ ID NO: 42759 - DNA, 20 bp, Human papillomavirus type 4
catgtggagttgctgaggct

SEQ ID NO: 42760 - DNA, 20 bp, Human papillomavirus type 4
atataatagaagggttcagc

SEQ ID NO: 42761 - DNA, 20 bp, Human papillomavirus type 4
tataatagaagggttcagca

SEQ ID NO: 42762 - DNA, 20 bp, Human papillomavirus type 4
agcaaatacctactaggaac

SEQ ID NO: 42763 - DNA, 20 bp, Human papillomavirus type 4
actgacacagccttcccgcg

SEQ ID NO: 42764 - DNA, 20 bp, Human papillomavirus type 4
ctgacacagccttcccgcgc

SEQ ID NO: 42765 - DNA, 20 bp, Human papillomavirus type 4
gagttagcaggcttggacgc

SEQ ID NO: 42766 - DNA, 20 bp, Human papillomavirus type 4
gcaggcttggacgccgaggc

SEQ ID NO: 42767 - DNA, 20 bp, Human papillomavirus type 4
gacgccgaggcacaataaaa

SEQ ID NO: 42768 - DNA, 20 bp, Human papillomavirus type 4
ggcaggcggttcatttttat

SEQ ID NO: 42769 - DNA, 20 bp, Human papillomavirus type 4
atttttattacgacctaagt

SEQ ID NO: 42770 - DNA, 20 bp, Human papillomavirus type 4
caggaagtcaatttagagtg

SEQ ID NO: 42771 - DNA, 20 bp, Human papillomavirus type 4
aggaagtcaatttagagtgt

SEQ ID NO: 42772 - DNA, 20 bp, Human papillomavirus type 4
agagtgtttagattcaattt

SEQ ID NO: 42773 - DNA, 20 bp, Human papillomavirus type 4
gagtgtttagattcaatttg

SEQ ID NO: 42774 - DNA, 20 bp, Human papillomavirus type 4
agattcaatttgccagaccc

SEQ ID NO: 42775 - DNA, 20 bp, Human papillomavirus type 4
tttaaaaatggggaaagata

SEQ ID NO: 42776 - DNA, 20 bp, Human papillomavirus type 4
ttaaaaatggggaaagatat

SEQ ID NO: 42777 - DNA, 20 bp, Human papillomavirus type 4
taaaaatggggaaagatatc

SEQ ID NO: 42778 - DNA, 20 bp, Human papillomavirus type 4
aaaaatggggaaagatatct

SEQ ID NO: 42779 - DNA, 20 bp, Human papillomavirus type 4
aaaatggggaaagatatcta

SEQ ID NO: 42780 - DNA, 20 bp, Human papillomavirus type 4
aattttgttccaccacctcc

SEQ ID NO: 42781 - DNA, 20 bp, Human papillomavirus type 4
tgttccaccacctccctctg

SEQ ID NO: 42782 - DNA, 20 bp, Human papillomavirus type 4
gttccaccacctccctctgg

SEQ ID NO: 42783 - DNA, 20 bp, Human papillomavirus type 4
ttccaccacctccctctgga

SEQ ID NO: 42784 - DNA, 20 bp, Human papillomavirus type 4
caccacctccctctggaatt

SEQ ID NO: 42785 - DNA, 20 bp, Human papillomavirus type 4
ccagtgtccagtctctctga

SEQ ID NO: 42786 - DNA, 20 bp, Human papillomavirus type 4
ggtcaacatgcgtccgcacc

SEQ ID NO: 42787 - DNA, 20 bp, Human papillomavirus type 4
gtcaacatgcgtccgcaccc

SEQ ID NO: 42788 - DNA, 20 bp, Human papillomavirus type 4
tttgcatacacagatcagta

SEQ ID NO: 42789 - DNA, 20 bp, Human papillomavirus type 4
gcatacacagatcagtagga

SEQ ID NO: 42790 - DNA, 20 bp, Human herpesvirus 7
gcagctgacgccggtgtgag

SEQ ID NO: 42791 - DNA, 20 bp, Human herpesvirus 7
tgccaattgttgttctgagt

SEQ ID NO: 42792 - DNA, 20 bp, Human herpesvirus 7
ttgttctgagtaaccagcaa

SEQ ID NO: 42793 - DNA, 20 bp, Human herpesvirus 7
ttctgagtaaccagcaacgt

SEQ ID NO: 42794 - DNA, 20 bp, Human herpesvirus 7
tgagtaaccagcaacgtcaa

SEQ ID NO: 42795 - DNA, 20 bp, Human herpesvirus 7
accacaaattctttggccaa

SEQ ID NO: 42796 - DNA, 20 bp, Human herpesvirus 7
aaaaaccgggcttttttata

SEQ ID NO: 42797 - DNA, 20 bp, Human herpesvirus 7
tttataacggatggatgcca

SEQ ID NO: 42798 - DNA, 20 bp, Human herpesvirus 7
ttataacggatggatgccag

SEQ ID NO: 42799 - DNA, 20 bp, Human herpesvirus 7
tataacggatggatgccagc

SEQ ID NO: 42800 - DNA, 20 bp, Human herpesvirus 7
ataacggatggatgccagcc

SEQ ID NO: 42801 - DNA, 20 bp, Human herpesvirus 7
cgcgtcctcctcatagccag

SEQ ID NO: 42802 - DNA, 20 bp, Human herpesvirus 7
tcatgtgatgcacatacatt

SEQ ID NO: 42803 - DNA, 20 bp, Human herpesvirus 7
ctccgtccctggctatgagg

SEQ ID NO: 42804 - DNA, 20 bp, Influenza C virus
taaacaacgacgtcacatcg

SEQ ID NO: 42805 - DNA, 20 bp, Influenza C virus
taatagtttccaaagtgtat

SEQ ID NO: 42806 - DNA, 20 bp, Influenza C virus
aatagtttccaaagtgtatt

SEQ ID NO: 42807 - DNA, 20 bp, Influenza C virus
atagtttccaaagtgtattt

SEQ ID NO: 42808 - DNA, 20 bp, Influenza C virus
ccaaagtgtatttggttgat

SEQ ID NO: 42809 - DNA, 20 bp, Influenza C virus
ggccttgcagagatgatgga

SEQ ID NO: 42810 - DNA, 20 bp, Influenza C virus
cagagatgatggagaaaaga

SEQ ID NO: 42811 - DNA, 20 bp, Influenza C virus
tttaagcattgtgtaatgga

SEQ ID NO: 42812 - DNA, 20 bp, Influenza C virus
ttaagcattgtgtaatggag

SEQ ID NO: 42813 - DNA, 20 bp, Influenza C virus
taagcattgtgtaatggagg

SEQ ID NO: 42814 - DNA, 20 bp, Influenza C virus
gtggtaatgagaagaaagca

SEQ ID NO: 42815 - DNA, 20 bp, Influenza C virus
agactactgttacttctctc

SEQ ID NO: 42816 - DNA, 20 bp, Influenza C virus
cttctctcaatgccaggatg

SEQ ID NO: 42817 - DNA, 20 bp, Influenza C virus
tctcaatgccaggatgaaca

SEQ ID NO: 42818 - DNA, 20 bp, Influenza C virus
gcagttaatataactggaga

SEQ ID NO: 42819 - DNA, 20 bp, Influenza C virus
ccagctttcactactgcagg

SEQ ID NO: 42820 - DNA, 20 bp, Influenza C virus
cactactgcaggagttaatg

SEQ ID NO: 42821 - DNA, 20 bp, Influenza C virus
actactgcaggagttaatga

SEQ ID NO: 42822 - DNA, 20 bp, Influenza C virus
atgaaggagttgattttaca

SEQ ID NO: 42823 - DNA, 20 bp, Influenza C virus
attttacagctgcaatgtca

SEQ ID NO: 42824 - DNA, 20 bp, Influenza C virus
gcgacatgtttaaaagcgtg

SEQ ID NO: 42825 - DNA, 20 bp, Influenza C virus
cgacatgtttaaaagcgtgt

SEQ ID NO: 42826 - DNA, 20 bp, Influenza C virus
aaaagcgtgtttgaatcagc

SEQ ID NO: 42827 - DNA, 20 bp, Influenza C virus
aaagcgtgtttgaatcagcg

SEQ ID NO: 42828 - DNA, 20 bp, Influenza C virus
gaatcagcggacataaatcc

SEQ ID NO: 42829 - DNA, 20 bp, Human papillomavirus type 6b
tggaaagtgcaaatgcctcc

SEQ ID NO: 42830 - DNA, 20 bp, Human papillomavirus type 6b
tgcaagacgtttaatctatc

SEQ ID NO: 42831 - DNA, 20 bp, Human papillomavirus type 6b
aatctatctatgcatacgtt

SEQ ID NO: 42832 - DNA, 20 bp, Human papillomavirus type 6b
atctatctatgcatacgttg

SEQ ID NO: 42833 - DNA, 20 bp, Human papillomavirus type 6b
caacgtatgcatagatagat

SEQ ID NO: 42834 - DNA, 20 bp, Human papillomavirus type 6b
gattatgctggatatgcaac

SEQ ID NO: 42835 - DNA, 20 bp, Human papillomavirus type 6b
attatgctggatatgcaaca

SEQ ID NO: 42836 - DNA, 20 bp, Human papillomavirus type 6b
tgctggatatgcaacaacag

SEQ ID NO: 42837 - DNA, 20 bp, Human papillomavirus type 6b
aagaagaaactaaacaagac

SEQ ID NO: 42838 - DNA, 20 bp, Human papillomavirus type 6b
gacgtgctaattcggtgcta

SEQ ID NO: 42839 - DNA, 20 bp, Human papillomavirus type 6b
cattgctatgagcaattagt

SEQ ID NO: 42840 - DNA, 20 bp, Human papillomavirus type 6b
ctatgagcaattagtagaca

SEQ ID NO: 42841 - DNA, 20 bp, Human papillomavirus type 6b
gtagacagctcagaagatga

SEQ ID NO: 42842 - DNA, 20 bp, Human papillomavirus type 6b
ttttaaaggttgtgaatctt

SEQ ID NO: 42843 - DNA, 20 bp, Human papillomavirus type 6b
taaaggttgtgaatcttgtc

SEQ ID NO: 42844 - DNA, 20 bp, Human papillomavirus type 6b
atggtagaagctatagtgca

SEQ ID NO: 42845 - DNA, 20 bp, Human papillomavirus type 6b
tggtagaagctatagtgcaa

SEQ ID NO: 42846 - DNA, 20 bp, Human papillomavirus type 6b
gtgtacctgttgggtgttgc

SEQ ID NO: 42847 - DNA, 20 bp, Human papillomavirus type 6b
tgtacctgttgggtgttgca

SEQ ID NO: 42848 - DNA, 20 bp, Human papillomavirus type 6b
ggtgttgcactatagcttct

SEQ ID NO: 42849 - DNA, 20 bp, Human papillomavirus type 6b
gtcctataaacactatagcc

SEQ ID NO: 42850 - DNA, 20 bp, Human papillomavirus type 6b
gacgccattaaacttacaag

SEQ ID NO: 42851 - DNA, 20 bp, Human papillomavirus type 6b
aacttacaagacagccaaaa

SEQ ID NO: 42852 - DNA, 20 bp, Human papillomavirus type 6b
caagacagccaaaaaaggta

SEQ ID NO: 42853 - DNA, 20 bp, Human papillomavirus type 6b
accttttttggctgtcttgt

SEQ ID NO: 42854 - DNA, 20 bp, Human papillomavirus type 6b
gaattgttaaaatgtaaaga

SEQ ID NO: 42855 - DNA, 20 bp, Human papillomavirus type 6b
ttaaaatgtaaagatttacg

SEQ ID NO: 42856 - DNA, 20 bp, Human papillomavirus type 6b
aaatgtaaagatttacgggc

SEQ ID NO: 42857 - DNA, 20 bp, Human papillomavirus type 6b
acattttaacaattccaata

SEQ ID NO: 42858 - DNA, 20 bp, Human papillomavirus type 6b
cattttaacaattccaatat

SEQ ID NO: 42859 - DNA, 20 bp, Human papillomavirus type 6b
acagaaatggtgcagtgggc

SEQ ID NO: 42860 - DNA, 20 bp, Human papillomavirus type 6b
catttgaatatgcacaaagg

SEQ ID NO: 42861 - DNA, 20 bp, Human papillomavirus type 6b
gaatatgcacaaaggggaga

SEQ ID NO: 42862 - DNA, 20 bp, Human papillomavirus type 6b
aatatgcacaaaggggagat

SEQ ID NO: 42863 - DNA, 20 bp, Human papillomavirus type 6b
gaatcaaaatctcccctttg

SEQ ID NO: 42864 - DNA, 20 bp, Human papillomavirus type 6b
aggattctgaggacgaggaa

SEQ ID NO: 42865 - DNA, 20 bp, Human papillomavirus type 6b
tgaggacgaggaagatggaa

SEQ ID NO: 42866 - DNA, 20 bp, Human papillomavirus type 6b
agatgcgtgccaggaacagt

SEQ ID NO: 42867 - DNA, 20 bp, Human papillomavirus type 6b
gatgcgtgccaggaacagtt

SEQ ID NO: 42868 - DNA, 20 bp, Human papillomavirus type 6b
taacaactgttcctggcacg

SEQ ID NO: 42869 - DNA, 20 bp, Human papillomavirus type 6b
aaatgcaaatgcatttagaa

SEQ ID NO: 42870 - DNA, 20 bp, Human papillomavirus type 6b
agaatcattattaaggactg

SEQ ID NO: 42871 - DNA, 20 bp, Human papillomavirus type 6b
gaatcattattaaggactga

SEQ ID NO: 42872 - DNA, 20 bp, Human papillomavirus type 6b
ttaaggactgagtatagtat

SEQ ID NO: 42873 - DNA, 20 bp, Human papillomavirus type 6b
aggactgagtatagtatgga

SEQ ID NO: 42874 - DNA, 20 bp, Human papillomavirus type 6b
caacgccttgtgtgtggccc

SEQ ID NO: 42875 - DNA, 20 bp, Human papillomavirus type 6b
tgtgtggcccacattggacc

SEQ ID NO: 42876 - DNA, 20 bp, Human papillomavirus type 6b
gacccgtggacagtggaaac

SEQ ID NO: 42877 - DNA, 20 bp, Human papillomavirus type 6b
agctacgcctatagtgcaat

SEQ ID NO: 42878 - DNA, 20 bp, Human papillomavirus type 6b
aaattgcactataggcgtag

SEQ ID NO: 42879 - DNA, 20 bp, Human papillomavirus type 6b
ttagatgttgtaaaaatacc

SEQ ID NO: 42880 - DNA, 20 bp, Human papillomavirus type 6b
tagatgttgtaaaaataccc

SEQ ID NO: 42881 - DNA, 20 bp, Human papillomavirus type 6b
agatgttgtaaaaatacccc

SEQ ID NO: 42882 - DNA, 20 bp, Human papillomavirus type 6b
gatgttgtaaaaataccccc

SEQ ID NO: 42883 - DNA, 20 bp, Human papillomavirus type 6b
taaaaataccccctaccatt

SEQ ID NO: 42884 - DNA, 20 bp, Human papillomavirus type 6b
tatatttactattgtggctg

SEQ ID NO: 42885 - DNA, 20 bp, Human papillomavirus type 6b
atatttactattgtggctgc

SEQ ID NO: 42886 - DNA, 20 bp, Human papillomavirus type 6b
tatttactattgtggctgct

SEQ ID NO: 42887 - DNA, 20 bp, Human papillomavirus type 6b
actattgtggctgctattaa

SEQ ID NO: 42888 - DNA, 20 bp, Human papillomavirus type 6b
ctattgtggctgctattaac

SEQ ID NO: 42889 - DNA, 20 bp, Human papillomavirus type 6b
ctggtactgcacctcggcct

SEQ ID NO: 42890 - DNA, 20 bp, Human papillomavirus type 6b
caccaggtgcaggttacaga

SEQ ID NO: 42891 - DNA, 20 bp, Human papillomavirus type 6b
cagaccctgcatttctttcc

SEQ ID NO: 42892 - DNA, 20 bp, Human papillomavirus type 6b
ctttccactcctcaacgctt

SEQ ID NO: 42893 - DNA, 20 bp, Human papillomavirus type 6b
tttccactcctcaacgctta

SEQ ID NO: 42894 - DNA, 20 bp, Human papillomavirus type 6b
cattgtcacttcctaatgac

SEQ ID NO: 42895 - DNA, 20 bp, Human papillomavirus type 6b
tcacttcctaatgacctgtt

SEQ ID NO: 42896 - DNA, 20 bp, Human papillomavirus type 6b
ctaatgacctgtttttacaa

SEQ ID NO: 42897 - DNA, 20 bp, Human papillomavirus type 6b
ttacaatctggccctgatat

SEQ ID NO: 42898 - DNA, 20 bp, Human papillomavirus type 6b
tacaatctggccctgatata

SEQ ID NO: 42899 - DNA, 20 bp, Human papillomavirus type 6b
ttgccacggatgcttatgtt

SEQ ID NO: 42900 - DNA, 20 bp, Human papillomavirus type 6b
ccacggatgcttatgttact

SEQ ID NO: 42901 - DNA, 20 bp, Human papillomavirus type 6b
tgttactcgcaccaacatat

SEQ ID NO: 42902 - DNA, 20 bp, Human papillomavirus type 6b
ctcgcaccaacatattttat

SEQ ID NO: 42903 - DNA, 20 bp, Human papillomavirus type 6b
tatcatgccagcagttctag

SEQ ID NO: 42904 - DNA, 20 bp, Human papillomavirus type 6b
acacaggctttggtgctatg

SEQ ID NO: 42905 - DNA, 20 bp, Human papillomavirus type 6b
ggtgctatgaattttgctga

SEQ ID NO: 42906 - DNA, 20 bp, Human papillomavirus type 6b
gtgctatgaattttgctgat

SEQ ID NO: 42907 - DNA, 20 bp, Human papillomavirus type 6b
tgctgatttgcagaccaata

SEQ ID NO: 42908 - DNA, 20 bp, Human papillomavirus type 6b
gctgatttgcagaccaataa

SEQ ID NO: 42909 - DNA, 20 bp, Human papillomavirus type 6b
tttaataagccatattggct

SEQ ID NO: 42910 - DNA, 20 bp, Human papillomavirus type 6b
aataagccatattggctaca

SEQ ID NO: 42911 - DNA, 20 bp, Human papillomavirus type 6b
ataagccatattggctacaa

SEQ ID NO: 42912 - DNA, 20 bp, Human papillomavirus type 6b
gctacaaaaagcccagggac

SEQ ID NO: 42913 - DNA, 20 bp, Human papillomavirus type 6b
gttggggtaatcaactgttt

SEQ ID NO: 42914 - DNA, 20 bp, Human papillomavirus type 6b
ccttactcataaacctgtct

SEQ ID NO: 42915 - DNA, 20 bp, Human papillomavirus type 6b
ctcataaacctgtctttgtg

SEQ ID NO: 42916 - DNA, 20 bp, Human papillomavirus type 6b
gtgttatacttttatgcact

SEQ ID NO: 42917 - DNA, 20 bp, Human papillomavirus type 6b
tgttatacttttatgcactg

SEQ ID NO: 42918 - DNA, 20 bp, Human papillomavirus type 6b
tacttttatgcactgtagcc

SEQ ID NO: 42919 - DNA, 20 bp, Hepatitis C virus
ggaaccggtgagtacaccgg

SEQ ID NO: 42920 - DNA, 20 bp, Hepatitis C virus
cttggattaacccgctcaat

SEQ ID NO: 42921 - DNA, 20 bp, Hepatitis C virus
ttggattaacccgctcaatg

SEQ ID NO: 42922 - DNA, 20 bp, Hepatitis C virus
gattaacccgctcaatgccc

SEQ ID NO: 42923 - DNA, 20 bp, Hepatitis C virus
acccgctcaatgcccggaaa

SEQ ID NO: 42924 - DNA, 20 bp, Hepatitis C virus
gcggagtttacttgttgccg

SEQ ID NO: 42925 - DNA, 20 bp, Hepatitis C virus
acttgttgccgcgcaggggc

SEQ ID NO: 42926 - DNA, 20 bp, Hepatitis C virus
cttgttgccgcgcaggggcc

SEQ ID NO: 42927 - DNA, 20 bp, Hepatitis C virus
ttgccgcgcaggggccccag

SEQ ID NO: 42928 - DNA, 20 bp, Hepatitis C virus
ccgcgcaggggccccagatt

SEQ ID NO: 42929 - DNA, 20 bp, Hepatitis C virus
ggaggacgggatcaattatg

SEQ ID NO: 42930 - DNA, 20 bp, Hepatitis C virus
gaggacgggatcaattatgc

SEQ ID NO: 42931 - DNA, 20 bp, Hepatitis C virus
tgcaacagggaatctccccg

SEQ ID NO: 42932 - DNA, 20 bp, Hepatitis C virus
cctgttgcataattgatccc

SEQ ID NO: 42933 - DNA, 20 bp, Hepatitis C virus
cataattgatcccgtcctcc

SEQ ID NO: 42934 - DNA, 20 bp, Hepatitis C virus
ctcctaccgtcgcagcgcca

SEQ ID NO: 42935 - DNA, 20 bp, Hepatitis C virus
ctctctggaggccactgggg

SEQ ID NO: 42936 - DNA, 20 bp, Hepatitis C virus
cagcatgcaggccaattggg

SEQ ID NO: 42937 - DNA, 20 bp, Hepatitis C virus
agcatgcaggccaattgggc

SEQ ID NO: 42938 - DNA, 20 bp, Hepatitis C virus
ggccaaagtcatcttggtcc

SEQ ID NO: 42939 - DNA, 20 bp, Hepatitis C virus
ggcccaattggcctgcatgc

SEQ ID NO: 42940 - DNA, 20 bp, Hepatitis C virus
acagctacggccaaggctgg

SEQ ID NO: 42941 - DNA, 20 bp, Hepatitis C virus
ttgctggcactacgcgcctc

SEQ ID NO: 42942 - DNA, 20 bp, Hepatitis C virus
gcgaccccgagtgggcccca

SEQ ID NO: 42943 - DNA, 20 bp, Hepatitis C virus
gccgtagctgtcaaggctct

SEQ ID NO: 42944 - DNA, 20 bp, Hepatitis C virus
ggatgcgtgtggatgaacag

SEQ ID NO: 42945 - DNA, 20 bp, Hepatitis C virus
gatgcgtgtggatgaacagt

SEQ ID NO: 42946 - DNA, 20 bp, Hepatitis C virus
accaaaacctgtggcgcccc

SEQ ID NO: 42947 - DNA, 20 bp, Hepatitis C virus
acaccaataatgggacctgg

SEQ ID NO: 42948 - DNA, 20 bp, Hepatitis C virus
ttggtgttaacctcgcatgg

SEQ ID NO: 42949 - DNA, 20 bp, Hepatitis C virus
gagcacagggatcgggtaga

SEQ ID NO: 42950 - DNA, 20 bp, Hepatitis C virus
ccactacagcgtggcagatc

SEQ ID NO: 42951 - DNA, 20 bp, Hepatitis C virus
ccagctgctgctgcctacgc

SEQ ID NO: 42952 - DNA, 20 bp, Hepatitis C virus
tctcctgcttctgatgctgc

SEQ ID NO: 42953 - DNA, 20 bp, Hepatitis C virus
ctcctgcttctgatgctgcc

SEQ ID NO: 42954 - DNA, 20 bp, Hepatitis C virus
tcctgcttctgatgctgcct

SEQ ID NO: 42955 - DNA, 20 bp, Hepatitis C virus
tgatgctgcctgagagggct

SEQ ID NO: 42956 - DNA, 20 bp, Hepatitis C virus
catccttcaacgtgcgcggg

SEQ ID NO: 42957 - DNA, 20 bp, Hepatitis C virus
aacgtgcgcgggcctcgcga

SEQ ID NO: 42958 - DNA, 20 bp, Hepatitis C virus
ttcttgcagtcctggtctgt

SEQ ID NO: 42959 - DNA, 20 bp, Hepatitis C virus
ttgcagtcctggtctgtcca

SEQ ID NO: 42960 - DNA, 20 bp, Hepatitis C virus
cagtcctggtctgtccagac

SEQ ID NO: 42961 - DNA, 20 bp, Hepatitis C virus
cctgtttcggccaggttggg

SEQ ID NO: 42962 - DNA, 20 bp, Hepatitis C virus
cggccaggttgggcaatgag

SEQ ID NO: 42963 - DNA, 20 bp, Hepatitis C virus
ggccaggttgggcaatgaga

SEQ ID NO: 42964 - DNA, 20 bp, Hepatitis C virus
ggcaatgagatcttgctcgg

SEQ ID NO: 42965 - DNA, 20 bp, Hepatitis C virus
ctcggaccagccgatacaga

SEQ ID NO: 42966 - DNA, 20 bp, Hepatitis C virus
tccaccgctacgcagtcctt

SEQ ID NO: 42967 - DNA, 20 bp, Hepatitis C virus
ctgggtactgcggttaacgg

SEQ ID NO: 42968 - DNA, 20 bp, Hepatitis C virus
acggcgtgatgtggaccgtc

SEQ ID NO: 42969 - DNA, 20 bp, Hepatitis C virus
gcacccgccccgtggtagac

SEQ ID NO: 42970 - DNA, 20 bp, Hepatitis C virus
accgcagtacccaggaagga

SEQ ID NO: 42971 - DNA, 20 bp, Hepatitis C virus
gtcccggttgaatctcttga

SEQ ID NO: 42972 - DNA, 20 bp, Hepatitis C virus
aatctcttgagactaccatg

SEQ ID NO: 42973 - DNA, 20 bp, Hepatitis C virus
agactaccatgagatcacca

SEQ ID NO: 42974 - DNA, 20 bp, Hepatitis C virus
actgacaactcaacaccccc

SEQ ID NO: 42975 - DNA, 20 bp, Hepatitis C virus
agttgtcagtgaacactggt

SEQ ID NO: 42976 - DNA, 20 bp, Hepatitis C virus
ctggctgatggaggttgcag

SEQ ID NO: 42977 - DNA, 20 bp, Hepatitis C virus
ccatacgttgagtacgtgat

SEQ ID NO: 42978 - DNA, 20 bp, Hepatitis C virus
agtacgtgattggcgcaccc

SEQ ID NO: 42979 - DNA, 20 bp, Hepatitis C virus
gcgcacccgtggtgatggtc

SEQ ID NO: 42980 - DNA, 20 bp, Hepatitis C virus
tacggcaaggcgatccctct

SEQ ID NO: 42981 - DNA, 20 bp, Hepatitis C virus
acggcaaggcgatccctctg

SEQ ID NO: 42982 - DNA, 20 bp, Hepatitis C virus
cggcaaggcgatccctctgg

SEQ ID NO: 42983 - DNA, 20 bp, Hepatitis C virus
tgccattcaaagaaaaagtg

SEQ ID NO: 42984 - DNA, 20 bp, Hepatitis C virus
aaagaaaaagtgcgatgaac

SEQ ID NO: 42985 - DNA, 20 bp, Hepatitis C virus
ggcacataccggtatgtcac

SEQ ID NO: 42986 - DNA, 20 bp, Hepatitis C virus
ttgcttaccaagcgacggtg

SEQ ID NO: 42987 - DNA, 20 bp, Hepatitis C virus
cttaccaagcgacggtgtcg

SEQ ID NO: 42988 - DNA, 20 bp, Hepatitis C virus
ccaagcgacggtgtcggcca

SEQ ID NO: 42989 - DNA, 20 bp, Hepatitis C virus
gccttaagcccaccctgcac

SEQ ID NO: 42990 - DNA, 20 bp, Hepatitis C virus
agcccaccctgcacgggccc

SEQ ID NO: 42991 - DNA, 20 bp, Hepatitis C virus
ctgatcgcgaagtgctctac

SEQ ID NO: 42992 - DNA, 20 bp, Hepatitis C virus
gacgaaatggaggagtgttc

SEQ ID NO: 42993 - DNA, 20 bp, Hepatitis C virus
caaacacctcccactagtcg

SEQ ID NO: 42994 - DNA, 20 bp, Hepatitis C virus
taacccgtgctcgactagtg

SEQ ID NO: 42995 - DNA, 20 bp, Hepatitis C virus
ggaacactcctccatttcgt

SEQ ID NO: 42996 - DNA, 20 bp, Hepatitis C virus
actgctgccgttacaagccc

SEQ ID NO: 42997 - DNA, 20 bp, Hepatitis C virus
ctgctgccgttacaagccct

SEQ ID NO: 42998 - DNA, 20 bp, Hepatitis C virus
caagccctctgaccacccaa

SEQ ID NO: 42999 - DNA, 20 bp, Hepatitis C virus
ttaacatcttggggggatgg

SEQ ID NO: 43000 - DNA, 20 bp, Hepatitis C virus
taacatcttggggggatggg

SEQ ID NO: 43001 - DNA, 20 bp, Hepatitis C virus
gtggtggaggtggtatgccc

SEQ ID NO: 43002 - DNA, 20 bp, Hepatitis C virus
tgcgccgccacgtgggcccg

SEQ ID NO: 43003 - DNA, 20 bp, Hepatitis C virus
gcgccgccacgtgggcccgg

SEQ ID NO: 43004 - DNA, 20 bp, Hepatitis C virus
cgccgccacgtgggcccggg

SEQ ID NO: 43005 - DNA, 20 bp, Hepatitis C virus
gacggttcatccactgcacg

SEQ ID NO: 43006 - DNA, 20 bp, Hepatitis C virus
aaagcaaagttcgtgccctt

SEQ ID NO: 43007 - DNA, 20 bp, Hepatitis C virus
gtgcccttaatgccaggcat

SEQ ID NO: 43008 - DNA, 20 bp, Hepatitis C virus
atgccaggcatccccctcct

SEQ ID NO: 43009 - DNA, 20 bp, Hepatitis C virus
tagcctcttggccatgagag

SEQ ID NO: 43010 - DNA, 20 bp, Hepatitis C virus
gccatgagaggagggggatg

SEQ ID NO: 43011 - DNA, 20 bp, Hepatitis C virus
cggccccagagctcttcacg

SEQ ID NO: 43012 - DNA, 20 bp, Hepatitis C virus
acggaagtggacggcatcag

SEQ ID NO: 43013 - DNA, 20 bp, Hepatitis C virus
ctgcgggacgaagtgtcgtt

SEQ ID NO: 43014 - DNA, 20 bp, Hepatitis C virus
tcagtaggactcaattcgtt

SEQ ID NO: 43015 - DNA, 20 bp, Hepatitis C virus
agtcctactgagaacgacac

SEQ ID NO: 43016 - DNA, 20 bp, Hepatitis C virus
ctcggcgagtcagctttcgc

SEQ ID NO: 43017 - DNA, 20 bp, Hepatitis C virus
cgccccgtcttcttcaggcc

SEQ ID NO: 43018 - DNA, 20 bp, Hepatitis C virus
gccccgtcttcttcaggcca

SEQ ID NO: 43019 - DNA, 20 bp, Hepatitis C virus
ttcaggccacgtgtaccgct

SEQ ID NO: 43020 - DNA, 20 bp, Hepatitis C virus
aggccacgtgtaccgctccc

SEQ ID NO: 43021 - DNA, 20 bp, Hepatitis C virus
cgctctgcctccggcaaagc

SEQ ID NO: 43022 - DNA, 20 bp, Hepatitis C virus
cctctcccaggaggaaacgg

SEQ ID NO: 43023 - DNA, 20 bp, Hepatitis C virus
cctcctgggagagggaacag

SEQ ID NO: 43024 - DNA, 20 bp, Hepatitis C virus
ctcctgggagagggaacagg

SEQ ID NO: 43025 - DNA, 20 bp, Hepatitis C virus
gccggaggcagagcgcaacc

SEQ ID NO: 43026 - DNA, 20 bp, Hepatitis C virus
gcggatcggaggacgtcgtg

SEQ ID NO: 43027 - DNA, 20 bp, Hepatitis C virus
gatgtcatactcgtggactg

SEQ ID NO: 43028 - DNA, 20 bp, Hepatitis C virus
taacaccttgcgcggctgaa

SEQ ID NO: 43029 - DNA, 20 bp, Hepatitis C virus
cgcggctgaagaatcaaagc

SEQ ID NO: 43030 - DNA, 20 bp, Hepatitis C virus
gcagctttgattcttcagcc

SEQ ID NO: 43031 - DNA, 20 bp, Hepatitis C virus
ggctacgggaaaaaggatgt

SEQ ID NO: 43032 - DNA, 20 bp, Hepatitis C virus
ggagccattcccgcaaggcc

SEQ ID NO: 43033 - DNA, 20 bp, Hepatitis C virus
ccgcaaggccattaaccaca

SEQ ID NO: 43034 - DNA, 20 bp, Hepatitis C virus
accacatcagctccgtgtgg

SEQ ID NO: 43035 - DNA, 20 bp, Hepatitis C virus
ctggacgacaacaatacccc

SEQ ID NO: 43036 - DNA, 20 bp, Hepatitis C virus
gaagtcgaagaacgacccaa

SEQ ID NO: 43037 - DNA, 20 bp, Hepatitis C virus
tcttatgatacccgctgctt

SEQ ID NO: 43038 - DNA, 20 bp, Hepatitis C virus
tgatacccgctgctttgact

SEQ ID NO: 43039 - DNA, 20 bp, Hepatitis C virus
gactccactgtaaccgaaaa

SEQ ID NO: 43040 - DNA, 20 bp, Hepatitis C virus
actccactgtaaccgaaaag

SEQ ID NO: 43041 - DNA, 20 bp, Hepatitis C virus
gtttgcggtgatgacttagt

SEQ ID NO: 43042 - DNA, 20 bp, Hepatitis C virus
gcggtgatgacttagtcgtc

SEQ ID NO: 43043 - DNA, 20 bp, Hepatitis C virus
cggtgatgacttagtcgtca

SEQ ID NO: 43044 - DNA, 20 bp, Hepatitis C virus
gtcgtcatcgctgagagcga

SEQ ID NO: 43045 - DNA, 20 bp, Hepatitis C virus
acggaggctatgacgagata

SEQ ID NO: 43046 - DNA, 20 bp, Hepatitis C virus
cctgccgctgccaaactcga

SEQ ID NO: 43047 - DNA, 20 bp, Hepatitis C virus
atcgggttggtttacggtag

SEQ ID NO: 43048 - DNA, 20 bp, Hepatitis C virus
tcgggttggtttacggtagg

SEQ ID NO: 43049 - DNA, 20 bp, Hepatitis C virus
gtttacggtaggcgccggcg

SEQ ID NO: 43050 - DNA, 20 bp, Hepatitis C virus
acggtaggcgccggcggggg

SEQ ID NO: 43051 - DNA, 20 bp, Human rhinovirus 14
gggtgtccgtgtttctcatt

SEQ ID NO: 43052 - DNA, 20 bp, Human rhinovirus 14
ggtgtccgtgtttctcattt

SEQ ID NO: 43053 - DNA, 20 bp, Human rhinovirus 14
ctcatttttcttcatattgt

SEQ ID NO: 43054 - DNA, 20 bp, Human rhinovirus 14
tcatttttcttcatattgtc

SEQ ID NO: 43055 - DNA, 20 bp, Human rhinovirus 14
ttcttcatattgtcttatgg

SEQ ID NO: 43056 - DNA, 20 bp, Human rhinovirus 14
agggtgcaccagcattgaat

SEQ ID NO: 43057 - DNA, 20 bp, Human rhinovirus 14
aattcacccaatgttgaggc

SEQ ID NO: 43058 - DNA, 20 bp, Human rhinovirus 14
acccaatgttgaggcctgtg

SEQ ID NO: 43059 - DNA, 20 bp, Human rhinovirus 14
aggcctgtggttatagtgat

SEQ ID NO: 43060 - DNA, 20 bp, Human rhinovirus 14
tagtgatagagtacaacaaa

SEQ ID NO: 43061 - DNA, 20 bp, Human rhinovirus 14
taaaggctggtgctggaaat

SEQ ID NO: 43062 - DNA, 20 bp, Human rhinovirus 14
ccagatgcactcaaggatat

SEQ ID NO: 43063 - DNA, 20 bp, Human rhinovirus 14
gggcaaaacatgtttttcca

SEQ ID NO: 43064 - DNA, 20 bp, Human rhinovirus 14
tgcccgaacacacccatatc

SEQ ID NO: 43065 - DNA, 20 bp, Human rhinovirus 14
gcccgaacacacccatatcc

SEQ ID NO: 43066 - DNA, 20 bp, Human rhinovirus 14
ttgggacaaacctgtttatt

SEQ ID NO: 43067 - DNA, 20 bp, Human rhinovirus 14
tgggacaaacctgtttattg

SEQ ID NO: 43068 - DNA, 20 bp, Human rhinovirus 14
gggacaaacctgtttattgg

SEQ ID NO: 43069 - DNA, 20 bp, Human rhinovirus 14
ggacaaacctgtttattggt

SEQ ID NO: 43070 - DNA, 20 bp, Human rhinovirus 14
attggtgatggggtcttcaa

SEQ ID NO: 43071 - DNA, 20 bp, Human rhinovirus 14
tctgggatattggtctgcaa

SEQ ID NO: 43072 - DNA, 20 bp, Human rhinovirus 14
gtctgcaatccaccatagta

SEQ ID NO: 43073 - DNA, 20 bp, Human rhinovirus 14
agatatactgatccagatac

SEQ ID NO: 43074 - DNA, 20 bp, Human rhinovirus 14
gatatactgatccagataca

SEQ ID NO: 43075 - DNA, 20 bp, Human rhinovirus 14
tcattactatggtggattgc

SEQ ID NO: 43076 - DNA, 20 bp, Human rhinovirus 14
cactcactgaaggcttaggt

SEQ ID NO: 43077 - DNA, 20 bp, Human rhinovirus 14
ggtgatgaattagaagaagt

SEQ ID NO: 43078 - DNA, 20 bp, Human rhinovirus 14
gaagaagtcatcgttgagaa

SEQ ID NO: 43079 - DNA, 20 bp, Human rhinovirus 14
agaaaacgaaacagacggtg

SEQ ID NO: 43080 - DNA, 20 bp, Human rhinovirus 14
tggaccagatgagattgagg

SEQ ID NO: 43081 - DNA, 20 bp, Human rhinovirus 14
cacatggcaaagtgcttcaa

SEQ ID NO: 43082 - DNA, 20 bp, Human rhinovirus 14
aaaccccagtgtattcttca

SEQ ID NO: 43083 - DNA, 20 bp, Human rhinovirus 14
ttcaaggtgggggatacatc

SEQ ID NO: 43084 - DNA, 20 bp, Human rhinovirus 14
aagaatacactggggtttga

SEQ ID NO: 43085 - DNA, 20 bp, Human rhinovirus 14
gaagcactttgccatgtgta

SEQ ID NO: 43086 - DNA, 20 bp, Human rhinovirus 14
aagcatggattccaagagca

SEQ ID NO: 43087 - DNA, 20 bp, Human rhinovirus 14
caagagcacccagagcacta

SEQ ID NO: 43088 - DNA, 20 bp, Human rhinovirus 14
tcctaagaatacagaaccag

SEQ ID NO: 43089 - DNA, 20 bp, Human rhinovirus 14
tgtattcttaggataatttg

SEQ ID NO: 43090 - DNA, 20 bp, Human rhinovirus 14
ttaggataatttgtgcgccc

SEQ ID NO: 43091 - DNA, 20 bp, Human rhinovirus 14
actattccacatattacaga

SEQ ID NO: 43092 - DNA, 20 bp, Human rhinovirus 14
ctattccacatattacagaa

SEQ ID NO: 43093 - DNA, 20 bp, Human rhinovirus 14
cacatattacagaaagtatt

SEQ ID NO: 43094 - DNA, 20 bp, Human rhinovirus 14
cagaaagtattaccccataa

SEQ ID NO: 43095 - DNA, 20 bp, Human rhinovirus 14
ccccataatttgcgaaaagc

SEQ ID NO: 43096 - DNA, 20 bp, Human rhinovirus 14
gattgttaacagctgaaggt

SEQ ID NO: 43097 - DNA, 20 bp, Human rhinovirus 14
ttaacagctgaaggtagtgg

SEQ ID NO: 43098 - DNA, 20 bp, Human rhinovirus 14
acagctgaaggtagtggata

SEQ ID NO: 43099 - DNA, 20 bp, Human rhinovirus 14
gttttgctgacatacgacag

SEQ ID NO: 43100 - DNA, 20 bp, Human rhinovirus 14
ttttgctgacatacgacagt

SEQ ID NO: 43101 - DNA, 20 bp, Human rhinovirus 14
cggccactctagcactactt

SEQ ID NO: 43102 - DNA, 20 bp, Human rhinovirus 14
gatgtgatggatctccttgg

SEQ ID NO: 43103 - DNA, 20 bp, Human rhinovirus 14
gagatttctgaagatgtaca

SEQ ID NO: 43104 - DNA, 20 bp, Human rhinovirus 14
ctgaagatgtacatttccaa

SEQ ID NO: 43105 - DNA, 20 bp, Human rhinovirus 14
tgaagatgtacatttccaaa

SEQ ID NO: 43106 - DNA, 20 bp, Human rhinovirus 14
tggtaaatcattaacaacat

SEQ ID NO: 43107 - DNA, 20 bp, Human rhinovirus 14
acaacatccattgtgggacg

SEQ ID NO: 43108 - DNA, 20 bp, Human rhinovirus 14
tgggacgtgcaattgcagaa

SEQ ID NO: 43109 - DNA, 20 bp, Human rhinovirus 14
cagaacacttcaattcagca

SEQ ID NO: 43110 - DNA, 20 bp, Human rhinovirus 14
aattcagcagtatattcact

SEQ ID NO: 43111 - DNA, 20 bp, Human rhinovirus 14
ttcaccagtaattttgttct

SEQ ID NO: 43112 - DNA, 20 bp, Human rhinovirus 14
accagtaattttgttctagc

SEQ ID NO: 43113 - DNA, 20 bp, Human rhinovirus 14
tgttctagcctccacaaatt

SEQ ID NO: 43114 - DNA, 20 bp, Human rhinovirus 14
gttctagcctccacaaattc

SEQ ID NO: 43115 - DNA, 20 bp, Human rhinovirus 14
ttctagcctccacaaattct

SEQ ID NO: 43116 - DNA, 20 bp, Human rhinovirus 14
gccctgtaacaatggcagga

SEQ ID NO: 43117 - DNA, 20 bp, Human rhinovirus 14
ttaatttgagtagcaccccc

SEQ ID NO: 43118 - DNA, 20 bp, Human rhinovirus 14
atttgagtagcacccccact

SEQ ID NO: 43119 - DNA, 20 bp, Human rhinovirus 14
gagtagcacccccactaaca

SEQ ID NO: 43120 - DNA, 20 bp, Human rhinovirus 14
agtagcacccccactaacag

SEQ ID NO: 43121 - DNA, 20 bp, Human rhinovirus 14
catcccagtgtattttatga

SEQ ID NO: 43122 - DNA, 20 bp, Human rhinovirus 14
tatgatgtttttccaggtga

SEQ ID NO: 43123 - DNA, 20 bp, Human rhinovirus 14
atgatgtttttccaggtgac

SEQ ID NO: 43124 - DNA, 20 bp, Human rhinovirus 14
tgatgtttttccaggtgaca

SEQ ID NO: 43125 - DNA, 20 bp, Human rhinovirus 14
ttccaggtgacaaggaacct

SEQ ID NO: 43126 - DNA, 20 bp, Human rhinovirus 14
attgaagcctccagtttgaa

SEQ ID NO: 43127 - DNA, 20 bp, Human rhinovirus 14
aagcctccagtttgaatgat

SEQ ID NO: 43128 - DNA, 20 bp, Human rhinovirus 14
gaatgattctgttaacatga

SEQ ID NO: 43129 - DNA, 20 bp, Human rhinovirus 14
aatgattctgttaacatgag

SEQ ID NO: 43130 - DNA, 20 bp, Human rhinovirus 14
tgttaacatgagaatgaaac

SEQ ID NO: 43131 - DNA, 20 bp, Human rhinovirus 14
gcaactcttggtaaaaatta

SEQ ID NO: 43132 - DNA, 20 bp, Human rhinovirus 14
gtaaaaattatggactaacc

SEQ ID NO: 43133 - DNA, 20 bp, Human rhinovirus 14
tggactaaccatcacacccc

SEQ ID NO: 43134 - DNA, 20 bp, Human rhinovirus 14
tacaaaaatgacatgggaaa

SEQ ID NO: 43135 - DNA, 20 bp, Human rhinovirus 14
acaaaaatgacatgggaaaa

SEQ ID NO: 43136 - DNA, 20 bp, Human genital-associated circular DNA virus-1
cgctcaatgcggagagctgg

SEQ ID NO: 43137 - DNA, 20 bp, Human genital-associated circular DNA virus-1
acgactctattacttcatac

SEQ ID NO: 43138 - DNA, 20 bp, Human genital-associated circular DNA virus-1
cttcatacccagctgagtgt

SEQ ID NO: 43139 - DNA, 20 bp, Human genital-associated circular DNA virus-1
atacccagctgagtgtctca

SEQ ID NO: 43140 - DNA, 20 bp, Human genital-associated circular DNA virus-1
gtcgagagaaccacgctgat

SEQ ID NO: 43141 - DNA, 20 bp, Human genital-associated circular DNA virus-1
tcgcaggagggctcagtacc

SEQ ID NO: 43142 - DNA, 20 bp, Human genital-associated circular DNA virus-1
agggaactgacaacgtctgg

SEQ ID NO: 43143 - DNA, 20 bp, Human genital-associated circular DNA virus-1
cagatgcagcaagtgtggag

SEQ ID NO: 43144 - DNA, 20 bp, Human genital-associated circular DNA virus-1
tgggagcttgttcgagagct

SEQ ID NO: 43145 - DNA, 20 bp, Human genital-associated circular DNA virus-1
gggagcttgttcgagagctg

SEQ ID NO: 43146 - DNA, 20 bp, Human genital-associated circular DNA virus-1
gcgtcttccagccctgactt

SEQ ID NO: 43147 - DNA, 20 bp, Human genital-associated circular DNA virus-1
cagccctgacttgaggtcgt

SEQ ID NO: 43148 - DNA, 20 bp, Human genital-associated circular DNA virus-1
aggtcgtccacgttccactg

SEQ ID NO: 43149 - DNA, 20 bp, Human genital-associated circular DNA virus-1
cactgcaggcagcagtggat

SEQ ID NO: 43150 - DNA, 20 bp, Human genital-associated circular DNA virus-1
gcggaatgtgcgggacattc

SEQ ID NO: 43151 - DNA, 20 bp, Human genital-associated circular DNA virus-1
cgctctcatcgccggggttg

SEQ ID NO: 43152 - DNA, 20 bp, Human genital-associated circular DNA virus-1
agtgtgactgttcggtcata

SEQ ID NO: 43153 - DNA, 20 bp, Human genital-associated circular DNA virus-1
ggtcatacatcggtgtgatg

SEQ ID NO: 43154 - DNA, 20 bp, Human genital-associated circular DNA virus-1
gatccaccactttgttgtaa

SEQ ID NO: 43155 - DNA, 20 bp, Human genital-associated circular DNA virus-1
gttgtaatagggtacaatcc

SEQ ID NO: 43156 - DNA, 20 bp, Human genital-associated circular DNA virus-1
ttgtaatagggtacaatcca

SEQ ID NO: 43157 - DNA, 20 bp, Human genital-associated circular DNA virus-1
taatagggtacaatccacgg

SEQ ID NO: 43158 - DNA, 20 bp, Human genital-associated circular DNA virus-1
taagtgaaaacaacgcggcg

SEQ ID NO: 43159 - DNA, 20 bp, Human papillomavirus type 140
gcttttttaaactgcaattg

SEQ ID NO: 43160 - DNA, 20 bp, Human papillomavirus type 140
tttaaactgcaattgaaatg

SEQ ID NO: 43161 - DNA, 20 bp, Human papillomavirus type 140
ttaaactgcaattgaaatgt

SEQ ID NO: 43162 - DNA, 20 bp, Human papillomavirus type 140
taaactgcaattgaaatgta

SEQ ID NO: 43163 - DNA, 20 bp, Human papillomavirus type 140
aaactgcaattgaaatgtat

SEQ ID NO: 43164 - DNA, 20 bp, Human papillomavirus type 140
cagagttgacagtttgtgta

SEQ ID NO: 43165 - DNA, 20 bp, Human papillomavirus type 140
acagtttgtgtaattcttgt

SEQ ID NO: 43166 - DNA, 20 bp, Human papillomavirus type 140
gtgtaattcttgtacagcca

SEQ ID NO: 43167 - DNA, 20 bp, Human papillomavirus type 140
tgtaattcttgtacagccag

SEQ ID NO: 43168 - DNA, 20 bp, Human papillomavirus type 140
ttgtacagccagagtcaggc

SEQ ID NO: 43169 - DNA, 20 bp, Human papillomavirus type 140
aaaggagactgtttgaggac

SEQ ID NO: 43170 - DNA, 20 bp, Human papillomavirus type 140
gaggacagtggaatagcaga

SEQ ID NO: 43171 - DNA, 20 bp, Human papillomavirus type 140
aggacagtggaatagcagaa

SEQ ID NO: 43172 - DNA, 20 bp, Human papillomavirus type 140
gtcatacgaaaatggcggga

SEQ ID NO: 43173 - DNA, 20 bp, Human papillomavirus type 140
tcatacgaaaatggcgggac

SEQ ID NO: 43174 - DNA, 20 bp, Human papillomavirus type 140
caaacaaaaaattaccgaga

SEQ ID NO: 43175 - DNA, 20 bp, Human papillomavirus type 140
ccgagaaagcatattcattt

SEQ ID NO: 43176 - DNA, 20 bp, Human papillomavirus type 140
atttggaatattaccagatt

SEQ ID NO: 43177 - DNA, 20 bp, Human papillomavirus type 140
ggaatattaccagattgggt

SEQ ID NO: 43178 - DNA, 20 bp, Human papillomavirus type 140
gaatattaccagattgggtt

SEQ ID NO: 43179 - DNA, 20 bp, Human papillomavirus type 140
tggattcagccattactaga

SEQ ID NO: 43180 - DNA, 20 bp, Human papillomavirus type 140
ggattcagccattactagat

SEQ ID NO: 43181 - DNA, 20 bp, Human papillomavirus type 140
gattcagccattactagatt

SEQ ID NO: 43182 - DNA, 20 bp, Human papillomavirus type 140
agccattactagattgtaaa

SEQ ID NO: 43183 - DNA, 20 bp, Human papillomavirus type 140
ctagattgtaaagtaggatt

SEQ ID NO: 43184 - DNA, 20 bp, Human papillomavirus type 140
ctccgtctttctgcggggtc

SEQ ID NO: 43185 - DNA, 20 bp, Human papillomavirus type 140
ctgcggggtcttggtgtagg

SEQ ID NO: 43186 - DNA, 20 bp, Human papillomavirus type 140
tgcggggtcttggtgtaggt

SEQ ID NO: 43187 - DNA, 20 bp, Human papillomavirus type 140
gtgtaggtggtggggctgct

SEQ ID NO: 43188 - DNA, 20 bp, Human papillomavirus type 140
atctcctgtctgtgtccccg

SEQ ID NO: 43189 - DNA, 20 bp, Human papillomavirus type 140
gaagtagccatcgatctgtt

SEQ ID NO: 43190 - DNA, 20 bp, Human papillomavirus type 140
cacgatcaggtctctcaaga

SEQ ID NO: 43191 - DNA, 20 bp, Human papillomavirus type 140
aaagacttgaagaggaagct

SEQ ID NO: 43192 - DNA, 20 bp, Human papillomavirus type 140
aagaggaagctagggatcca

SEQ ID NO: 43193 - DNA, 20 bp, Human papillomavirus type 140
accacgaggattggtggatc

SEQ ID NO: 43194 - DNA, 20 bp, Human papillomavirus type 140
attgacactgttccacttcc

SEQ ID NO: 43195 - DNA, 20 bp, Human papillomavirus type 140
ttgacactgttccacttcct

SEQ ID NO: 43196 - DNA, 20 bp, Human papillomavirus type 140
acactgttccacttcctaag

SEQ ID NO: 43197 - DNA, 20 bp, Human papillomavirus type 140
cacttcctaagggtacctcc

SEQ ID NO: 43198 - DNA, 20 bp, Human papillomavirus type 140
ctaagggtacctccatgtgt

SEQ ID NO: 43199 - DNA, 20 bp, Human papillomavirus type 140
gggtatagaccatttaatgc

SEQ ID NO: 43200 - DNA, 20 bp, Human papillomavirus type 140
ggtatagaccatttaatgct

SEQ ID NO: 43201 - DNA, 20 bp, Human papillomavirus type 140
aatgctcaaacacctaggga

SEQ ID NO: 43202 - DNA, 20 bp, Human papillomavirus type 140
atgctcaaacacctagggag

SEQ ID NO: 43203 - DNA, 20 bp, Human papillomavirus type 140
ggccacgtcctaccataccc

SEQ ID NO: 43204 - DNA, 20 bp, Human papillomavirus type 140
aattagaacaaattaatact

SEQ ID NO: 43205 - DNA, 20 bp, Human papillomavirus type 140
gaacaaattaatactatggc

SEQ ID NO: 43206 - DNA, 20 bp, Human papillomavirus type 140
atactatggcgcagtttgaa

SEQ ID NO: 43207 - DNA, 20 bp, Human papillomavirus type 140
gaaatagatgagggaccttt

SEQ ID NO: 43208 - DNA, 20 bp, Human papillomavirus type 140
aaatagatgagggaccttta

SEQ ID NO: 43209 - DNA, 20 bp, Human papillomavirus type 140
agcagaattagctgacaact

SEQ ID NO: 43210 - DNA, 20 bp, Human papillomavirus type 140
gcagaattagctgacaactc

SEQ ID NO: 43211 - DNA, 20 bp, Human papillomavirus type 140
gctgacaactcctctagaca

SEQ ID NO: 43212 - DNA, 20 bp, Human papillomavirus type 140
catttacagaacagccacga

SEQ ID NO: 43213 - DNA, 20 bp, Human papillomavirus type 140
acagaacagccacgactttt

SEQ ID NO: 43214 - DNA, 20 bp, Human papillomavirus type 140
ccaagtgcaatagataatag

SEQ ID NO: 43215 - DNA, 20 bp, Human papillomavirus type 140
cgaccctaaacagaatcaga

SEQ ID NO: 43216 - DNA, 20 bp, Human papillomavirus type 140
gaccctaaacagaatcagat

SEQ ID NO: 43217 - DNA, 20 bp, Human papillomavirus type 140
attgttggttgtgcacctgc

SEQ ID NO: 43218 - DNA, 20 bp, Human papillomavirus type 140
ttggttgtgcacctgccatt

SEQ ID NO: 43219 - DNA, 20 bp, Human papillomavirus type 140
ttaattccatttgcaaatgg

SEQ ID NO: 43220 - DNA, 20 bp, Human papillomavirus type 140
attccatttgcaaatggccg

SEQ ID NO: 43221 - DNA, 20 bp, Human papillomavirus type 140
catttgcaaatggccggatt

SEQ ID NO: 43222 - DNA, 20 bp, Human papillomavirus type 140
gcaaatggccggattttata

SEQ ID NO: 43223 - DNA, 20 bp, Human papillomavirus type 140
caaatggccggattttatac

SEQ ID NO: 43224 - DNA, 20 bp, Human papillomavirus type 140
ctttcctacacccagtggtt

SEQ ID NO: 43225 - DNA, 20 bp, Human papillomavirus type 140
cctacacccagtggttctct

SEQ ID NO: 43226 - DNA, 20 bp, Human papillomavirus type 140
ctacacccagtggttctcta

SEQ ID NO: 43227 - DNA, 20 bp, Human papillomavirus type 140
tctagttactagtgaggccc

SEQ ID NO: 43228 - DNA, 20 bp, Human papillomavirus type 140
ctagtgaggcccagttattt

SEQ ID NO: 43229 - DNA, 20 bp, Human papillomavirus type 140
ggacattgatttgcaggatc

SEQ ID NO: 43230 - DNA, 20 bp, Human papillomavirus type 140
atttgcaggatcgctttact

SEQ ID NO: 43231 - DNA, 20 bp, Human papillomavirus type 140
gcaggatcgctttacttctg

SEQ ID NO: 43232 - DNA, 20 bp, Human papillomavirus type 140
caggatcgctttacttctga

SEQ ID NO: 43233 - DNA, 20 bp, Human papillomavirus type 140
acttctgatttggatcagac

SEQ ID NO: 43234 - DNA, 20 bp, Human papillomavirus type 140
tcggtgggttagagaccgat

SEQ ID NO: 43235 - DNA, 20 bp, Human papillomavirus type 140
cggtgggttagagaccgatt

SEQ ID NO: 43236 - DNA, 20 bp, Human papillomavirus type 140
ggtgggttagagaccgattt

SEQ ID NO: 43237 - DNA, 20 bp, Human papillomavirus type 140
gagaccgatttcggtgttct

SEQ ID NO: 43238 - DNA, 20 bp, Human papillomavirus type 140
cggtgttctatcactttaac

SEQ ID NO: 43239 - DNA, 20 bp, Hepatitis E virus
cgaatgctgtggtagttagg

SEQ ID NO: 43240 - DNA, 20 bp, Hepatitis E virus
ggccttttctctctcaccag

SEQ ID NO: 43241 - DNA, 20 bp, Hepatitis E virus
tctctctcaccagcagattg

SEQ ID NO: 43242 - DNA, 20 bp, Hepatitis E virus
ctctctcaccagcagattga

SEQ ID NO: 43243 - DNA, 20 bp, Hepatitis E virus
tctctcaccagcagattgag

SEQ ID NO: 43244 - DNA, 20 bp, Hepatitis E virus
ctccgccctgccgggcgtga

SEQ ID NO: 43245 - DNA, 20 bp, Hepatitis E virus
agcgttggtatactgcccct

SEQ ID NO: 43246 - DNA, 20 bp, Hepatitis E virus
gtatactgcccctacccgcg

SEQ ID NO: 43247 - DNA, 20 bp, Hepatitis E virus
ccggcgttccgcactgcgcg

SEQ ID NO: 43248 - DNA, 20 bp, Hepatitis E virus
cgcactgcgcgggctccccg

SEQ ID NO: 43249 - DNA, 20 bp, Hepatitis E virus
acgctgccctccacctcccg

SEQ ID NO: 43250 - DNA, 20 bp, Hepatitis E virus
cgctgccctccacctcccgc

SEQ ID NO: 43251 - DNA, 20 bp, Hepatitis E virus
ccccctggcacataccgcac

SEQ ID NO: 43252 - DNA, 20 bp, Hepatitis E virus
gtcctcttactcacggcagc

SEQ ID NO: 43253 - DNA, 20 bp, Hepatitis E virus
tcctcttactcacggcagcc

SEQ ID NO: 43254 - DNA, 20 bp, Hepatitis E virus
ctcacggcagccccggagcc

SEQ ID NO: 43255 - DNA, 20 bp, Hepatitis E virus
cttacccccggtctaccgag

SEQ ID NO: 43256 - DNA, 20 bp, Hepatitis E virus
cccccggtctaccgaggtct

SEQ ID NO: 43257 - DNA, 20 bp, Hepatitis E virus
ttgccaatgaaggctggaac

SEQ ID NO: 43258 - DNA, 20 bp, Hepatitis E virus
ccaatgaaggctggaacgcc

SEQ ID NO: 43259 - DNA, 20 bp, Hepatitis E virus
cagctgtcatcactgccgcc

SEQ ID NO: 43260 - DNA, 20 bp, Hepatitis E virus
ccatctgccaccagcggtac

SEQ ID NO: 43261 - DNA, 20 bp, Hepatitis E virus
gatatagcctgagtgcggag

SEQ ID NO: 43262 - DNA, 20 bp, Hepatitis E virus
catcttgacccacgggtgtt

SEQ ID NO: 43263 - DNA, 20 bp, Hepatitis E virus
atcttgacccacgggtgttg

SEQ ID NO: 43264 - DNA, 20 bp, Hepatitis E virus
acccacgggtgttggttttt

SEQ ID NO: 43265 - DNA, 20 bp, Hepatitis E virus
gtttttgatgagtcggcccc

SEQ ID NO: 43266 - DNA, 20 bp, Hepatitis E virus
ttgatgagtcggccccctgc

SEQ ID NO: 43267 - DNA, 20 bp, Hepatitis E virus
gtgacatatctgggtcctac

SEQ ID NO: 43268 - DNA, 20 bp, Hepatitis E virus
accaagcccttgacctcccc

SEQ ID NO: 43269 - DNA, 20 bp, Hepatitis E virus
ccaagcccttgacctccccg

SEQ ID NO: 43270 - DNA, 20 bp, Hepatitis E virus
acctccccgctgagattgtg

SEQ ID NO: 43271 - DNA, 20 bp, Hepatitis E virus
tggctcgtgcaggccggctg

SEQ ID NO: 43272 - DNA, 20 bp, Hepatitis E virus
cagtctcacctatgccgcct

SEQ ID NO: 43273 - DNA, 20 bp, Hepatitis E virus
agtctcacctatgccgcctc

SEQ ID NO: 43274 - DNA, 20 bp, Hepatitis E virus
acctacccggatggctctaa

SEQ ID NO: 43275 - DNA, 20 bp, Hepatitis E virus
cctacccggatggctctaag

SEQ ID NO: 43276 - DNA, 20 bp, Hepatitis E virus
gccggctcgctgtttgagtc

SEQ ID NO: 43277 - DNA, 20 bp, Hepatitis E virus
gagtcgacatgtacctggct

SEQ ID NO: 43278 - DNA, 20 bp, Hepatitis E virus
agtcgacatgtacctggctc

SEQ ID NO: 43279 - DNA, 20 bp, Hepatitis E virus
acgccgtcgctcctgattat

SEQ ID NO: 43280 - DNA, 20 bp, Hepatitis E virus
taggttggaacataacccaa

SEQ ID NO: 43281 - DNA, 20 bp, Hepatitis E virus
gaacataacccaaagatgct

SEQ ID NO: 43282 - DNA, 20 bp, Hepatitis E virus
aggctgcctaccgggagact

SEQ ID NO: 43283 - DNA, 20 bp, Hepatitis E virus
ctcccgcctcggtaccgctg

SEQ ID NO: 43284 - DNA, 20 bp, Hepatitis E virus
cacggacagcaaatctggct

SEQ ID NO: 43285 - DNA, 20 bp, Hepatitis E virus
actcagccacagacgtcggc

SEQ ID NO: 43286 - DNA, 20 bp, Hepatitis E virus
gatagccagatttgctgtcc

SEQ ID NO: 43287 - DNA, 20 bp, Hepatitis E virus
gctgtccgtgcaacatcctc

SEQ ID NO: 43288 - DNA, 20 bp, Hepatitis E virus
ctgtccgtgcaacatcctca

SEQ ID NO: 43289 - DNA, 20 bp, Hepatitis E virus
accccgcacactgccgccag

SEQ ID NO: 43290 - DNA, 20 bp, Hepatitis E virus
tcattgatgaggccccgtcc

SEQ ID NO: 43291 - DNA, 20 bp, Hepatitis E virus
atgaggccccgtcccttccc

SEQ ID NO: 43292 - DNA, 20 bp, Hepatitis E virus
cccctcacttgctgctgctc

SEQ ID NO: 43293 - DNA, 20 bp, Hepatitis E virus
ctgctgctccacatgcagcg

SEQ ID NO: 43294 - DNA, 20 bp, Hepatitis E virus
agaccactagtcgggtcctc

SEQ ID NO: 43295 - DNA, 20 bp, Hepatitis E virus
ttctggggtgagcctgctgt

SEQ ID NO: 43296 - DNA, 20 bp, Hepatitis E virus
tggggtgagcctgctgttgg

SEQ ID NO: 43297 - DNA, 20 bp, Hepatitis E virus
ggcagaaactagtgttcacc

SEQ ID NO: 43298 - DNA, 20 bp, Hepatitis E virus
ctgcccaacagcaggctcac

SEQ ID NO: 43299 - DNA, 20 bp, Hepatitis E virus
acgcaccaggcctgcttcgc

SEQ ID NO: 43300 - DNA, 20 bp, Hepatitis E virus
gcgaggtgggcatctccgat

SEQ ID NO: 43301 - DNA, 20 bp, Hepatitis E virus
ataactttttccttgctggt

SEQ ID NO: 43302 - DNA, 20 bp, Hepatitis E virus
ttccttgctggtggcgaaat

SEQ ID NO: 43303 - DNA, 20 bp, Hepatitis E virus
tccttgctggtggcgaaatt

SEQ ID NO: 43304 - DNA, 20 bp, Hepatitis E virus
agctcgacctttgtaaccgc

SEQ ID NO: 43305 - DNA, 20 bp, Hepatitis E virus
gtaaccgcgacgtgtccagg

SEQ ID NO: 43306 - DNA, 20 bp, Hepatitis E virus
taaccgcgacgtgtccagga

SEQ ID NO: 43307 - DNA, 20 bp, Hepatitis E virus
ttccagaaagattgtaataa

SEQ ID NO: 43308 - DNA, 20 bp, Hepatitis E virus
cagaaagattgtaataaatt

SEQ ID NO: 43309 - DNA, 20 bp, Hepatitis E virus
gccggccggcttactgagaa

SEQ ID NO: 43310 - DNA, 20 bp, Hepatitis E virus
ctgagaagaattggggccct

SEQ ID NO: 43311 - DNA, 20 bp, Hepatitis E virus
gggccctggccccgagcggg

SEQ ID NO: 43312 - DNA, 20 bp, Hepatitis E virus
tctccgcaagctcacgaatg

SEQ ID NO: 43313 - DNA, 20 bp, Hepatitis E virus
ctccgcaagctcacgaatgt

SEQ ID NO: 43314 - DNA, 20 bp, Hepatitis E virus
gccaacccgcccgaccactc

SEQ ID NO: 43315 - DNA, 20 bp, Hepatitis E virus
gcgtgaccaggcccagcgcc

SEQ ID NO: 43316 - DNA, 20 bp, Hepatitis E virus
cgcaacctcacccccggtaa

SEQ ID NO: 43317 - DNA, 20 bp, Hepatitis E virus
ctccagcactgcccgtcacc

SEQ ID NO: 43318 - DNA, 20 bp, Hepatitis E virus
gtcgcggtgcagatgggact

SEQ ID NO: 43319 - DNA, 20 bp, Hepatitis E virus
gtattaccgggggtgaggtt

SEQ ID NO: 43320 - DNA, 20 bp, Hepatitis E virus
ccgggggtgaggttgcggaa

SEQ ID NO: 43321 - DNA, 20 bp, Hepatitis E virus
cggctcttcgaccggcccag

SEQ ID NO: 43322 - DNA, 20 bp, Hepatitis E virus
gaccggcccagtctatgtct

SEQ ID NO: 43323 - DNA, 20 bp, Hepatitis E virus
gttaatgtagcgaccggcgc

SEQ ID NO: 43324 - DNA, 20 bp, Hepatitis E virus
atgtagcgaccggcgcgcag

SEQ ID NO: 43325 - DNA, 20 bp, Hepatitis E virus
accaaggtcacagagtcaga

SEQ ID NO: 43326 - DNA, 20 bp, Hepatitis E virus
agaatgccgctgggcatcgg

SEQ ID NO: 43327 - DNA, 20 bp, Hepatitis E virus
ctatttccacttacaccact

SEQ ID NO: 43328 - DNA, 20 bp, Hepatitis E virus
ccacttacaccactagcctg

SEQ ID NO: 43329 - DNA, 20 bp, Hepatitis E virus
cacttacaccactagcctgg

SEQ ID NO: 43330 - DNA, 20 bp, Hepatitis E virus
caccactagcctgggtgctg

SEQ ID NO: 43331 - DNA, 20 bp, Human herpesvirus 3
acgttcgtaatgggcatata

SEQ ID NO: 43332 - DNA, 20 bp, Human herpesvirus 3
gtaatgggcatataatgatg

SEQ ID NO: 43333 - DNA, 20 bp, Human herpesvirus 3
tatgcccattacgaacgtca

SEQ ID NO: 43334 - DNA, 20 bp, Human herpesvirus 3
cgaacgtcaagtattggctg

SEQ ID NO: 43335 - DNA, 20 bp, Human herpesvirus 3
gctgcatatcgacgactcta

SEQ ID NO: 43336 - DNA, 20 bp, Human herpesvirus 3
tgcttggattacaccataat

SEQ ID NO: 43337 - DNA, 20 bp, Human herpesvirus 3
gattacaccataataatgtt

SEQ ID NO: 43338 - DNA, 20 bp, Human herpesvirus 3
caccataataatgttcctga

SEQ ID NO: 43339 - DNA, 20 bp, Human herpesvirus 3
ctgaatcgttggtggtctcg

SEQ ID NO: 43340 - DNA, 20 bp, Human herpesvirus 3
gtggtctcgtgtatgtctaa

SEQ ID NO: 43341 - DNA, 20 bp, Human herpesvirus 3
ctatataacataaccggtaa

SEQ ID NO: 43342 - DNA, 20 bp, Human herpesvirus 3
acgcattgcccagttgacgg

SEQ ID NO: 43343 - DNA, 20 bp, Human herpesvirus 3
cccagttgacggtgcggatc

SEQ ID NO: 43344 - DNA, 20 bp, Human herpesvirus 3
acggtgcggatctataaggt

SEQ ID NO: 43345 - DNA, 20 bp, Human herpesvirus 3
tagatccgcaccgtcaactg

SEQ ID NO: 43346 - DNA, 20 bp, Human herpesvirus 3
caactttcgatcataaacga

SEQ ID NO: 43347 - DNA, 20 bp, Human herpesvirus 3
cgatcataaacgatttatag

SEQ ID NO: 43348 - DNA, 20 bp, Human herpesvirus 3
gatcataaacgatttatagg

SEQ ID NO: 43349 - DNA, 20 bp, Human herpesvirus 3
ataggaacggcatatgaaag

SEQ ID NO: 43350 - DNA, 20 bp, Human herpesvirus 3
taggaacggcatatgaaaga

SEQ ID NO: 43351 - DNA, 20 bp, Human herpesvirus 3
gatgttgtgttgcaaaaaca

SEQ ID NO: 43352 - DNA, 20 bp, Human herpesvirus 3
tgttgcaaaaacaaagacag

SEQ ID NO: 43353 - DNA, 20 bp, Human herpesvirus 3
caaaaacaaagacagtttga

SEQ ID NO: 43354 - DNA, 20 bp, Human herpesvirus 3
gaagagaccgcgtctcgctt

SEQ ID NO: 43355 - DNA, 20 bp, Human herpesvirus 3
aagagaccgcgtctcgctta

SEQ ID NO: 43356 - DNA, 20 bp, Human herpesvirus 3
tgttttatgggaacgaaaag

SEQ ID NO: 43357 - DNA, 20 bp, Human herpesvirus 3
tatgggaacgaaaagactcg

SEQ ID NO: 43358 - DNA, 20 bp, Human herpesvirus 3
atgggaacgaaaagactcga

SEQ ID NO: 43359 - DNA, 20 bp, Human herpesvirus 3
tgggaacgaaaagactcgat

SEQ ID NO: 43360 - DNA, 20 bp, Human herpesvirus 3
cagctccggattatgtggtc

SEQ ID NO: 43361 - DNA, 20 bp, Human herpesvirus 3
cacataaattttttgagttg

SEQ ID NO: 43362 - DNA, 20 bp, Human herpesvirus 3
tttgagttggtcaacggccc

SEQ ID NO: 43363 - DNA, 20 bp, Human herpesvirus 3
ttgagttggtcaacggccca

SEQ ID NO: 43364 - DNA, 20 bp, Human herpesvirus 3
tgagttggtcaacggcccat

SEQ ID NO: 43365 - DNA, 20 bp, Human herpesvirus 3
gagttggtcaacggcccatt

SEQ ID NO: 43366 - DNA, 20 bp, Human herpesvirus 3
taattccactataaaacaaa

SEQ ID NO: 43367 - DNA, 20 bp, Human herpesvirus 3
aattccactataaaacaaac

SEQ ID NO: 43368 - DNA, 20 bp, Human herpesvirus 3
attccactataaaacaaacg

SEQ ID NO: 43369 - DNA, 20 bp, Human herpesvirus 3
cactataaaacaaacggtct

SEQ ID NO: 43370 - DNA, 20 bp, Human herpesvirus 3
ccggcaccactggattccgt

SEQ ID NO: 43371 - DNA, 20 bp, Human herpesvirus 3
cgttaagcgcgtctcgtatc

SEQ ID NO: 43372 - DNA, 20 bp, Human herpesvirus 3
agcgcgtctcgtatctcggg

SEQ ID NO: 43373 - DNA, 20 bp, Human herpesvirus 3
ctggtaactccaacatacgc

SEQ ID NO: 43374 - DNA, 20 bp, Human herpesvirus 3
tggtaactccaacatacgca

SEQ ID NO: 43375 - DNA, 20 bp, Human herpesvirus 3
gagttaccagaaagtttgca

SEQ ID NO: 43376 - DNA, 20 bp, Human herpesvirus 3
caactggaaatgtgctgtca

SEQ ID NO: 43377 - DNA, 20 bp, Human herpesvirus 3
catttttgatttttttaaac

SEQ ID NO: 43378 - DNA, 20 bp, Human herpesvirus 3
ttgatttttttaaacaaata

SEQ ID NO: 43379 - DNA, 20 bp, Human herpesvirus 3
tgatttttttaaacaaatac

SEQ ID NO: 43380 - DNA, 20 bp, Human herpesvirus 3
gatttttttaaacaaatacg

SEQ ID NO: 43381 - DNA, 20 bp, Human herpesvirus 3
ataacaccgctatacgcatt

SEQ ID NO: 43382 - DNA, 20 bp, Human herpesvirus 3
cgatgaggtgctgcttcttc

SEQ ID NO: 43383 - DNA, 20 bp, Human herpesvirus 3
gatgaggtgctgcttcttcc

SEQ ID NO: 43384 - DNA, 20 bp, Human herpesvirus 3
ttccggtgaatattcataaa

SEQ ID NO: 43385 - DNA, 20 bp, Human herpesvirus 3
cggtgaatattcataaaact

SEQ ID NO: 43386 - DNA, 20 bp, Human herpesvirus 3
gcattttaaacgggtccggc

SEQ ID NO: 43387 - DNA, 20 bp, Human herpesvirus 3
taaacgggtccggctgccta

SEQ ID NO: 43388 - DNA, 20 bp, Human herpesvirus 3
aaacgggtccggctgcctaa

SEQ ID NO: 43389 - DNA, 20 bp, Human herpesvirus 3
aacgggtccggctgcctaaa

SEQ ID NO: 43390 - DNA, 20 bp, Human herpesvirus 3
cctttactgtaagtacaaaa

SEQ ID NO: 43391 - DNA, 20 bp, Human herpesvirus 3
ctctgggaatcggggggagg

SEQ ID NO: 43392 - DNA, 20 bp, Human herpesvirus 3
cgagcctcgtccgccgacgc

SEQ ID NO: 43393 - DNA, 20 bp, Human herpesvirus 3
ccagagtaatgtggccgccc

SEQ ID NO: 43394 - DNA, 20 bp, Human herpesvirus 3
tggggccgcggagacggtgt

SEQ ID NO: 43395 - DNA, 20 bp, Human herpesvirus 3
ggggccgcggagacggtgtt

SEQ ID NO: 43396 - DNA, 20 bp, Human herpesvirus 3
caaccgtcaaaacccggcag

SEQ ID NO: 43397 - DNA, 20 bp, Human herpesvirus 3
acggggcgacagggggacgc

SEQ ID NO: 43398 - DNA, 20 bp, Human herpesvirus 3
tgacggttgcaaggacctcg

SEQ ID NO: 43399 - DNA, 20 bp, Human herpesvirus 3
gacggttgcaaggacctcgc

SEQ ID NO: 43400 - DNA, 20 bp, Human herpesvirus 3
acggttgcaaggacctcgcg

SEQ ID NO: 43401 - DNA, 20 bp, Human herpesvirus 3
gatgggaggggtgccgatcc

SEQ ID NO: 43402 - DNA, 20 bp, Human herpesvirus 3
cgtcgggcatcatgagcggc

SEQ ID NO: 43403 - DNA, 20 bp, Human herpesvirus 3
gcccggatcggcacccctcc

SEQ ID NO: 43404 - DNA, 20 bp, Human herpesvirus 3
ggaccgtccggggagaccag

SEQ ID NO: 43405 - DNA, 20 bp, Human herpesvirus 3
gaccgtccggggagaccaga

SEQ ID NO: 43406 - DNA, 20 bp, Human herpesvirus 3
taccccgggcatcatgtttc

SEQ ID NO: 43407 - DNA, 20 bp, Human herpesvirus 3
ccttgggcgggtatcatcgg

SEQ ID NO: 43408 - DNA, 20 bp, Human herpesvirus 3
cttgggcgggtatcatcggt

SEQ ID NO: 43409 - DNA, 20 bp, Human herpesvirus 3
ggcgggtatcatcggtctca

SEQ ID NO: 43410 - DNA, 20 bp, Human herpesvirus 3
gagaccgatgatacccgccc

SEQ ID NO: 43411 - DNA, 20 bp, Human immunodeficiency virus 1
ggttaaggccagggggaaag

SEQ ID NO: 43412 - DNA, 20 bp, Human immunodeficiency virus 1
aggccagggggaaagaaaaa

SEQ ID NO: 43413 - DNA, 20 bp, Human immunodeficiency virus 1
aaacatatagtatgggcaag

SEQ ID NO: 43414 - DNA, 20 bp, Human immunodeficiency virus 1
gcagttaatcctggcctgtt

SEQ ID NO: 43415 - DNA, 20 bp, Human immunodeficiency virus 1
atcctggcctgttagaaaca

SEQ ID NO: 43416 - DNA, 20 bp, Human immunodeficiency virus 1
ccctatagtgcagaacatcc

SEQ ID NO: 43417 - DNA, 20 bp, Human immunodeficiency virus 1
cccctggatgttctgcacta

SEQ ID NO: 43418 - DNA, 20 bp, Human immunodeficiency virus 1
tgcactatagggtaattttg

SEQ ID NO: 43419 - DNA, 20 bp, Human immunodeficiency virus 1
tggctgacctgattgctgtg

SEQ ID NO: 43420 - DNA, 20 bp, Human immunodeficiency virus 1
ggctgacctgattgctgtgt

SEQ ID NO: 43421 - DNA, 20 bp, Human immunodeficiency virus 1
caccaggccagatgagagaa

SEQ ID NO: 43422 - DNA, 20 bp, Human immunodeficiency virus 1
ctgctatgtcacttcccctt

SEQ ID NO: 43423 - DNA, 20 bp, Human immunodeficiency virus 1
cccttggttctctcatctgg

SEQ ID NO: 43424 - DNA, 20 bp, Human immunodeficiency virus 1
gttctctcatctggcctggt

SEQ ID NO: 43425 - DNA, 20 bp, Human immunodeficiency virus 1
tctcatctggcctggtgcaa

SEQ ID NO: 43426 - DNA, 20 bp, Human immunodeficiency virus 1
gatgacagaaaccttgttgg

SEQ ID NO: 43427 - DNA, 20 bp, Human immunodeficiency virus 1
ttggtccaaaatgcgaaccc

SEQ ID NO: 43428 - DNA, 20 bp, Human immunodeficiency virus 1
gtccaaaatgcgaacccaga

SEQ ID NO: 43429 - DNA, 20 bp, Human immunodeficiency virus 1
taagactattttaaaagcat

SEQ ID NO: 43430 - DNA, 20 bp, Human immunodeficiency virus 1
taaaagcattgggaccagcg

SEQ ID NO: 43431 - DNA, 20 bp, Human immunodeficiency virus 1
cacagggatggaaaggatca

SEQ ID NO: 43432 - DNA, 20 bp, Human immunodeficiency virus 1
caaagtagcatgacaaaaat

SEQ ID NO: 43433 - DNA, 20 bp, Human immunodeficiency virus 1
gagccttttagaaaacaaaa

SEQ ID NO: 43434 - DNA, 20 bp, Human immunodeficiency virus 1
tgttttctaaaaggctctaa

SEQ ID NO: 43435 - DNA, 20 bp, Human immunodeficiency virus 1
gttttctaaaaggctctaag

SEQ ID NO: 43436 - DNA, 20 bp, Human immunodeficiency virus 1
gtggggaaattgaattgggc

SEQ ID NO: 43437 - DNA, 20 bp, Human immunodeficiency virus 1
aattgggcaagtcagattta

SEQ ID NO: 43438 - DNA, 20 bp, Human immunodeficiency virus 1
ggcaagtcagatttacccag

SEQ ID NO: 43439 - DNA, 20 bp, Human immunodeficiency virus 1
ctttaatccctgggtaaatc

SEQ ID NO: 43440 - DNA, 20 bp, Human immunodeficiency virus 1
aatccctgggtaaatctgac

SEQ ID NO: 43441 - DNA, 20 bp, Human immunodeficiency virus 1
acagaggcagtgcaaaaaat

SEQ ID NO: 43442 - DNA, 20 bp, Human immunodeficiency virus 1
aaactgcccatacaaaagga

SEQ ID NO: 43443 - DNA, 20 bp, Human immunodeficiency virus 1
aactgcccatacaaaaggaa

SEQ ID NO: 43444 - DNA, 20 bp, Human immunodeficiency virus 1
ccaatactctgtccaccatg

SEQ ID NO: 43445 - DNA, 20 bp, Human immunodeficiency virus 1
cccatgtttccttttgtatg

SEQ ID NO: 43446 - DNA, 20 bp, Human immunodeficiency virus 1
gagagcaatggctagtgatt

SEQ ID NO: 43447 - DNA, 20 bp, Human immunodeficiency virus 1
taacctgccacctgtagtag

SEQ ID NO: 43448 - DNA, 20 bp, Human immunodeficiency virus 1
aacctgccacctgtagtagc

SEQ ID NO: 43449 - DNA, 20 bp, Human immunodeficiency virus 1
acctgccacctgtagtagca

SEQ ID NO: 43450 - DNA, 20 bp, Human immunodeficiency virus 1
cttttgctactacaggtggc

SEQ ID NO: 43451 - DNA, 20 bp, Human immunodeficiency virus 1
tcttttaaaattagcaggaa

SEQ ID NO: 43452 - DNA, 20 bp, Human immunodeficiency virus 1
cttttaaaattagcaggaag

SEQ ID NO: 43453 - DNA, 20 bp, Human immunodeficiency virus 1
ttttaaaattagcaggaaga

SEQ ID NO: 43454 - DNA, 20 bp, Human immunodeficiency virus 1
taaaattagcaggaagatgg

SEQ ID NO: 43455 - DNA, 20 bp, Human immunodeficiency virus 1
aaaattagcaggaagatggc

SEQ ID NO: 43456 - DNA, 20 bp, Human immunodeficiency virus 1
tatagacatcactatgaaag

SEQ ID NO: 43457 - DNA, 20 bp, Human immunodeficiency virus 1
atagacatcactatgaaagc

SEQ ID NO: 43458 - DNA, 20 bp, Human immunodeficiency virus 1
tagacatcactatgaaagcc

SEQ ID NO: 43459 - DNA, 20 bp, Human immunodeficiency virus 1
agaagtacacatcccactag

SEQ ID NO: 43460 - DNA, 20 bp, Human immunodeficiency virus 1
gtaataacaacatattgggg

SEQ ID NO: 43461 - DNA, 20 bp, Human immunodeficiency virus 1
gcactagcagcattaataac

SEQ ID NO: 43462 - DNA, 20 bp, Human immunodeficiency virus 1
ataacaccaaaaaagataaa

SEQ ID NO: 43463 - DNA, 20 bp, Human immunodeficiency virus 1
gcctagtgttacgaaactga

SEQ ID NO: 43464 - DNA, 20 bp, Human immunodeficiency virus 1
cctagtgttacgaaactgac

SEQ ID NO: 43465 - DNA, 20 bp, Human immunodeficiency virus 1
cgaaactgacagaggataga

SEQ ID NO: 43466 - DNA, 20 bp, Human immunodeficiency virus 1
tggggatacttgggcaggag

SEQ ID NO: 43467 - DNA, 20 bp, Human immunodeficiency virus 1
ggcaggagtggaagccataa

SEQ ID NO: 43468 - DNA, 20 bp, Human immunodeficiency virus 1
tgcaacaactgctgtttatc

SEQ ID NO: 43469 - DNA, 20 bp, Human immunodeficiency virus 1
atccattttcagaattgggt

SEQ ID NO: 43470 - DNA, 20 bp, Human immunodeficiency virus 1
tccattttcagaattgggtg

SEQ ID NO: 43471 - DNA, 20 bp, Human immunodeficiency virus 1
tgggtcacagtctattatgg

SEQ ID NO: 43472 - DNA, 20 bp, Human immunodeficiency virus 1
tggggtacctgtgtggaagg

SEQ ID NO: 43473 - DNA, 20 bp, Human immunodeficiency virus 1
tgtgcatcagatgctaaagc

SEQ ID NO: 43474 - DNA, 20 bp, Human immunodeficiency virus 1
gtgcatcagatgctaaagca

SEQ ID NO: 43475 - DNA, 20 bp, Human immunodeficiency virus 1
tgcatcagatgctaaagcat

SEQ ID NO: 43476 - DNA, 20 bp, Human immunodeficiency virus 1
ggccagtagtatcaactcaa

SEQ ID NO: 43477 - DNA, 20 bp, Human immunodeficiency virus 1
aatggcagtctagcagaaga

SEQ ID NO: 43478 - DNA, 20 bp, Human immunodeficiency virus 1
ctacctcttcttctgctaga

SEQ ID NO: 43479 - DNA, 20 bp, Human immunodeficiency virus 1
ttctgctagactgccattta

SEQ ID NO: 43480 - DNA, 20 bp, Human immunodeficiency virus 1
tgctagactgccatttaaca

SEQ ID NO: 43481 - DNA, 20 bp, Human immunodeficiency virus 1
gatgttcatcaaatattaca

SEQ ID NO: 43482 - DNA, 20 bp, Human immunodeficiency virus 1
atcaaatattacagggctgc

SEQ ID NO: 43483 - DNA, 20 bp, Human immunodeficiency virus 1
cagggctgctattaacaaga

SEQ ID NO: 43484 - DNA, 20 bp, Human immunodeficiency virus 1
acaagagatggtggtaatag

SEQ ID NO: 43485 - DNA, 20 bp, Human immunodeficiency virus 1
agacctggaggaggagatat

SEQ ID NO: 43486 - DNA, 20 bp, Human immunodeficiency virus 1
ttgtctggtatagtgcagca

SEQ ID NO: 43487 - DNA, 20 bp, Human immunodeficiency virus 1
tctggtatagtgcagcagca

SEQ ID NO: 43488 - DNA, 20 bp, Human immunodeficiency virus 1
gctgagggctattgaggcgc

SEQ ID NO: 43489 - DNA, 20 bp, Human immunodeficiency virus 1
ctgagggctattgaggcgca

SEQ ID NO: 43490 - DNA, 20 bp, Human immunodeficiency virus 1
aggcgcaacagcatctgttg

SEQ ID NO: 43491 - DNA, 20 bp, Human immunodeficiency virus 1
tgcctggctagaagcacaag

SEQ ID NO: 43492 - DNA, 20 bp, Human immunodeficiency virus 1
tgcttctagccaggcacaag

SEQ ID NO: 43493 - DNA, 20 bp, Human immunodeficiency virus 1
tagccaggcacaagcagcat

SEQ ID NO: 43494 - DNA, 20 bp, Human immunodeficiency virus 1
gtagctgctgtattgctact

SEQ ID NO: 43495 - DNA, 20 bp, Human immunodeficiency virus 1
ctacttgtgattgctccatg

SEQ ID NO: 43496 - DNA, 20 bp, Human immunodeficiency virus 1
aagaactgctgacatcgagc

SEQ ID NO: 43497 - DNA, 20 bp, Human immunodeficiency virus 1
ctacaagggactttccgctg

SEQ ID NO: 43498 - DNA, 20 bp, Human immunodeficiency virus 1
ccgctggggactttccaggg

SEQ ID NO: 43499 - DNA, 20 bp, Human immunodeficiency virus 1
cgctggggactttccaggga

SEQ ID NO: 43500 - DNA, 20 bp, Human immunodeficiency virus 1
ccagggaggcgtggcctggg

SEQ ID NO: 43501 - DNA, 20 bp, Human herpesvirus 2
accgcgactccacctccgag

SEQ ID NO: 43502 - DNA, 20 bp, Human herpesvirus 2
ccacctcggtctcctcctcc

SEQ ID NO: 43503 - DNA, 20 bp, Human herpesvirus 2
tccagactgagcccctggga

SEQ ID NO: 43504 - DNA, 20 bp, Human herpesvirus 2
ggagctgatgccgtagtcgg

SEQ ID NO: 43505 - DNA, 20 bp, Human herpesvirus 2
gagctgatgccgtagtcggc

SEQ ID NO: 43506 - DNA, 20 bp, Human herpesvirus 2
tccacgtaggtgctgaaggg

SEQ ID NO: 43507 - DNA, 20 bp, Human herpesvirus 2
tcctacgggagctcttcggg

SEQ ID NO: 43508 - DNA, 20 bp, Human herpesvirus 2
ggggaggtgtttgagagcgc

SEQ ID NO: 43509 - DNA, 20 bp, Human herpesvirus 2
gagagcgcccccttcagcac

SEQ ID NO: 43510 - DNA, 20 bp, Human herpesvirus 2
agagcgcccccttcagcacc

SEQ ID NO: 43511 - DNA, 20 bp, Human herpesvirus 2
gtccagcccggcgaagataa

SEQ ID NO: 43512 - DNA, 20 bp, Human herpesvirus 2
cccgacgacgaccttgacgt

SEQ ID NO: 43513 - DNA, 20 bp, Human herpesvirus 2
acgttatcttcgccgggctg

SEQ ID NO: 43514 - DNA, 20 bp, Human herpesvirus 2
tcttcgccgggctggacgaa

SEQ ID NO: 43515 - DNA, 20 bp, Human herpesvirus 2
gccgggctggacgaacagca

SEQ ID NO: 43516 - DNA, 20 bp, Human herpesvirus 2
acgaagctgtcgtcgcgcag

SEQ ID NO: 43517 - DNA, 20 bp, Human herpesvirus 2
cggaggcgcgcggtcaccgc

SEQ ID NO: 43518 - DNA, 20 bp, Human herpesvirus 2
gggttcgacgggacgtttcg

SEQ ID NO: 43519 - DNA, 20 bp, Human herpesvirus 2
ggttcgacgggacgtttcgg

SEQ ID NO: 43520 - DNA, 20 bp, Human herpesvirus 2
gacgggacgtttcggacctt

SEQ ID NO: 43521 - DNA, 20 bp, Human herpesvirus 2
aggtaggcgtggagcttggc

SEQ ID NO: 43522 - DNA, 20 bp, Human herpesvirus 2
ggtaggcgtggagcttggcc

SEQ ID NO: 43523 - DNA, 20 bp, Human herpesvirus 2
gccatgtacgcgctgacctc

SEQ ID NO: 43524 - DNA, 20 bp, Human herpesvirus 2
tgggacgagaacagccgcgt

SEQ ID NO: 43525 - DNA, 20 bp, Human herpesvirus 2
cggggtggacgcggctgttc

SEQ ID NO: 43526 - DNA, 20 bp, Human herpesvirus 2
gcgtggcgcccgtgaccacg

SEQ ID NO: 43527 - DNA, 20 bp, Human herpesvirus 2
agggtctgcacgcacgtact

SEQ ID NO: 43528 - DNA, 20 bp, Human herpesvirus 2
ccggatccggcgttgccggt

SEQ ID NO: 43529 - DNA, 20 bp, Human herpesvirus 2
aagattctgcgccaccgcaa

SEQ ID NO: 43530 - DNA, 20 bp, Human herpesvirus 2
tgcgccaccgcaacaaccag

SEQ ID NO: 43531 - DNA, 20 bp, Human herpesvirus 2
cctggccctggttgttgcgg

SEQ ID NO: 43532 - DNA, 20 bp, Human herpesvirus 2
ctggccctggttgttgcggt

SEQ ID NO: 43533 - DNA, 20 bp, Human herpesvirus 2
ttgcggtggcgcagaatctt

SEQ ID NO: 43534 - DNA, 20 bp, Human herpesvirus 2
gtcaaggtgtcggcgtggtt

SEQ ID NO: 43535 - DNA, 20 bp, Human herpesvirus 2
acgaacagcgagggcgtggc

SEQ ID NO: 43536 - DNA, 20 bp, Human herpesvirus 2
tccaggtacatcagcaggca

SEQ ID NO: 43537 - DNA, 20 bp, Human herpesvirus 2
gacgacgagctagtcctgcc

SEQ ID NO: 43538 - DNA, 20 bp, Human herpesvirus 2
ttggccagcaggtagtgggc

SEQ ID NO: 43539 - DNA, 20 bp, Human herpesvirus 2
gccagcaggtagtgggccat

SEQ ID NO: 43540 - DNA, 20 bp, Human herpesvirus 2
catgccacgacgcccggggg

SEQ ID NO: 43541 - DNA, 20 bp, Human herpesvirus 2
ccgtgtatcgaacgagcgcg

SEQ ID NO: 43542 - DNA, 20 bp, Human herpesvirus 2
tagggtgctaaagttcaccg

SEQ ID NO: 43543 - DNA, 20 bp, Human herpesvirus 2
agcaccctataagtctgggg

SEQ ID NO: 43544 - DNA, 20 bp, Human herpesvirus 2
gcaccctataagtctggggc

SEQ ID NO: 43545 - DNA, 20 bp, Human herpesvirus 2
cagtggcccagttcgaacac

SEQ ID NO: 43546 - DNA, 20 bp, Human herpesvirus 2
gaacaccagctgcatgtagc

SEQ ID NO: 43547 - DNA, 20 bp, Human herpesvirus 2
agcagctccagcacgtcctc

SEQ ID NO: 43548 - DNA, 20 bp, Human herpesvirus 2
gaactgggccactgtaacgt

SEQ ID NO: 43549 - DNA, 20 bp, Human herpesvirus 2
agggtggggtgtagggccac

SEQ ID NO: 43550 - DNA, 20 bp, Human herpesvirus 2
gggtggggtgtagggccaca

SEQ ID NO: 43551 - DNA, 20 bp, Human herpesvirus 2
atcgtggggatgacgcccgt

SEQ ID NO: 43552 - DNA, 20 bp, Human herpesvirus 2
tggccctacaccccacccta

SEQ ID NO: 43553 - DNA, 20 bp, Human herpesvirus 2
cggagagtccgtacccgccc

SEQ ID NO: 43554 - DNA, 20 bp, Human herpesvirus 2
tgtagatgaccacccggtac

SEQ ID NO: 43555 - DNA, 20 bp, Human herpesvirus 2
acggaccgcgtgctgctgct

SEQ ID NO: 43556 - DNA, 20 bp, Human herpesvirus 2
cggaccgcgtgctgctgctc

SEQ ID NO: 43557 - DNA, 20 bp, Human herpesvirus 2
tgtcggcagcagcagggccg

SEQ ID NO: 43558 - DNA, 20 bp, Human herpesvirus 2
gcgagcgtatcgtcgaaggc

SEQ ID NO: 43559 - DNA, 20 bp, Human herpesvirus 2
gacgatacgctcgccaagtt

SEQ ID NO: 43560 - DNA, 20 bp, Human herpesvirus 2
tgggcctcgcgttctccggg

SEQ ID NO: 43561 - DNA, 20 bp, Human herpesvirus 2
tccggggcgcggccctgctg

SEQ ID NO: 43562 - DNA, 20 bp, Human herpesvirus 2
agggggcggttgttaaactc

SEQ ID NO: 43563 - DNA, 20 bp, Human herpesvirus 2
ttaaactcggcccgctcgtt

SEQ ID NO: 43564 - DNA, 20 bp, Human herpesvirus 2
aactcggcccgctcgttgtt

SEQ ID NO: 43565 - DNA, 20 bp, Human herpesvirus 2
aacaaccgccccctgaagca

SEQ ID NO: 43566 - DNA, 20 bp, Human herpesvirus 2
acaaccgccccctgaagcac

SEQ ID NO: 43567 - DNA, 20 bp, Human herpesvirus 2
gcggcggccgcacccacgac

SEQ ID NO: 43568 - DNA, 20 bp, Human herpesvirus 2
atcaccccgctcgggttctc

SEQ ID NO: 43569 - DNA, 20 bp, Human herpesvirus 2
tcaccccgctcgggttctcg

SEQ ID NO: 43570 - DNA, 20 bp, Human herpesvirus 2
agccgcgcctccaattccaa

SEQ ID NO: 43571 - DNA, 20 bp, Human herpesvirus 2
gccgcgcctccaattccaag

SEQ ID NO: 43572 - DNA, 20 bp, Human herpesvirus 2
caagtgggccgccttggcgg

SEQ ID NO: 43573 - DNA, 20 bp, Human herpesvirus 2
gcggccataaaggcgccaac

SEQ ID NO: 43574 - DNA, 20 bp, Human herpesvirus 2
tgtactcacgccctcccggt

SEQ ID NO: 43575 - DNA, 20 bp, Human herpesvirus 2
caggccctgcaccgctccga

SEQ ID NO: 43576 - DNA, 20 bp, Human herpesvirus 2
aggccctgcaccgctccgaa

SEQ ID NO: 43577 - DNA, 20 bp, Human herpesvirus 2
cggcagttggttcacttcgt

SEQ ID NO: 43578 - DNA, 20 bp, Human herpesvirus 2
ggcagttggttcacttcgtg

SEQ ID NO: 43579 - DNA, 20 bp, Human herpesvirus 2
gttcacttcgtgcgggactt

SEQ ID NO: 43580 - DNA, 20 bp, Human herpesvirus 2
tcgttcccggacggctcgcg

SEQ ID NO: 43581 - DNA, 20 bp, Human herpesvirus 2
ccggacggctcgcgcagcac

SEQ ID NO: 43582 - DNA, 20 bp, Human herpesvirus 2
gcctccagccacaacacgaa

SEQ ID NO: 43583 - DNA, 20 bp, Human herpesvirus 2
cctccagccacaacacgaac

SEQ ID NO: 43584 - DNA, 20 bp, Human herpesvirus 2
cgttcgtgttgtggctggag

SEQ ID NO: 43585 - DNA, 20 bp, Human herpesvirus 2
gggggggggtgggtgagcgg

SEQ ID NO: 43586 - DNA, 20 bp, Human herpesvirus 2
tgtcgcggggcggctacggg

SEQ ID NO: 43587 - DNA, 20 bp, Human herpesvirus 2
tccgctgacgcgtgcttttg

SEQ ID NO: 43588 - DNA, 20 bp, Human herpesvirus 2
tgttccaccgctcacccacc

SEQ ID NO: 43589 - DNA, 20 bp, Human herpesvirus 2
gttccaccgctcacccaccc

SEQ ID NO: 43590 - DNA, 20 bp, Human herpesvirus 2
aacccaaggcagaggtacgc

SEQ ID NO: 43591 - DNA, 20 bp, Human herpesvirus 2
ctcgcagaccctgtgtgggg

SEQ ID NO: 43592 - DNA, 20 bp, Human herpesvirus 2
cgggagagagctacgcgtac

SEQ ID NO: 43593 - DNA, 20 bp, Human herpesvirus 2
ggttcaatcgccgcctctgc

SEQ ID NO: 43594 - DNA, 20 bp, Human herpesvirus 2
gtggcggcgtagatgcgctt

SEQ ID NO: 43595 - DNA, 20 bp, Human herpesvirus 2
tccagggcctccaggaagac

SEQ ID NO: 43596 - DNA, 20 bp, Human herpesvirus 2
ctggaggccctggagaagcg

SEQ ID NO: 43597 - DNA, 20 bp, Human herpesvirus 2
gggttttggcggcccgtggg

SEQ ID NO: 43598 - DNA, 20 bp, Human herpesvirus 2
tggcggcccgtgggttgtta

SEQ ID NO: 43599 - DNA, 20 bp, Human herpesvirus 2
ggcggcccgtgggttgttag

SEQ ID NO: 43600 - DNA, 20 bp, Human herpesvirus 2
gcggcccgtgggttgttagt

SEQ ID NO: 43601 - DNA, 20 bp, Human herpesvirus 2
ttagtcgcgtccgccggcgg

SEQ ID NO: 43602 - DNA, 20 bp, Human herpesvirus 2
tatccgatcccgcggggcaa

SEQ ID NO: 43603 - DNA, 20 bp, Human herpesvirus 2
ccccgcgggatcggatacaa

SEQ ID NO: 43604 - DNA, 20 bp, Human herpesvirus 2
cgggcgttgacgtccgccgc

SEQ ID NO: 43605 - DNA, 20 bp, Human herpesvirus 2
tgccatgacgtccgccggga

SEQ ID NO: 43606 - DNA, 20 bp, Human herpesvirus 2
ccggagcgccgtcgtcgccc

SEQ ID NO: 43607 - DNA, 20 bp, Human herpesvirus 2
cgacgcgctggacgtttggg

SEQ ID NO: 43608 - DNA, 20 bp, Human herpesvirus 2
gacgcgctggacgtttggga

SEQ ID NO: 43609 - DNA, 20 bp, Human herpesvirus 2
gggaacacaggcgcttcatc

SEQ ID NO: 43610 - DNA, 20 bp, Human herpesvirus 2
ggaacacaggcgcttcatcg

SEQ ID NO: 43611 - DNA, 20 bp, Human herpesvirus 2
cgccttcgagtgcgccgtgc

SEQ ID NO: 43612 - DNA, 20 bp, Human herpesvirus 2
gagtgcgccgtgctgtgtct

SEQ ID NO: 43613 - DNA, 20 bp, Human herpesvirus 2
ggtacagcagatacagacac

SEQ ID NO: 43614 - DNA, 20 bp, Human herpesvirus 2
tcgaggcggtccgcgtacac

SEQ ID NO: 43615 - DNA, 20 bp, Human herpesvirus 2
aggtcgatgaaggtgctgac

SEQ ID NO: 43616 - DNA, 20 bp, Human herpesvirus 2
atcgacctgaacatcaccat

SEQ ID NO: 43617 - DNA, 20 bp, Human herpesvirus 2
ctccttgaggtgcggcagga

SEQ ID NO: 43618 - DNA, 20 bp, Human herpesvirus 2
aggtgcggcaggagccccac

SEQ ID NO: 43619 - DNA, 20 bp, Human herpesvirus 2
tcgacgctgtagtacagcgc

SEQ ID NO: 43620 - DNA, 20 bp, Human herpesvirus 2
atcatgggcgcggggggttc

SEQ ID NO: 43621 - DNA, 20 bp, Human herpesvirus 2
cgctggagggcggtccagaa

SEQ ID NO: 43622 - DNA, 20 bp, Human herpesvirus 2
ggctggttcgaccccggggg

SEQ ID NO: 43623 - DNA, 20 bp, Human herpesvirus 2
tggaccgccctccagcgcaa

SEQ ID NO: 43624 - DNA, 20 bp, Human herpesvirus 2
ccgccggcagaacttctaca

SEQ ID NO: 43625 - DNA, 20 bp, Human herpesvirus 2
tacaacccccacctcgctca

SEQ ID NO: 43626 - DNA, 20 bp, Human herpesvirus 2
ggctgcgttccggtctgagc

SEQ ID NO: 43627 - DNA, 20 bp, Human herpesvirus 2
gctgcgttccggtctgagcg

SEQ ID NO: 43628 - DNA, 20 bp, Human herpesvirus 2
cggtctgagcgaggtggggg

SEQ ID NO: 43629 - DNA, 20 bp, Human herpesvirus 2
ggaacctcgagcgacgtcga

SEQ ID NO: 43630 - DNA, 20 bp, Human herpesvirus 2
aactgcacggcggacaacct

SEQ ID NO: 43631 - DNA, 20 bp, Human herpesvirus 2
actgcacggcggacaacctg

SEQ ID NO: 43632 - DNA, 20 bp, Human herpesvirus 2
tccgccgtgcagttaaactc

SEQ ID NO: 43633 - DNA, 20 bp, Human herpesvirus 2
aactcgacgtcgctcgaggt

SEQ ID NO: 43634 - DNA, 20 bp, Human herpesvirus 2
gcgcagaggaacgcgtaatc

SEQ ID NO: 43635 - DNA, 20 bp, Human herpesvirus 2
cgcgttcctctgcgccaagt

SEQ ID NO: 43636 - DNA, 20 bp, Human herpesvirus 2
ctctgcgccaagtgcctggg

SEQ ID NO: 43637 - DNA, 20 bp, Human herpesvirus 2
cggtgctgtttcaggggttt

SEQ ID NO: 43638 - DNA, 20 bp, Human herpesvirus 2
ggtgctgtttcaggggtttt

SEQ ID NO: 43639 - DNA, 20 bp, Human herpesvirus 2
caggggttttttaaccggcc

SEQ ID NO: 43640 - DNA, 20 bp, Human herpesvirus 2
aggggttttttaaccggccc

SEQ ID NO: 43641 - DNA, 20 bp, Human herpesvirus 2
tttaaccggccccacggcgc

SEQ ID NO: 43642 - DNA, 20 bp, Human herpesvirus 2
gtgcgcatgccccgggtgca

SEQ ID NO: 43643 - DNA, 20 bp, Human herpesvirus 2
tgcgcatgccccgggtgcag

SEQ ID NO: 43644 - DNA, 20 bp, Human herpesvirus 2
ggggacttgacggtcgccac

SEQ ID NO: 43645 - DNA, 20 bp, Human herpesvirus 2
acggtcgccactctcctgcg

SEQ ID NO: 43646 - DNA, 20 bp, Human herpesvirus 2
gcccaccgattcctgttgcg

SEQ ID NO: 43647 - DNA, 20 bp, Human herpesvirus 2
ctgttgcgttcctgtcggcc

SEQ ID NO: 43648 - DNA, 20 bp, Human herpesvirus 2
cgttcctgtcggccggtgct

SEQ ID NO: 43649 - DNA, 20 bp, Human herpesvirus 2
ccccggtcccccccaacgca

SEQ ID NO: 43650 - DNA, 20 bp, Human herpesvirus 2
acgggttcaaacccctggtg

SEQ ID NO: 43651 - DNA, 20 bp, Human herpesvirus 2
aaacccctggtgcggcggtc

SEQ ID NO: 43652 - DNA, 20 bp, Human herpesvirus 2
gaacccgttaaccagccgcg

SEQ ID NO: 43653 - DNA, 20 bp, Human herpesvirus 2
aacccgttaaccagccgcgt

SEQ ID NO: 43654 - DNA, 20 bp, Human herpesvirus 2
gttgtgcgccgccaccaggg

SEQ ID NO: 43655 - DNA, 20 bp, Human herpesvirus 2
ttgtgcgccgccaccaggga

SEQ ID NO: 43656 - DNA, 20 bp, Human herpesvirus 2
tgcgccgccaccagggagtc

SEQ ID NO: 43657 - DNA, 20 bp, Human herpesvirus 2
agggccggcatgatgctggc

SEQ ID NO: 43658 - DNA, 20 bp, Human herpesvirus 2
gcatgcagggcctgcacacg

SEQ ID NO: 43659 - DNA, 20 bp, Human herpesvirus 2
aggcacgccgtgtgcaggcc

SEQ ID NO: 43660 - DNA, 20 bp, Human herpesvirus 2
gtgggggacgaggaggacgt

SEQ ID NO: 43661 - DNA, 20 bp, Human herpesvirus 2
gagacgtcctcctcgtcccc

SEQ ID NO: 43662 - DNA, 20 bp, Human herpesvirus 2
tggccgggaccgcggtagtg

SEQ ID NO: 43663 - DNA, 20 bp, Human herpesvirus 2
ccgcagccgacgatagcgca

SEQ ID NO: 43664 - DNA, 20 bp, Human herpesvirus 2
ttgcccgccgatccgtcagg

SEQ ID NO: 43665 - DNA, 20 bp, Human herpesvirus 2
tgcccgccgatccgtcaggt

SEQ ID NO: 43666 - DNA, 20 bp, Human herpesvirus 2
gcccgccgatccgtcaggtc

SEQ ID NO: 43667 - DNA, 20 bp, Human herpesvirus 2
cccgccgatccgtcaggtcg

SEQ ID NO: 43668 - DNA, 20 bp, Human herpesvirus 2
gcgggggcggagtcgttcaa

SEQ ID NO: 43669 - DNA, 20 bp, Human herpesvirus 2
aactgaacatggtcaacaaa

SEQ ID NO: 43670 - DNA, 20 bp, Human herpesvirus 2
gttgaccatgttcagttgaa

SEQ ID NO: 43671 - DNA, 20 bp, Human herpesvirus 2
ttgaccatgttcagttgaac

SEQ ID NO: 43672 - DNA, 20 bp, Human herpesvirus 2
accatgttcagttgaacgac

SEQ ID NO: 43673 - DNA, 20 bp, Human herpesvirus 2
cggctcccgtggaggttacg

SEQ ID NO: 43674 - DNA, 20 bp, Human herpesvirus 2
cggcgctgtatgcgaccgac

SEQ ID NO: 43675 - DNA, 20 bp, Human herpesvirus 2
tcacctcctcgctcgccctc

SEQ ID NO: 43676 - DNA, 20 bp, Human herpesvirus 2
gtgaggagggcgagcgagga

SEQ ID NO: 43677 - DNA, 20 bp, Human herpesvirus 2
tgaggagggcgagcgaggag

SEQ ID NO: 43678 - DNA, 20 bp, Human herpesvirus 2
tgcacggctccctgacgatg

SEQ ID NO: 43679 - DNA, 20 bp, Human herpesvirus 2
ttcgagaagaaggcgtcgcg

SEQ ID NO: 43680 - DNA, 20 bp, Human herpesvirus 2
tcgagaagaaggcgtcgcgc

SEQ ID NO: 43681 - DNA, 20 bp, Human herpesvirus 2
cgagaagaaggcgtcgcgca

SEQ ID NO: 43682 - DNA, 20 bp, Human herpesvirus 2
gagaagaaggcgtcgcgcaa

SEQ ID NO: 43683 - DNA, 20 bp, Human herpesvirus 2
cgcgacgccttcttctcgaa

SEQ ID NO: 43684 - DNA, 20 bp, Human herpesvirus 2
ctcgcgctgagcgtcgggac

SEQ ID NO: 43685 - DNA, 20 bp, Human herpesvirus 2
tcgcgctgagcgtcgggacc

SEQ ID NO: 43686 - DNA, 20 bp, Human herpesvirus 2
agtggcaaagcactgctgac

SEQ ID NO: 43687 - DNA, 20 bp, Human herpesvirus 2
gtggcaaagcactgctgaca

SEQ ID NO: 43688 - DNA, 20 bp, Human herpesvirus 2
ttggtcccgacgctcagcgc

SEQ ID NO: 43689 - DNA, 20 bp, Human herpesvirus 2
gtttctgtatctagcgttcg

SEQ ID NO: 43690 - DNA, 20 bp, Human herpesvirus 2
ctgtatctagcgttcgtcgc

SEQ ID NO: 43691 - DNA, 20 bp, Human herpesvirus 2
tgtatctagcgttcgtcgcc

SEQ ID NO: 43692 - DNA, 20 bp, Human herpesvirus 2
gtcgcccttcaccaacgacg

SEQ ID NO: 43693 - DNA, 20 bp, Human herpesvirus 2
accaacgacgatgcatgttc

SEQ ID NO: 43694 - DNA, 20 bp, Human herpesvirus 2
aacgccagaccctggtgcag

SEQ ID NO: 43695 - DNA, 20 bp, Human herpesvirus 2
gaggcggatccggtcacctt

SEQ ID NO: 43696 - DNA, 20 bp, Human herpesvirus 2
ttgtaccaccgcccggccgt

SEQ ID NO: 43697 - DNA, 20 bp, Human herpesvirus 2
taccaccgcccggccgttgg

SEQ ID NO: 43698 - DNA, 20 bp, Human herpesvirus 2
aacggatagctcgcagagga

SEQ ID NO: 43699 - DNA, 20 bp, Human herpesvirus 2
tggtcgtgtgcagggcgttt

SEQ ID NO: 43700 - DNA, 20 bp, Human herpesvirus 2
ggtcgtgtgcagggcgtttt

SEQ ID NO: 43701 - DNA, 20 bp, Human herpesvirus 2
gtcgtgtgcagggcgttttc

SEQ ID NO: 43702 - DNA, 20 bp, Human herpesvirus 2
tcggcctgccacgtggcatt

SEQ ID NO: 43703 - DNA, 20 bp, Human herpesvirus 2
cggcctgccacgtggcattc

SEQ ID NO: 43704 - DNA, 20 bp, Human herpesvirus 2
gcggctcagaagcctgcatg

SEQ ID NO: 43705 - DNA, 20 bp, Human herpesvirus 2
gactacgaccgaccacacga

SEQ ID NO: 43706 - DNA, 20 bp, Human herpesvirus 2
tgagccgcgaatccccacca

SEQ ID NO: 43707 - DNA, 20 bp, Human herpesvirus 2
catgccccgcaaaacgcgtc

SEQ ID NO: 43708 - DNA, 20 bp, Human herpesvirus 2
tgcggggcatgcaagtcgac

SEQ ID NO: 43709 - DNA, 20 bp, Human herpesvirus 2
gcggggcatgcaagtcgaca

SEQ ID NO: 43710 - DNA, 20 bp, Human herpesvirus 2
cggggcatgcaagtcgacac

SEQ ID NO: 43711 - DNA, 20 bp, Human herpesvirus 2
ccctagcggccccggccccc

SEQ ID NO: 43712 - DNA, 20 bp, Human herpesvirus 2
cgcaacggaatccaggtctt

SEQ ID NO: 43713 - DNA, 20 bp, Human herpesvirus 2
atgcacgggatgcagaaggg

SEQ ID NO: 43714 - DNA, 20 bp, Human herpesvirus 2
tccctgcctgcaccccttct

SEQ ID NO: 43715 - DNA, 20 bp, Human herpesvirus 2
ccctgcctgcaccccttctg

SEQ ID NO: 43716 - DNA, 20 bp, Human herpesvirus 2
cctgcctgcaccccttctgc

SEQ ID NO: 43717 - DNA, 20 bp, Human herpesvirus 2
gttgtgaggagccacgaggg

SEQ ID NO: 43718 - DNA, 20 bp, Human herpesvirus 2
ttgtgaggagccacgaggga

SEQ ID NO: 43719 - DNA, 20 bp, Human herpesvirus 2
tgaggagccacgagggaccg

SEQ ID NO: 43720 - DNA, 20 bp, Human herpesvirus 2
tgctccccagagcctgctgg

SEQ ID NO: 43721 - DNA, 20 bp, Human herpesvirus 2
gctccccagagcctgctggt

SEQ ID NO: 43722 - DNA, 20 bp, Human herpesvirus 2
ctccccagagcctgctggtg

SEQ ID NO: 43723 - DNA, 20 bp, Human herpesvirus 2
cgggccgcacgtttattcgg

SEQ ID NO: 43724 - DNA, 20 bp, Human herpesvirus 2
gcagacccctcgcttaagat

SEQ ID NO: 43725 - DNA, 20 bp, Human herpesvirus 2
agatggccgatcccaatcga

SEQ ID NO: 43726 - DNA, 20 bp, Human herpesvirus 2
cgcgggaagaaccttccggt

SEQ ID NO: 43727 - DNA, 20 bp, Human herpesvirus 2
gcgggaagaaccttccggtt

SEQ ID NO: 43728 - DNA, 20 bp, Human herpesvirus 2
cggttttggaccagctgacc

SEQ ID NO: 43729 - DNA, 20 bp, Human herpesvirus 2
gttttgggggtggcgctctc

SEQ ID NO: 43730 - DNA, 20 bp, Human herpesvirus 2
ttttgggggtggcgctctct

SEQ ID NO: 43731 - DNA, 20 bp, Human herpesvirus 2
tgggggtggcgctctctgcc

SEQ ID NO: 43732 - DNA, 20 bp, Human herpesvirus 2
gggggtggcgctctctgcca

SEQ ID NO: 43733 - DNA, 20 bp, Human herpesvirus 2
ggggtggcgctctctgccaa

SEQ ID NO: 43734 - DNA, 20 bp, Human herpesvirus 2
gatctagcacacccacgggt

SEQ ID NO: 43735 - DNA, 20 bp, Human herpesvirus 2
atacgatctcgtcgaccggg

SEQ ID NO: 43736 - DNA, 20 bp, Human papillomavirus type 41
gttctcagtgtactagagtg

SEQ ID NO: 43737 - DNA, 20 bp, Human papillomavirus type 41
ttctcagtgtactagagtgc

SEQ ID NO: 43738 - DNA, 20 bp, Human papillomavirus type 41
tcagtgtactagagtgcttg

SEQ ID NO: 43739 - DNA, 20 bp, Human papillomavirus type 41
caaggctggagttcactgca

SEQ ID NO: 43740 - DNA, 20 bp, Human papillomavirus type 41
actgcacggcacgaagtgtc

SEQ ID NO: 43741 - DNA, 20 bp, Human papillomavirus type 41
tgttcgatgtatggtaggac

SEQ ID NO: 43742 - DNA, 20 bp, Human papillomavirus type 41
gatgtatggtaggactgtat

SEQ ID NO: 43743 - DNA, 20 bp, Human papillomavirus type 41
gctgtgagactaatatactg

SEQ ID NO: 43744 - DNA, 20 bp, Human papillomavirus type 41
gctgtattgtattgctgtaa

SEQ ID NO: 43745 - DNA, 20 bp, Human papillomavirus type 41
ctgtattgtattgctgtaat

SEQ ID NO: 43746 - DNA, 20 bp, Human papillomavirus type 41
gtatgcgtagcaagcaacac

SEQ ID NO: 43747 - DNA, 20 bp, Human papillomavirus type 41
tatgcgtagcaagcaacact

SEQ ID NO: 43748 - DNA, 20 bp, Human papillomavirus type 41
acctcgcttgtcacgcctgt

SEQ ID NO: 43749 - DNA, 20 bp, Human papillomavirus type 41
accaggagtgcctgtagatt

SEQ ID NO: 43750 - DNA, 20 bp, Human papillomavirus type 41
cgtatcccagtgttgcttgc

SEQ ID NO: 43751 - DNA, 20 bp, Human papillomavirus type 41
ggttgtggccgcctactatt

SEQ ID NO: 43752 - DNA, 20 bp, Human papillomavirus type 41
tggccgcctactatttagct

SEQ ID NO: 43753 - DNA, 20 bp, Human papillomavirus type 41
agcttttgatagtgagataa

SEQ ID NO: 43754 - DNA, 20 bp, Human papillomavirus type 41
gcttttgatagtgagataag

SEQ ID NO: 43755 - DNA, 20 bp, Human papillomavirus type 41
tgatagtgagataagtgcta

SEQ ID NO: 43756 - DNA, 20 bp, Human papillomavirus type 41
atgggtacagggggtataaa

SEQ ID NO: 43757 - DNA, 20 bp, Human papillomavirus type 41
tgggtacagggggtataaaa

SEQ ID NO: 43758 - DNA, 20 bp, Human papillomavirus type 41
taaaccagtgcgtggtgtct

SEQ ID NO: 43759 - DNA, 20 bp, Human papillomavirus type 41
gaattatcacgtatggtaca

SEQ ID NO: 43760 - DNA, 20 bp, Human papillomavirus type 41
aattatcacgtatggtacag

SEQ ID NO: 43761 - DNA, 20 bp, Human papillomavirus type 41
cacagtatgtgaataagcgg

SEQ ID NO: 43762 - DNA, 20 bp, Human papillomavirus type 41
acagtatgtgaataagcggt

SEQ ID NO: 43763 - DNA, 20 bp, Human papillomavirus type 41
cccgccagctgttttcatca

SEQ ID NO: 43764 - DNA, 20 bp, Human papillomavirus type 41
tcatcagcttccccatggtc

SEQ ID NO: 43765 - DNA, 20 bp, Human papillomavirus type 41
catcagcttccccatggtcc

SEQ ID NO: 43766 - DNA, 20 bp, Human papillomavirus type 41
gtcagcaatgggtcacattt

SEQ ID NO: 43767 - DNA, 20 bp, Human papillomavirus type 41
tcagcaatgggtcacatttt

SEQ ID NO: 43768 - DNA, 20 bp, Human papillomavirus type 41
ttggttatcaccattacgtg

SEQ ID NO: 43769 - DNA, 20 bp, Human papillomavirus type 41
tggttatcaccattacgtgg

SEQ ID NO: 43770 - DNA, 20 bp, Human papillomavirus type 41
ggttatcaccattacgtggg

SEQ ID NO: 43771 - DNA, 20 bp, Human papillomavirus type 41
gacaatgatcccgaaaacct

SEQ ID NO: 43772 - DNA, 20 bp, Human papillomavirus type 41
acaatgatcccgaaaacctt

SEQ ID NO: 43773 - DNA, 20 bp, Human papillomavirus type 41
cagaagttgtattgtggaaa

SEQ ID NO: 43774 - DNA, 20 bp, Human papillomavirus type 41
tattgtggaaatgggtttat

SEQ ID NO: 43775 - DNA, 20 bp, Human papillomavirus type 41
tggaaatgggtttattatat

SEQ ID NO: 43776 - DNA, 20 bp, Human papillomavirus type 41
ccgacagctcctccacgagg

SEQ ID NO: 43777 - DNA, 20 bp, Human papillomavirus type 41
cctcgtttctgcgtcgtctc

SEQ ID NO: 43778 - DNA, 20 bp, Human papillomavirus type 41
ctcgtttctgcgtcgtctcg

SEQ ID NO: 43779 - DNA, 20 bp, Human papillomavirus type 41
ctgcgtcgtctcgacccctg

SEQ ID NO: 43780 - DNA, 20 bp, Human papillomavirus type 41
tgcgtcgtctcgacccctgc

SEQ ID NO: 43781 - DNA, 20 bp, Human papillomavirus type 41
cgcgcacacgcagaaaagct

SEQ ID NO: 43782 - DNA, 20 bp, Human papillomavirus type 41
gcgcacacgcagaaaagctg

SEQ ID NO: 43783 - DNA, 20 bp, Human papillomavirus type 41
aacaatgcttgctaggcaaa

SEQ ID NO: 43784 - DNA, 20 bp, Human papillomavirus type 41
ctaggcaaagggttaaacgc

SEQ ID NO: 43785 - DNA, 20 bp, Human papillomavirus type 41
aacgcgctaatcctgaacaa

SEQ ID NO: 43786 - DNA, 20 bp, Human papillomavirus type 41
gggctggggcagttggggga

SEQ ID NO: 43787 - DNA, 20 bp, Human papillomavirus type 41
ggggacgcccgtccatatcc

SEQ ID NO: 43788 - DNA, 20 bp, Human papillomavirus type 41
gtccccgggatattttgcca

SEQ ID NO: 43789 - DNA, 20 bp, Human papillomavirus type 41
tgccaattgaatcagggggg

SEQ ID NO: 43790 - DNA, 20 bp, Human papillomavirus type 41
gccaattgaatcaggggggc

SEQ ID NO: 43791 - DNA, 20 bp, Human papillomavirus type 41
gctagatatatcccgggggg

SEQ ID NO: 43792 - DNA, 20 bp, Human papillomavirus type 41
ctagatatatcccgggggga

SEQ ID NO: 43793 - DNA, 20 bp, Human papillomavirus type 41
acacaacaatacttgcccct

SEQ ID NO: 43794 - DNA, 20 bp, Human papillomavirus type 41
cccctggcgaggaggagact

SEQ ID NO: 43795 - DNA, 20 bp, Human papillomavirus type 41
gtgaccagcactcctgaacg

SEQ ID NO: 43796 - DNA, 20 bp, Human papillomavirus type 41
ttaccagaggcgcactactg

SEQ ID NO: 43797 - DNA, 20 bp, Human papillomavirus type 41
ccagaggcgcactactggcc

SEQ ID NO: 43798 - DNA, 20 bp, Human papillomavirus type 41
gtgttagtcgcctggggcaa

SEQ ID NO: 43799 - DNA, 20 bp, Human papillomavirus type 41
gtcgcctggggcaacgtcgg

SEQ ID NO: 43800 - DNA, 20 bp, Human papillomavirus type 41
ccccaggcgactaacacgaa

SEQ ID NO: 43801 - DNA, 20 bp, Human papillomavirus type 41
tgagaggagaccctacgcct

SEQ ID NO: 43802 - DNA, 20 bp, Human papillomavirus type 41
tattgagcaagacataggac

SEQ ID NO: 43803 - DNA, 20 bp, Human papillomavirus type 41
agcaagacataggactaacc

SEQ ID NO: 43804 - DNA, 20 bp, Human papillomavirus type 41
gggggacaacattgaaaatg

SEQ ID NO: 43805 - DNA, 20 bp, Human papillomavirus type 41
ggggacaacattgaaaatga

SEQ ID NO: 43806 - DNA, 20 bp, Human papillomavirus type 41
cctccatgctgccactgacc

SEQ ID NO: 43807 - DNA, 20 bp, Human papillomavirus type 41
ctccatgctgccactgaccg

SEQ ID NO: 43808 - DNA, 20 bp, Human papillomavirus type 41
gcttactgttggacatccat

SEQ ID NO: 43809 - DNA, 20 bp, Human papillomavirus type 41
cttactgttggacatccatt

SEQ ID NO: 43810 - DNA, 20 bp, Human papillomavirus type 41
ctgttggacatccattttac

SEQ ID NO: 43811 - DNA, 20 bp, Human papillomavirus type 41
ggtattggtgtaacagggaa

SEQ ID NO: 43812 - DNA, 20 bp, Human papillomavirus type 41
gtgtaacagggaaccctttt

SEQ ID NO: 43813 - DNA, 20 bp, Human papillomavirus type 41
ttttaataagtttgatgatg

SEQ ID NO: 43814 - DNA, 20 bp, Human papillomavirus type 41
tttaataagtttgatgatgc

SEQ ID NO: 43815 - DNA, 20 bp, Human papillomavirus type 41
ttaataagtttgatgatgct

SEQ ID NO: 43816 - DNA, 20 bp, Human papillomavirus type 41
agtcctcatacattgaggat

SEQ ID NO: 43817 - DNA, 20 bp, Human papillomavirus type 41
aggatgcagacatgagtgac

SEQ ID NO: 43818 - DNA, 20 bp, Human papillomavirus type 41
aatttttctacactgcagag

SEQ ID NO: 43819 - DNA, 20 bp, Human papillomavirus type 41
ttctacactgcagagaaaca

SEQ ID NO: 43820 - DNA, 20 bp, Human papillomavirus type 41
tctacactgcagagaaacaa

SEQ ID NO: 43821 - DNA, 20 bp, Human papillomavirus type 41
ctgagggggatgcttcttca

SEQ ID NO: 43822 - DNA, 20 bp, Human papillomavirus type 41
ttcatataacaattctaagt

SEQ ID NO: 43823 - DNA, 20 bp, Human papillomavirus type 41
atataacaattctaagtttt

SEQ ID NO: 43824 - DNA, 20 bp, Human papillomavirus type 41
taagttttttgagtttttaa

SEQ ID NO: 43825 - DNA, 20 bp, Human papillomavirus type 41
tttgagtttttaaggcacac

SEQ ID NO: 43826 - DNA, 20 bp, Human papillomavirus type 41
agttttgggaggttgatcta

SEQ ID NO: 43827 - DNA, 20 bp, Human papillomavirus type 41
tgggaggttgatctacggga

SEQ ID NO: 43828 - DNA, 20 bp, Human papillomavirus type 41
gggaggttgatctacgggat

SEQ ID NO: 43829 - DNA, 20 bp, Human papillomavirus type 41
ggaggttgatctacgggatc

SEQ ID NO: 43830 - DNA, 20 bp, Human papillomavirus type 41
atctacgggatcgtatgaca

SEQ ID NO: 43831 - DNA, 20 bp, Human papillomavirus type 41
ccaatagccccatctggcgg

SEQ ID NO: 43832 - DNA, 20 bp, Human papillomavirus type 41
aactgaaacggtgtgtactg

SEQ ID NO: 43833 - DNA, 20 bp, Human papillomavirus type 41
ttgttattggaacgcctccg

SEQ ID NO: 43834 - DNA, 20 bp, Human papillomavirus type 41
tgttattggaacgcctccgg

SEQ ID NO: 43835 - DNA, 20 bp, Human papillomavirus type 41
gttattggaacgcctccggt

SEQ ID NO: 43836 - DNA, 20 bp, Human papillomavirus type 167
agagtcactgtcatccgatt

SEQ ID NO: 43837 - DNA, 20 bp, Human papillomavirus type 167
tgaaggagaggaggagcaat

SEQ ID NO: 43838 - DNA, 20 bp, Human papillomavirus type 167
gaaccttatagaatagaatg

SEQ ID NO: 43839 - DNA, 20 bp, Human papillomavirus type 167
tagaatagaatgcacctgtt

SEQ ID NO: 43840 - DNA, 20 bp, Human papillomavirus type 167
taattgtggtataagaatta

SEQ ID NO: 43841 - DNA, 20 bp, Human papillomavirus type 167
tgtagcagatctgagtccaa

SEQ ID NO: 43842 - DNA, 20 bp, Human papillomavirus type 167
acatatcacctcgaaaaaac

SEQ ID NO: 43843 - DNA, 20 bp, Human papillomavirus type 167
tttcgggacagtggaataga

SEQ ID NO: 43844 - DNA, 20 bp, Human papillomavirus type 167
cactgtcccgaaataagcgt

SEQ ID NO: 43845 - DNA, 20 bp, Human papillomavirus type 167
tgatgttttttcgaggtgat

SEQ ID NO: 43846 - DNA, 20 bp, Human papillomavirus type 167
cgatgcactgcaagaagctc

SEQ ID NO: 43847 - DNA, 20 bp, Human papillomavirus type 167
gatgcactgcaagaagctct

SEQ ID NO: 43848 - DNA, 20 bp, Human papillomavirus type 167
gctttctcaaattgaacatt

SEQ ID NO: 43849 - DNA, 20 bp, Human papillomavirus type 167
ctttctcaaattgaacattg

SEQ ID NO: 43850 - DNA, 20 bp, Human papillomavirus type 167
ctcaaattgaacattggaat

SEQ ID NO: 43851 - DNA, 20 bp, Human papillomavirus type 167
aaaataaaatagaaggtgaa

SEQ ID NO: 43852 - DNA, 20 bp, Human papillomavirus type 167
ctgatcgtttgttaaaatgg

SEQ ID NO: 43853 - DNA, 20 bp, Human papillomavirus type 167
gttaaaatggttcggaagtt

SEQ ID NO: 43854 - DNA, 20 bp, Human papillomavirus type 167
ttaaaatggttcggaagttt

SEQ ID NO: 43855 - DNA, 20 bp, Human papillomavirus type 167
aaatggttcggaagttttat

SEQ ID NO: 43856 - DNA, 20 bp, Human papillomavirus type 167
ttaggtcaagtttcccgcgc

SEQ ID NO: 43857 - DNA, 20 bp, Human papillomavirus type 167
taggtcaagtttcccgcgca

SEQ ID NO: 43858 - DNA, 20 bp, Human papillomavirus type 167
aggtcaagtttcccgcgcag

SEQ ID NO: 43859 - DNA, 20 bp, Human papillomavirus type 167
ggtcaagtttcccgcgcagt

SEQ ID NO: 43860 - DNA, 20 bp, Human papillomavirus type 167
cccgcgcagttcaatttgaa

SEQ ID NO: 43861 - DNA, 20 bp, Human papillomavirus type 167
ttttatggatttatcagcaa

SEQ ID NO: 43862 - DNA, 20 bp, Human papillomavirus type 167
tttatggatttatcagcaat

SEQ ID NO: 43863 - DNA, 20 bp, Human papillomavirus type 167
ttatggatttatcagcaatt

SEQ ID NO: 43864 - DNA, 20 bp, Human papillomavirus type 167
tatggatttatcagcaattc

SEQ ID NO: 43865 - DNA, 20 bp, Human papillomavirus type 167
atggatttatcagcaattcc

SEQ ID NO: 43866 - DNA, 20 bp, Human papillomavirus type 167
agtacggatgaatatgtgaa

SEQ ID NO: 43867 - DNA, 20 bp, Human papillomavirus type 167
tttcatactggaactgacag

SEQ ID NO: 43868 - DNA, 20 bp, Human papillomavirus type 167
ttcatactggaactgacaga

SEQ ID NO: 43869 - DNA, 20 bp, Human papillomavirus type 167
tcatactggaactgacagat

SEQ ID NO: 43870 - DNA, 20 bp, Human papillomavirus type 167
catactggaactgacagatt

SEQ ID NO: 43871 - DNA, 20 bp, Human papillomavirus type 167
aaggcagtacaaatggatag

SEQ ID NO: 43872 - DNA, 20 bp, Human papillomavirus type 167
gagttggtgtttctgggcac

SEQ ID NO: 43873 - DNA, 20 bp, Human papillomavirus type 167
gtgtttctgggcacccatta

SEQ ID NO: 43874 - DNA, 20 bp, Human papillomavirus type 167
ctgggcacccattatttaat

SEQ ID NO: 43875 - DNA, 20 bp, Human papillomavirus type 167
tgggcacccattatttaata

SEQ ID NO: 43876 - DNA, 20 bp, Human papillomavirus type 187
atacttgacactcaacagct

SEQ ID NO: 43877 - DNA, 20 bp, Human papillomavirus type 187
tacttgacactcaacagctt

SEQ ID NO: 43878 - DNA, 20 bp, Human papillomavirus type 187
acactcaacagcttgctgat

SEQ ID NO: 43879 - DNA, 20 bp, Human papillomavirus type 187
ctgatttttacagaaagggt

SEQ ID NO: 43880 - DNA, 20 bp, Human papillomavirus type 187
ttacagaaagggtcttagcc

SEQ ID NO: 43881 - DNA, 20 bp, Human papillomavirus type 187
aaaagtatgacactgtttgc

SEQ ID NO: 43882 - DNA, 20 bp, Human papillomavirus type 187
gcagaaacgagcacttctat

SEQ ID NO: 43883 - DNA, 20 bp, Human papillomavirus type 187
cagaaacgagcacttctatt

SEQ ID NO: 43884 - DNA, 20 bp, Human papillomavirus type 187
tatttagtgcgcaacggctg

SEQ ID NO: 43885 - DNA, 20 bp, Human papillomavirus type 187
agtgcgcaacggctggaaag

SEQ ID NO: 43886 - DNA, 20 bp, Human papillomavirus type 187
taaagcaggtgtaagattat

SEQ ID NO: 43887 - DNA, 20 bp, Human papillomavirus type 187
tcaattgtagctacagctac

SEQ ID NO: 43888 - DNA, 20 bp, Human papillomavirus type 187
tagctacagctactgctgtt

SEQ ID NO: 43889 - DNA, 20 bp, Human papillomavirus type 187
gtactcttcaagtgttgctg

SEQ ID NO: 43890 - DNA, 20 bp, Human papillomavirus type 187
aagtgttgctgtttgcagaa

SEQ ID NO: 43891 - DNA, 20 bp, Human papillomavirus type 187
gaagacagtacagacggttc

SEQ ID NO: 43892 - DNA, 20 bp, Human papillomavirus type 187
aagacagtacagacggttca

SEQ ID NO: 43893 - DNA, 20 bp, Human papillomavirus type 187
atgtatctctcagctgattg

SEQ ID NO: 43894 - DNA, 20 bp, Human papillomavirus type 187
atgatgccgatgaactggac

SEQ ID NO: 43895 - DNA, 20 bp, Human papillomavirus type 187
aacagtgccagggaatttcc

SEQ ID NO: 43896 - DNA, 20 bp, Human papillomavirus type 187
tcaggtagtcgctatagaaa

SEQ ID NO: 43897 - DNA, 20 bp, Human papillomavirus type 187
tatcggcgccattaggcttt

SEQ ID NO: 43898 - DNA, 20 bp, Human papillomavirus type 187
ggcttttccaccacagatgt

SEQ ID NO: 43899 - DNA, 20 bp, Human papillomavirus type 187
tccaccacagatgtttctat

SEQ ID NO: 43900 - DNA, 20 bp, Human papillomavirus type 187
ccaccacagatgtttctata

SEQ ID NO: 43901 - DNA, 20 bp, Human papillomavirus type 187
gctaacctaatactgttaga

SEQ ID NO: 43902 - DNA, 20 bp, Human papillomavirus type 187
gatcatcgaacagcttcagc

SEQ ID NO: 43903 - DNA, 20 bp, Human papillomavirus type 187
agcagataattttgatttat

SEQ ID NO: 43904 - DNA, 20 bp, Human papillomavirus type 187
tgatttatcaaaaatgatac

SEQ ID NO: 43905 - DNA, 20 bp, Human papillomavirus type 187
gatttatcaaaaatgataca

SEQ ID NO: 43906 - DNA, 20 bp, Human papillomavirus type 187
gacatttgaaataaccaatg

SEQ ID NO: 43907 - DNA, 20 bp, Human papillomavirus type 187
acatttgaaataaccaatga

SEQ ID NO: 43908 - DNA, 20 bp, Human papillomavirus type 187
gaaataaccaatgatacttg

SEQ ID NO: 43909 - DNA, 20 bp, Human papillomavirus type 187
aaataaccaatgatacttgg

SEQ ID NO: 43910 - DNA, 20 bp, Human papillomavirus type 187
ggcatgtttttttagaaaat

SEQ ID NO: 43911 - DNA, 20 bp, Human papillomavirus type 187
ctggaggttgtagaggagtc

SEQ ID NO: 43912 - DNA, 20 bp, Human papillomavirus type 187
tagaggagtcgtcccgtttc

SEQ ID NO: 43913 - DNA, 20 bp, Human papillomavirus type 187
acaagttggagcacgacatc

SEQ ID NO: 43914 - DNA, 20 bp, Human papillomavirus type 187
gagcacgacatcgatcaact

SEQ ID NO: 43915 - DNA, 20 bp, Human papillomavirus type 187
cgcgacttcaacgacttcaa

SEQ ID NO: 43916 - DNA, 20 bp, Human papillomavirus type 187
aacgacttcaagctgaggct

SEQ ID NO: 43917 - DNA, 20 bp, Human papillomavirus type 187
aagctgaggcttgggatccc

SEQ ID NO: 43918 - DNA, 20 bp, Human papillomavirus type 187
ttctttaggctccttcgata

SEQ ID NO: 43919 - DNA, 20 bp, Human papillomavirus type 187
tctttaggctccttcgatag

SEQ ID NO: 43920 - DNA, 20 bp, Human papillomavirus type 187
ctttaggctccttcgatagt

SEQ ID NO: 43921 - DNA, 20 bp, Human papillomavirus type 187
tttaggctccttcgatagtt

SEQ ID NO: 43922 - DNA, 20 bp, Human papillomavirus type 187
aggctccttcgatagtttat

SEQ ID NO: 43923 - DNA, 20 bp, Human papillomavirus type 187
ccactggtattcgtccatta

SEQ ID NO: 43924 - DNA, 20 bp, Human papillomavirus type 187
gtccattacctgaaaatata

SEQ ID NO: 43925 - DNA, 20 bp, Human papillomavirus type 187
cctgaaaatatacctttacc

SEQ ID NO: 43926 - DNA, 20 bp, Human papillomavirus type 187
accggagactgtaccagaac

SEQ ID NO: 43927 - DNA, 20 bp, Human papillomavirus type 187
ccggagactgtaccagaacc

SEQ ID NO: 43928 - DNA, 20 bp, Human papillomavirus type 187
tggatgttaatgctggtaca

SEQ ID NO: 43929 - DNA, 20 bp, Human papillomavirus type 187
atgctggtacaggggaggga

SEQ ID NO: 43930 - DNA, 20 bp, Human papillomavirus type 187
ggtatgaaatatatacagat

SEQ ID NO: 43931 - DNA, 20 bp, Human papillomavirus type 187
tctgtttcaccactggttac

SEQ ID NO: 43932 - DNA, 20 bp, Human papillomavirus type 187
ctgtttcaccactggttact

SEQ ID NO: 43933 - DNA, 20 bp, Human papillomavirus type 187
caacccttgaataggatcag

SEQ ID NO: 43934 - DNA, 20 bp, Human papillomavirus type 187
aataggatcagtgatataga

SEQ ID NO: 43935 - DNA, 20 bp, Human papillomavirus type 187
gattctttgcaaagaactag

SEQ ID NO: 43936 - DNA, 20 bp, Human papillomavirus type 187
tttgcaaagaactagcacac

SEQ ID NO: 43937 - DNA, 20 bp, Human papillomavirus type 187
gcaaagaactagcacaccat

SEQ ID NO: 43938 - DNA, 20 bp, Human papillomavirus type 187
caggatgatataagtctaga

SEQ ID NO: 43939 - DNA, 20 bp, Human papillomavirus type 187
aggatgatataagtctagag

SEQ ID NO: 43940 - DNA, 20 bp, Human papillomavirus type 187
gagcgggatcttagagagtt

SEQ ID NO: 43941 - DNA, 20 bp, Human papillomavirus type 187
agcgggatcttagagagttg

SEQ ID NO: 43942 - DNA, 20 bp, Human papillomavirus type 187
gagagttggcagctgctcca

SEQ ID NO: 43943 - DNA, 20 bp, Human papillomavirus type 187
cgttggaaacattgggagaa

SEQ ID NO: 43944 - DNA, 20 bp, Human papillomavirus type 187
gaaacattgggagaatctcc

SEQ ID NO: 43945 - DNA, 20 bp, Human papillomavirus type 187
ggagaatctccagatcaatt

SEQ ID NO: 43946 - DNA, 20 bp, Human papillomavirus type 187
actatagtagatggattagg

SEQ ID NO: 43947 - DNA, 20 bp, Human papillomavirus type 187
gggggaggtacattaattga

SEQ ID NO: 43948 - DNA, 20 bp, Human papillomavirus type 187
gaaggggaggacctttggga

SEQ ID NO: 43949 - DNA, 20 bp, Human papillomavirus type 187
gggattgggaacatcgggtc

SEQ ID NO: 43950 - DNA, 20 bp, Human papillomavirus type 187
ggattgggaacatcgggtca

SEQ ID NO: 43951 - DNA, 20 bp, Human papillomavirus type 187
ggaacatcgggtcatccttt

SEQ ID NO: 43952 - DNA, 20 bp, Human papillomavirus type 187
atttaacaaattaggtgaca

SEQ ID NO: 43953 - DNA, 20 bp, Human papillomavirus type 187
aattcagtaatacaggatgg

SEQ ID NO: 43954 - DNA, 20 bp, Human papillomavirus type 187
agtaatacaggatggggata

SEQ ID NO: 43955 - DNA, 20 bp, Human papillomavirus type 187
gctttggggctgcaaacttc

SEQ ID NO: 43956 - DNA, 20 bp, Human papillomavirus type 187
ggggctgcaaacttcaaaac

SEQ ID NO: 43957 - DNA, 20 bp, Human papillomavirus type 187
gggctgcaaacttcaaaacg

SEQ ID NO: 43958 - DNA, 20 bp, Human papillomavirus type 187
tcctttacttgattaatgta

SEQ ID NO: 43959 - DNA, 20 bp, Human papillomavirus type 187
cctttacttgattaatgtac

SEQ ID NO: 43960 - DNA, 20 bp, Human papillomavirus type 187
ctttacttgattaatgtact

SEQ ID NO: 43961 - DNA, 20 bp, Human papillomavirus type 187
acttgattaatgtactgtga

SEQ ID NO: 43962 - DNA, 20 bp, Human papillomavirus type 187
cttgattaatgtactgtgaa

SEQ ID NO: 43963 - DNA, 20 bp, Human papillomavirus type 187
gtaaaggtaagtgcaagttc

SEQ ID NO: 43964 - DNA, 20 bp, Human papillomavirus type 187
taaaggtaagtgcaagttca

SEQ ID NO: 43965 - DNA, 20 bp, Human papillomavirus type 187
agacgaatatagactgactc

SEQ ID NO: 43966 - DNA, 20 bp, Human papillomavirus type 187
ggtcgctgccagatttgagt

SEQ ID NO: 43967 - DNA, 20 bp, Human papillomavirus type 187
gagtcagtctatattcgtct

SEQ ID NO: 43968 - DNA, 20 bp, Influenza C virus
aagaaatggactacatcaag

SEQ ID NO: 43969 - DNA, 20 bp, Influenza C virus
ttagtgaaggattcttttcc

SEQ ID NO: 43970 - DNA, 20 bp, Influenza C virus
gtgaaggattcttttccttc

SEQ ID NO: 43971 - DNA, 20 bp, Influenza C virus
ttttccttccttgatgtagt

SEQ ID NO: 43972 - DNA, 20 bp, Influenza C virus
tccttccttgatgtagtcca

SEQ ID NO: 43973 - DNA, 20 bp, Influenza C virus
ctggttccggagtaaaagtt

SEQ ID NO: 43974 - DNA, 20 bp, Influenza C virus
tggttccggagtaaaagtta

SEQ ID NO: 43975 - DNA, 20 bp, Influenza C virus
cggagtaaaagttaaagata

SEQ ID NO: 43976 - DNA, 20 bp, Influenza C virus
aagatacagtatatatccaa

SEQ ID NO: 43977 - DNA, 20 bp, Influenza C virus
gaatactggagtgagcaaga

SEQ ID NO: 43978 - DNA, 20 bp, Influenza C virus
gattcatcaggaagaattgt

SEQ ID NO: 43979 - DNA, 20 bp, Influenza C virus
attcatcaggaagaattgtt

SEQ ID NO: 43980 - DNA, 20 bp, Influenza C virus
atcaggaagaattgttgcaa

SEQ ID NO: 43981 - DNA, 20 bp, Influenza C virus
ttgcaacaattttagacctt

SEQ ID NO: 43982 - DNA, 20 bp, Influenza C virus
caacaattttagaccttcct

SEQ ID NO: 43983 - DNA, 20 bp, Influenza C virus
agttgttggagatgaacaca

SEQ ID NO: 43984 - DNA, 20 bp, Influenza C virus
gttgttggagatgaacacat

SEQ ID NO: 43985 - DNA, 20 bp, Influenza C virus
ttggagatgaacacatggac

SEQ ID NO: 43986 - DNA, 20 bp, Influenza C virus
gagatgaacacatggacact

SEQ ID NO: 43987 - DNA, 20 bp, Influenza C virus
gttagcactattagaagggt

SEQ ID NO: 43988 - DNA, 20 bp, Human papillomavirus type 88
taccgctgctctgtaaaggg

SEQ ID NO: 43989 - DNA, 20 bp, Human papillomavirus type 88
accgctgctctgtaaaggga

SEQ ID NO: 43990 - DNA, 20 bp, Human papillomavirus type 88
ccgctgctctgtaaagggaa

SEQ ID NO: 43991 - DNA, 20 bp, Human papillomavirus type 88
attttgaggatttcctaaga

SEQ ID NO: 43992 - DNA, 20 bp, Human papillomavirus type 88
tgaggatttcctaagaaaga

SEQ ID NO: 43993 - DNA, 20 bp, Human papillomavirus type 88
cctgctaaccttttaagcaa

SEQ ID NO: 43994 - DNA, 20 bp, Human papillomavirus type 88
taagcaacgaggttttgtca

SEQ ID NO: 43995 - DNA, 20 bp, Human papillomavirus type 88
aagcaacgaggttttgtcat

SEQ ID NO: 43996 - DNA, 20 bp, Human papillomavirus type 88
agcaacgaggttttgtcatc

SEQ ID NO: 43997 - DNA, 20 bp, Human papillomavirus type 88
tgtcatctgatgaggagacc

SEQ ID NO: 43998 - DNA, 20 bp, Human papillomavirus type 88
atcaaaagtccgcagctgca

SEQ ID NO: 43999 - DNA, 20 bp, Human papillomavirus type 88
ctgagttgagtccaaggctt

SEQ ID NO: 44000 - DNA, 20 bp, Human papillomavirus type 88
agtccaaggcttcaagcagt

SEQ ID NO: 44001 - DNA, 20 bp, Human papillomavirus type 88
aagcagtttcaatttcaccc

SEQ ID NO: 44002 - DNA, 20 bp, Human papillomavirus type 88
caatttcacccaaaaaacaa

SEQ ID NO: 44003 - DNA, 20 bp, Human papillomavirus type 88
tctggtgtttgttgggcccc

SEQ ID NO: 44004 - DNA, 20 bp, Human papillomavirus type 88
gttgggccccctgacactgg

SEQ ID NO: 44005 - DNA, 20 bp, Human papillomavirus type 88
ttgggccccctgacactggg

SEQ ID NO: 44006 - DNA, 20 bp, Human papillomavirus type 88
ggccccctgacactgggaaa

SEQ ID NO: 44007 - DNA, 20 bp, Human papillomavirus type 88
ctgcttctcattaatacgtt

SEQ ID NO: 44008 - DNA, 20 bp, Human papillomavirus type 88
cgttgcactgcaagatgcca

SEQ ID NO: 44009 - DNA, 20 bp, Human papillomavirus type 88
gttgcactgcaagatgccat

SEQ ID NO: 44010 - DNA, 20 bp, Human papillomavirus type 88
cactgcaagatgccatattg

SEQ ID NO: 44011 - DNA, 20 bp, Human papillomavirus type 88
aatctaattgaaaggggaga

SEQ ID NO: 44012 - DNA, 20 bp, Human papillomavirus type 88
aaaggggagaaactgattta

SEQ ID NO: 44013 - DNA, 20 bp, Human papillomavirus type 88
tccgagagtgtttccgtcgg

SEQ ID NO: 44014 - DNA, 20 bp, Human papillomavirus type 88
ccgtcggtggctgttcttct

SEQ ID NO: 44015 - DNA, 20 bp, Human papillomavirus type 88
cgtcggtggctgttcttctt

SEQ ID NO: 44016 - DNA, 20 bp, Human papillomavirus type 88
ttcttctctttgctccggag

SEQ ID NO: 44017 - DNA, 20 bp, Human papillomavirus type 88
ttctctttgctccggaggtt

SEQ ID NO: 44018 - DNA, 20 bp, Human papillomavirus type 88
gcagatcgattgctgcgcat

SEQ ID NO: 44019 - DNA, 20 bp, Human papillomavirus type 88
ctgcgcatttttggtagtgt

SEQ ID NO: 44020 - DNA, 20 bp, Human papillomavirus type 88
ttggtagtgttatatacctg

SEQ ID NO: 44021 - DNA, 20 bp, Human papillomavirus type 88
tggtagtgttatatacctgg

SEQ ID NO: 44022 - DNA, 20 bp, Human papillomavirus type 88
ggtagtgttatatacctggg

SEQ ID NO: 44023 - DNA, 20 bp, Human papillomavirus type 88
tgcacttgccccaagtgtgc

SEQ ID NO: 44024 - DNA, 20 bp, Human papillomavirus type 88
gcacttgccccaagtgtgca

SEQ ID NO: 44025 - DNA, 20 bp, Human papillomavirus type 88
cacttgccccaagtgtgcat

SEQ ID NO: 44026 - DNA, 20 bp, Human papillomavirus type 88
ccccaagtgtgcatgcagaa

SEQ ID NO: 44027 - DNA, 20 bp, Human papillomavirus type 88
ctattatagagagctcacta

SEQ ID NO: 44028 - DNA, 20 bp, Human papillomavirus type 88
actttttaacccggccttca

SEQ ID NO: 44029 - DNA, 20 bp, Human papillomavirus type 88
ttaacccggccttcacgcgc

SEQ ID NO: 44030 - DNA, 20 bp, Human papillomavirus type 88
taacccggccttcacgcgcg

SEQ ID NO: 44031 - DNA, 20 bp, Human papillomavirus type 88
aacccggccttcacgcgcgg

SEQ ID NO: 44032 - DNA, 20 bp, Human papillomavirus type 88
acccggccttcacgcgcggt

SEQ ID NO: 44033 - DNA, 20 bp, Human papillomavirus type 88
gatcttagtgcaattgaacc

SEQ ID NO: 44034 - DNA, 20 bp, Human papillomavirus type 88
atcttagtgcaattgaacct

SEQ ID NO: 44035 - DNA, 20 bp, Human papillomavirus type 88
gtgcaattgaacctatagag

SEQ ID NO: 44036 - DNA, 20 bp, Human papillomavirus type 88
aacctatagagcctgatgtt

SEQ ID NO: 44037 - DNA, 20 bp, Human papillomavirus type 88
ttgagctttctaatttaggg

SEQ ID NO: 44038 - DNA, 20 bp, Human papillomavirus type 88
tggcaacaacaaactgggaa

SEQ ID NO: 44039 - DNA, 20 bp, Human papillomavirus type 88
cttccgccggctaaacctgt

SEQ ID NO: 44040 - DNA, 20 bp, Human papillomavirus type 88
cgccggctaaacctgtggca

SEQ ID NO: 44041 - DNA, 20 bp, Human papillomavirus type 88
tctacagatgattatgttat

SEQ ID NO: 44042 - DNA, 20 bp, Human papillomavirus type 88
tgttattggaactcagttac

SEQ ID NO: 44043 - DNA, 20 bp, Human papillomavirus type 88
cctgatccaaataaatttgc

SEQ ID NO: 44044 - DNA, 20 bp, Human papillomavirus type 88
gccttaatagatcagtcaat

SEQ ID NO: 44045 - DNA, 20 bp, Human papillomavirus type 88
ccttaatagatcagtcaatt

SEQ ID NO: 44046 - DNA, 20 bp, Human papillomavirus type 88
atagatcagtcaattttcaa

SEQ ID NO: 44047 - DNA, 20 bp, Human papillomavirus type 88
tcaatcctgaacgtgaacgt

SEQ ID NO: 44048 - DNA, 20 bp, Human papillomavirus type 88
gagatcaggcgaatgcagga

SEQ ID NO: 44049 - DNA, 20 bp, Human papillomavirus type 88
gttaatgctgttattcagga

SEQ ID NO: 44050 - DNA, 20 bp, Human papillomavirus type 88
atgctgttattcaggacgga

SEQ ID NO: 44051 - DNA, 20 bp, Human papillomavirus type 88
ttcaggacggaacaatgggt

SEQ ID NO: 44052 - DNA, 20 bp, Human papillomavirus type 88
aggacggaacaatgggtgac

SEQ ID NO: 44053 - DNA, 20 bp, Human papillomavirus type 88
cttttttggaaaacgtgagc

SEQ ID NO: 44054 - DNA, 20 bp, Human papillomavirus type 88
ttttttggaaaacgtgagca

SEQ ID NO: 44055 - DNA, 20 bp, Human papillomavirus type 88
tttggaaaacgtgagcagtc

SEQ ID NO: 44056 - DNA, 20 bp, Human papillomavirus type 88
ttggaaaacgtgagcagtcg

SEQ ID NO: 44057 - DNA, 20 bp, Human papillomavirus type 88
tggaaaacgtgagcagtcgt

SEQ ID NO: 44058 - DNA, 20 bp, Human papillomavirus type 88
tagatatataacatctttgg

SEQ ID NO: 44059 - DNA, 20 bp, Human papillomavirus type 88
ggcaacaagatgtcctactg

SEQ ID NO: 44060 - DNA, 20 bp, Human papillomavirus type 88
gcaacaagatgtcctactga

SEQ ID NO: 44061 - DNA, 20 bp, Human papillomavirus type 88
taatctttataagggtcagg

SEQ ID NO: 44062 - DNA, 20 bp, Human papillomavirus type 88
ataagggtcaggtatttctg

SEQ ID NO: 44063 - DNA, 20 bp, Human papillomavirus type 88
aaggtaagttgtttggaaca

SEQ ID NO: 44064 - DNA, 20 bp, Human papillomavirus type 88
tttggaacatagccgtctct

SEQ ID NO: 44065 - DNA, 20 bp, Human papillomavirus type 88
ggaacatagccgtctctcga

SEQ ID NO: 44066 - DNA, 20 bp, Human papillomavirus type 88
gaacatagccgtctctcgaa

SEQ ID NO: 44067 - DNA, 20 bp, Human papillomavirus type 88
ttaaaaggcctttagggcac

SEQ ID NO: 44068 - DNA, 20 bp, Human papillomavirus type 179
tgttgataaggggtaattgg

SEQ ID NO: 44069 - DNA, 20 bp, Human papillomavirus type 179
gttgataaggggtaattggc

SEQ ID NO: 44070 - DNA, 20 bp, Human papillomavirus type 179
ttgataaggggtaattggcg

SEQ ID NO: 44071 - DNA, 20 bp, Human papillomavirus type 179
ataaggggtaattggcgtac

SEQ ID NO: 44072 - DNA, 20 bp, Human papillomavirus type 179
gcgtacagagtgcagaaatt

SEQ ID NO: 44073 - DNA, 20 bp, Human papillomavirus type 179
tagagttgacacctcgtgtg

SEQ ID NO: 44074 - DNA, 20 bp, Human papillomavirus type 179
acacctcgtgtggcaattgt

SEQ ID NO: 44075 - DNA, 20 bp, Human papillomavirus type 179
taagagaggtgtaaggcttt

SEQ ID NO: 44076 - DNA, 20 bp, Human papillomavirus type 179
tttttgttgcaacttctgct

SEQ ID NO: 44077 - DNA, 20 bp, Human papillomavirus type 179
ttttgttgcaacttctgctt

SEQ ID NO: 44078 - DNA, 20 bp, Human papillomavirus type 179
tttgaagaaagcacaaacgg

SEQ ID NO: 44079 - DNA, 20 bp, Human papillomavirus type 179
gaagaaagcacaaacgggtc

SEQ ID NO: 44080 - DNA, 20 bp, Human papillomavirus type 179
aagaaagcacaaacgggtca

SEQ ID NO: 44081 - DNA, 20 bp, Human papillomavirus type 179
caaatttactagacgatgaa

SEQ ID NO: 44082 - DNA, 20 bp, Human papillomavirus type 179
aaatttactagacgatgaac

SEQ ID NO: 44083 - DNA, 20 bp, Human papillomavirus type 179
aaattctaatgaacttttgc

SEQ ID NO: 44084 - DNA, 20 bp, Human papillomavirus type 179
taatgaacttttgcaggtag

SEQ ID NO: 44085 - DNA, 20 bp, Human papillomavirus type 179
tgcaggtagaggcggagcat

SEQ ID NO: 44086 - DNA, 20 bp, Human papillomavirus type 179
gcaggtagaggcggagcatg

SEQ ID NO: 44087 - DNA, 20 bp, Human papillomavirus type 179
caggtagaggcggagcatgg

SEQ ID NO: 44088 - DNA, 20 bp, Human papillomavirus type 179
cgaaacaccatcttggaaga

SEQ ID NO: 44089 - DNA, 20 bp, Human papillomavirus type 179
gaagacttagaagacttcaa

SEQ ID NO: 44090 - DNA, 20 bp, Human papillomavirus type 179
gaagacttcaagaggaagct

SEQ ID NO: 44091 - DNA, 20 bp, Human papillomavirus type 179
aagaggaagctagggatcca

SEQ ID NO: 44092 - DNA, 20 bp, Human papillomavirus type 179
tgtgtataaaaggtccagca

SEQ ID NO: 44093 - DNA, 20 bp, Human papillomavirus type 179
ggtggttataaaccaattgg

SEQ ID NO: 44094 - DNA, 20 bp, Human papillomavirus type 179
gtggttataaaccaattggt

SEQ ID NO: 44095 - DNA, 20 bp, Human papillomavirus type 179
taaaccaattggtggaacag

SEQ ID NO: 44096 - DNA, 20 bp, Human papillomavirus type 179
gtggaacagcaagcaaaggt

SEQ ID NO: 44097 - DNA, 20 bp, Human papillomavirus type 179
ggtctgctcacagttatttc

SEQ ID NO: 44098 - DNA, 20 bp, Human papillomavirus type 179
aaatgaagttgctgaatttg

SEQ ID NO: 44099 - DNA, 20 bp, Human papillomavirus type 179
aatgaagttgctgaatttgc

SEQ ID NO: 44100 - DNA, 20 bp, Human papillomavirus type 179
ctgaatttgcaattgaggag

SEQ ID NO: 44101 - DNA, 20 bp, Human papillomavirus type 179
gcaattgaggagggggcggg

SEQ ID NO: 44102 - DNA, 20 bp, Human papillomavirus type 179
caattgaggagggggcgggt

SEQ ID NO: 44103 - DNA, 20 bp, Human papillomavirus type 179
cctattcacaattctgcaga

SEQ ID NO: 44104 - DNA, 20 bp, Human papillomavirus type 179
ctattcacaattctgcagat

SEQ ID NO: 44105 - DNA, 20 bp, Human papillomavirus type 179
acaattctgcagatccttct

SEQ ID NO: 44106 - DNA, 20 bp, Human papillomavirus type 179
tgcagatccttctaaagtag

SEQ ID NO: 44107 - DNA, 20 bp, Human papillomavirus type 179
taaagtagaagtaccaaaag

SEQ ID NO: 44108 - DNA, 20 bp, Human papillomavirus type 179
aatatccagcggcacaagca

SEQ ID NO: 44109 - DNA, 20 bp, Human papillomavirus type 179
gatatggccatggagcctaa

SEQ ID NO: 44110 - DNA, 20 bp, Human papillomavirus type 179
attattgtgggttgtgtacc

SEQ ID NO: 44111 - DNA, 20 bp, Human papillomavirus type 179
ttgtgggttgtgtacccaca

SEQ ID NO: 44112 - DNA, 20 bp, Human papillomavirus type 179
attttgcttaggctccatgg

SEQ ID NO: 44113 - DNA, 20 bp, Human papillomavirus type 179
ggatgttgatatgtcagaaa

SEQ ID NO: 44114 - DNA, 20 bp, Human papillomavirus type 179
atatgtcagaaaagttttcc

SEQ ID NO: 44115 - DNA, 20 bp, Human papillomavirus type 179
tcctcagatttaagtcagtc

SEQ ID NO: 44116 - DNA, 20 bp, Human papillomavirus type 179
cctcagatttaagtcagtct

SEQ ID NO: 44117 - DNA, 20 bp, Human papillomavirus type 179
ctcagatttaagtcagtctt

SEQ ID NO: 44118 - DNA, 20 bp, Human papillomavirus type 179
ccttaccgcacccaacaatt

SEQ ID NO: 44119 - DNA, 20 bp, Human papillomavirus type 179
cttaccgcacccaacaatta

SEQ ID NO: 44120 - DNA, 20 bp, Human papillomavirus type 179
ccgcacccaacaattatttg

SEQ ID NO: 44121 - DNA, 20 bp, Human papillomavirus type 179
tttggccagtattaataccc

SEQ ID NO: 44122 - DNA, 20 bp, Human papillomavirus type 179
ggccagtattaatacccaca

SEQ ID NO: 44123 - DNA, 20 bp, Influenza C virus
aatggcatttgtagccacaa

SEQ ID NO: 44124 - DNA, 20 bp, Influenza C virus
atggcatttgtagccacaaa

SEQ ID NO: 44125 - DNA, 20 bp, Influenza C virus
gtagccacaaaaatgttaga

SEQ ID NO: 44126 - DNA, 20 bp, Influenza C virus
tagccacaaaaatgttagag

SEQ ID NO: 44127 - DNA, 20 bp, Influenza C virus
gagagacaagaagatttaga

SEQ ID NO: 44128 - DNA, 20 bp, Influenza C virus
cctattgattttgctccaag

SEQ ID NO: 44129 - DNA, 20 bp, Influenza C virus
ctattgattttgctccaaga

SEQ ID NO: 44130 - DNA, 20 bp, Influenza C virus
attttgctccaagaaacata

SEQ ID NO: 44131 - DNA, 20 bp, Influenza C virus
tgctccaagaaacatagcac

SEQ ID NO: 44132 - DNA, 20 bp, Influenza C virus
gctccaagaaacatagcacc

SEQ ID NO: 44133 - DNA, 20 bp, Influenza C virus
aaacaggaattagaaaatgt

SEQ ID NO: 44134 - DNA, 20 bp, Influenza C virus
gaaaatgtttcagatgcatt

SEQ ID NO: 44135 - DNA, 20 bp, Influenza C virus
cagatgcattaaaagcggat

SEQ ID NO: 44136 - DNA, 20 bp, Influenza C virus
agatgcattaaaagcggatt

SEQ ID NO: 44137 - DNA, 20 bp, Influenza C virus
aaagcggattcgttatggct

SEQ ID NO: 44138 - DNA, 20 bp, Human rhinovirus 3
cccacgggtgaccgtgtcct

SEQ ID NO: 44139 - DNA, 20 bp, Human rhinovirus 3
tgctgggacgcctttttata

SEQ ID NO: 44140 - DNA, 20 bp, Human rhinovirus 3
gccgccacgcaggctaggac

SEQ ID NO: 44141 - DNA, 20 bp, Human rhinovirus 3
aatgttgaagggggcaccag

SEQ ID NO: 44142 - DNA, 20 bp, Human rhinovirus 3
atgttgaagggggcaccagc

SEQ ID NO: 44143 - DNA, 20 bp, Human rhinovirus 3
aagggggcaccagcactgaa

SEQ ID NO: 44144 - DNA, 20 bp, Human rhinovirus 3
accgaatgttgaagcatgtg

SEQ ID NO: 44145 - DNA, 20 bp, Human rhinovirus 3
aagcatgtggttacagtgat

SEQ ID NO: 44146 - DNA, 20 bp, Human rhinovirus 3
gaagttgcccgatgctctta

SEQ ID NO: 44147 - DNA, 20 bp, Human rhinovirus 3
cccgatgctcttaaggacat

SEQ ID NO: 44148 - DNA, 20 bp, Human rhinovirus 3
aggacatgggagtatttggc

SEQ ID NO: 44149 - DNA, 20 bp, Human rhinovirus 3
ggccagaatatgttttacca

SEQ ID NO: 44150 - DNA, 20 bp, Human rhinovirus 3
gccagaatatgttttaccat

SEQ ID NO: 44151 - DNA, 20 bp, Human rhinovirus 3
atctagacactgttgaagtt

SEQ ID NO: 44152 - DNA, 20 bp, Human rhinovirus 3
aagttgcaggtggccctacc

SEQ ID NO: 44153 - DNA, 20 bp, Human rhinovirus 3
caggtggccctaccagcgac

SEQ ID NO: 44154 - DNA, 20 bp, Human rhinovirus 3
taggcaatcttttgattttc

SEQ ID NO: 44155 - DNA, 20 bp, Human rhinovirus 3
cctagaagagttccgtccat

SEQ ID NO: 44156 - DNA, 20 bp, Human rhinovirus 3
cctgtgactgttacaattgc

SEQ ID NO: 44157 - DNA, 20 bp, Human rhinovirus 3
caattgcaccaatgtgcaca

SEQ ID NO: 44158 - DNA, 20 bp, Human rhinovirus 3
caccaatgtgcacagaattt

SEQ ID NO: 44159 - DNA, 20 bp, Human rhinovirus 3
actggtattagatctagatc

SEQ ID NO: 44160 - DNA, 20 bp, Human rhinovirus 3
ctggtattagatctagatcc

SEQ ID NO: 44161 - DNA, 20 bp, Human rhinovirus 3
ggcacaaaactctacattgg

SEQ ID NO: 44162 - DNA, 20 bp, Human rhinovirus 3
gcacaaaactctacattggt

SEQ ID NO: 44163 - DNA, 20 bp, Human rhinovirus 3
gtgatggtgttttcaagact

SEQ ID NO: 44164 - DNA, 20 bp, Human rhinovirus 3
tcaagactactttattgggt

SEQ ID NO: 44165 - DNA, 20 bp, Human rhinovirus 3
caagactactttattgggtg

SEQ ID NO: 44166 - DNA, 20 bp, Human rhinovirus 3
ggaacacatgttgtatggga

SEQ ID NO: 44167 - DNA, 20 bp, Human rhinovirus 3
tatgggatattggcttacaa

SEQ ID NO: 44168 - DNA, 20 bp, Human rhinovirus 3
gcttacaatccaccatagtt

SEQ ID NO: 44169 - DNA, 20 bp, Human rhinovirus 3
caatccaccatagttatgac

SEQ ID NO: 44170 - DNA, 20 bp, Human rhinovirus 3
tgaccattccatggacatca

SEQ ID NO: 44171 - DNA, 20 bp, Human rhinovirus 3
tgtgcatgtgacagaaatca

SEQ ID NO: 44172 - DNA, 20 bp, Human rhinovirus 3
gataatcacaggaaggaggg

SEQ ID NO: 44173 - DNA, 20 bp, Human rhinovirus 3
aacaacccctccttcctgtg

SEQ ID NO: 44174 - DNA, 20 bp, Human rhinovirus 3
ctgtgattatccaagccagc

SEQ ID NO: 44175 - DNA, 20 bp, Human rhinovirus 3
tccaagccagctgcgttctt

SEQ ID NO: 44176 - DNA, 20 bp, Human rhinovirus 3
cacatggcaaagtgcttcta

SEQ ID NO: 44177 - DNA, 20 bp, Human rhinovirus 3
taaccccagtgtgtttttca

SEQ ID NO: 44178 - DNA, 20 bp, Human rhinovirus 3
ttcaaagttggtgagacatc

SEQ ID NO: 44179 - DNA, 20 bp, Human rhinovirus 3
tcaaagttggtgagacatcc

SEQ ID NO: 44180 - DNA, 20 bp, Human rhinovirus 3
caaagttggtgagacatcca

SEQ ID NO: 44181 - DNA, 20 bp, Human rhinovirus 3
tgaaaattagagtttaccac

SEQ ID NO: 44182 - DNA, 20 bp, Human rhinovirus 3
gagtttaccacagagccaaa

SEQ ID NO: 44183 - DNA, 20 bp, Human rhinovirus 3
accacagagccaaacatgtg

SEQ ID NO: 44184 - DNA, 20 bp, Human rhinovirus 3
ccacagagccaaacatgtgg

SEQ ID NO: 44185 - DNA, 20 bp, Human rhinovirus 3
caagagcacctagagccttg

SEQ ID NO: 44186 - DNA, 20 bp, Human rhinovirus 3
actactccagatattacagg

SEQ ID NO: 44187 - DNA, 20 bp, Human rhinovirus 3
ctactccagatattacagga

SEQ ID NO: 44188 - DNA, 20 bp, Human rhinovirus 3
caggaagttctatcccatca

SEQ ID NO: 44189 - DNA, 20 bp, Human rhinovirus 3
tatcccatcatttgtgagag

SEQ ID NO: 44190 - DNA, 20 bp, Human rhinovirus 3
gtgagagacccactaacatc

SEQ ID NO: 44191 - DNA, 20 bp, Human rhinovirus 3
ttaacagctggtggaggcgg

SEQ ID NO: 44192 - DNA, 20 bp, Human rhinovirus 3
acagctggtggaggcggtta

SEQ ID NO: 44193 - DNA, 20 bp, Human rhinovirus 3
tgtctgttttgcagacataa

SEQ ID NO: 44194 - DNA, 20 bp, Human rhinovirus 3
tgcagacataagacaattgg

SEQ ID NO: 44195 - DNA, 20 bp, Human rhinovirus 3
gcagacataagacaattgga

SEQ ID NO: 44196 - DNA, 20 bp, Human rhinovirus 3
agttttgtagcaaactaaag

SEQ ID NO: 44197 - DNA, 20 bp, Human rhinovirus 3
tgtagcaaactaaagcaact

SEQ ID NO: 44198 - DNA, 20 bp, Human rhinovirus 3
gtagcaaactaaagcaacta

SEQ ID NO: 44199 - DNA, 20 bp, Human rhinovirus 3
tagcaaactaaagcaactag

SEQ ID NO: 44200 - DNA, 20 bp, Human rhinovirus 3
gagagacaaatagcatccat

SEQ ID NO: 44201 - DNA, 20 bp, Human rhinovirus 3
taatacacggcacaccaggt

SEQ ID NO: 44202 - DNA, 20 bp, Human rhinovirus 3
aatacacggcacaccaggtt

SEQ ID NO: 44203 - DNA, 20 bp, Human rhinovirus 3
atacacggcacaccaggttc

SEQ ID NO: 44204 - DNA, 20 bp, Human rhinovirus 3
tggcaaatcactaactacat

SEQ ID NO: 44205 - DNA, 20 bp, Human rhinovirus 3
tgggccgcgcattggcagaa

SEQ ID NO: 44206 - DNA, 20 bp, Human rhinovirus 3
gcctcaaccaattcaaacac

SEQ ID NO: 44207 - DNA, 20 bp, Human rhinovirus 3
aaacactctaagtcccccca

SEQ ID NO: 44208 - DNA, 20 bp, Human rhinovirus 3
aacccagaagctctgattag

SEQ ID NO: 44209 - DNA, 20 bp, Human rhinovirus 3
gacggtttggatttgatttg

SEQ ID NO: 44210 - DNA, 20 bp, Human rhinovirus 3
tgggttcaagatagtggggg

SEQ ID NO: 44211 - DNA, 20 bp, Human rhinovirus 3
actagtttgggtattcatga

SEQ ID NO: 44212 - DNA, 20 bp, Human rhinovirus 3
gggtattcatgatcgtatct

SEQ ID NO: 44213 - DNA, 20 bp, Human rhinovirus 3
ggtattcatgatcgtatctg

SEQ ID NO: 44214 - DNA, 20 bp, Human rhinovirus 3
atgatcgtatctgtgtctta

SEQ ID NO: 44215 - DNA, 20 bp, Human rhinovirus 3
ccaacacatgcccaaccagg

SEQ ID NO: 44216 - DNA, 20 bp, Human rhinovirus 3
actaatactatattagatgt

SEQ ID NO: 44217 - DNA, 20 bp, Human rhinovirus 3
ctaatactatattagatgta

SEQ ID NO: 44218 - DNA, 20 bp, Human rhinovirus 3
gatgtaggaccaataaccat

SEQ ID NO: 44219 - DNA, 20 bp, Human rhinovirus 3
taaatttaagtaatacacca

SEQ ID NO: 44220 - DNA, 20 bp, Human rhinovirus 3
aagtaatacaccaacaacca

SEQ ID NO: 44221 - DNA, 20 bp, Human rhinovirus 3
gtctaaacccaataaacaca

SEQ ID NO: 44222 - DNA, 20 bp, Human rhinovirus 3
atcctagtgtgttttacaat

SEQ ID NO: 44223 - DNA, 20 bp, Human rhinovirus 3
tacaatgtgttccctggaag

SEQ ID NO: 44224 - DNA, 20 bp, Human rhinovirus 3
acaatgtgttccctggaagc

SEQ ID NO: 44225 - DNA, 20 bp, Human rhinovirus 3
caatgtgttccctggaagca

SEQ ID NO: 44226 - DNA, 20 bp, Influenza A virus
aatccgatgattgtcgagct

SEQ ID NO: 44227 - DNA, 20 bp, Influenza A virus
tcgagcttgcggaaaaaaca

SEQ ID NO: 44228 - DNA, 20 bp, Influenza A virus
cggaaaaaacaatgaaagag

SEQ ID NO: 44229 - DNA, 20 bp, Influenza A virus
gcagcaatatgcactcactt

SEQ ID NO: 44230 - DNA, 20 bp, Influenza A virus
cagcaatatgcactcacttg

SEQ ID NO: 44231 - DNA, 20 bp, Influenza A virus
tttgaaaacaacaccacgac

SEQ ID NO: 44232 - DNA, 20 bp, Influenza A virus
ttgaaaacaacaccacgacc

SEQ ID NO: 44233 - DNA, 20 bp, Influenza A virus
tgaaaacaacaccacgacca

SEQ ID NO: 44234 - DNA, 20 bp, Influenza A virus
gaaaacaacaccacgaccac

SEQ ID NO: 44235 - DNA, 20 bp, Influenza A virus
aaaacaacaccacgaccact

SEQ ID NO: 44236 - DNA, 20 bp, Influenza A virus
gagaagatgtggctccaatt

SEQ ID NO: 44237 - DNA, 20 bp, Influenza A virus
aacacattgcaagcatgaga

SEQ ID NO: 44238 - DNA, 20 bp, Influenza A virus
caagcatgagaaggaattat

SEQ ID NO: 44239 - DNA, 20 bp, Influenza A virus
tttcacatcagaggtgtctc

SEQ ID NO: 44240 - DNA, 20 bp, Influenza A virus
cacatcagaggtgtctcact

SEQ ID NO: 44241 - DNA, 20 bp, Influenza A virus
gtgagcatggagttttctct

SEQ ID NO: 44242 - DNA, 20 bp, Influenza A virus
tgagcatggagttttctctc

SEQ ID NO: 44243 - DNA, 20 bp, Influenza A virus
tctctcactgacccaagact

SEQ ID NO: 44244 - DNA, 20 bp, Influenza A virus
ctctcactgacccaagactt

SEQ ID NO: 44245 - DNA, 20 bp, Influenza A virus
tctcactgacccaagacttg

SEQ ID NO: 44246 - DNA, 20 bp, Influenza A virus
aacaaattgagagtatgatt

SEQ ID NO: 44247 - DNA, 20 bp, Influenza A virus
agagtatgattgaagctgag

SEQ ID NO: 44248 - DNA, 20 bp, Influenza A virus
aagctgagtcctctgtcaaa

SEQ ID NO: 44249 - DNA, 20 bp, Influenza A virus
tttgagaacaaatcagaaac

SEQ ID NO: 44250 - DNA, 20 bp, Influenza A virus
gagaacaaatcagaaacatg

SEQ ID NO: 44251 - DNA, 20 bp, Influenza A virus
ggatgaagtggatgatggca

SEQ ID NO: 44252 - DNA, 20 bp, Influenza A virus
gatatttcattgccatcatc

SEQ ID NO: 44253 - DNA, 20 bp, Influenza A virus
cattgccatcatccacttca

SEQ ID NO: 44254 - DNA, 20 bp, Influenza A virus
attgccatcatccacttcat

SEQ ID NO: 44255 - DNA, 20 bp, Influenza A virus
ccatcatccacttcatccta

SEQ ID NO: 44256 - DNA, 20 bp, Influenza A virus
tgaaaaggtcgaaaggctaa

SEQ ID NO: 44257 - DNA, 20 bp, Influenza A virus
gaaaaggtcgaaaggctaaa

SEQ ID NO: 44258 - DNA, 20 bp, Influenza A virus
aaaaggtcgaaaggctaaaa

SEQ ID NO: 44259 - DNA, 20 bp, Influenza A virus
ggccccgttcacttcagaaa

SEQ ID NO: 44260 - DNA, 20 bp, Influenza A virus
acttcagaaaccaggttaaa

SEQ ID NO: 44261 - DNA, 20 bp, Influenza A virus
ccaaggaaaagaagaaggag

SEQ ID NO: 44262 - DNA, 20 bp, Influenza A virus
aggactgcaaaattgcccct

SEQ ID NO: 44263 - DNA, 20 bp, Influenza A virus
cccctttaatggtggcttac

SEQ ID NO: 44264 - DNA, 20 bp, Influenza A virus
aatggtggcttacatgttgg

SEQ ID NO: 44265 - DNA, 20 bp, Influenza A virus
atggtggcttacatgttgga

SEQ ID NO: 44266 - DNA, 20 bp, Influenza A virus
gcttcgcttttggagatgtg

SEQ ID NO: 44267 - DNA, 20 bp, Influenza A virus
gcttttggagatgtgccata

SEQ ID NO: 44268 - DNA, 20 bp, Influenza A virus
tggagatgtgccatagtaca

SEQ ID NO: 44269 - DNA, 20 bp, Influenza A virus
ggagatgtgccatagtacac

SEQ ID NO: 44270 - DNA, 20 bp, Influenza A virus
gagatgtgccatagtacaca

SEQ ID NO: 44271 - DNA, 20 bp, Influenza A virus
aaaataagagtacatgaagg

SEQ ID NO: 44272 - DNA, 20 bp, Influenza A virus
acaatggtcgggcgaagagc

SEQ ID NO: 44273 - DNA, 20 bp, Influenza A virus
taaggaaagcaaccagaaga

SEQ ID NO: 44274 - DNA, 20 bp, Influenza A virus
gatcagtcttctggttgctt

SEQ ID NO: 44275 - DNA, 20 bp, Influenza A virus
tggttgctttccttagaatg

SEQ ID NO: 44276 - DNA, 20 bp, Influenza A virus
ccaaaaggatgcaaaggtcc

SEQ ID NO: 44277 - DNA, 20 bp, Influenza A virus
caaaaggatgcaaaggtcct

SEQ ID NO: 44278 - DNA, 20 bp, Influenza A virus
caaaactggggaattgaacc

SEQ ID NO: 44279 - DNA, 20 bp, Influenza A virus
aaaactggggaattgaaccc

SEQ ID NO: 44280 - DNA, 20 bp, Influenza A virus
aacccattgacaatgtaatg

SEQ ID NO: 44281 - DNA, 20 bp, Influenza A virus
gtgaaacacagggaacagaa

SEQ ID NO: 44282 - DNA, 20 bp, Influenza A virus
atcgtccatgatgtgggaga

SEQ ID NO: 44283 - DNA, 20 bp, Influenza A virus
cggaccattgatctcccaca

SEQ ID NO: 44284 - DNA, 20 bp, Influenza A virus
atctcccacatcatggacga

SEQ ID NO: 44285 - DNA, 20 bp, Influenza A virus
tagtcagcttttctgttccc

SEQ ID NO: 44286 - DNA, 20 bp, Influenza A virus
ccatttgcagcagccccgcc

SEQ ID NO: 44287 - DNA, 20 bp, Influenza A virus
gcagcagccccgccgaagca

SEQ ID NO: 44288 - DNA, 20 bp, Influenza A virus
cagcagccccgccgaagcag

SEQ ID NO: 44289 - DNA, 20 bp, Influenza A virus
tcttctctaactgtgaatgt

SEQ ID NO: 44290 - DNA, 20 bp, Influenza A virus
tctaactgtgaatgtgaggg

SEQ ID NO: 44291 - DNA, 20 bp, Human papillomavirus type 116
tttaagtgggttagatttgc

SEQ ID NO: 44292 - DNA, 20 bp, Human papillomavirus type 116
aagtgggttagatttgcaag

SEQ ID NO: 44293 - DNA, 20 bp, Human papillomavirus type 116
agtgggttagatttgcaaga

SEQ ID NO: 44294 - DNA, 20 bp, Human papillomavirus type 116
gatttgcaagagaaatttga

SEQ ID NO: 44295 - DNA, 20 bp, Human papillomavirus type 116
gcaagagaaatttgatttgg

SEQ ID NO: 44296 - DNA, 20 bp, Human papillomavirus type 116
agatacattgtttgatgaaa

SEQ ID NO: 44297 - DNA, 20 bp, Human papillomavirus type 116
gatacattgtttgatgaaag

SEQ ID NO: 44298 - DNA, 20 bp, Human papillomavirus type 116
tttgatgaaagtgattgtga

SEQ ID NO: 44299 - DNA, 20 bp, Human papillomavirus type 116
gatgaaagtgattgtgattc

SEQ ID NO: 44300 - DNA, 20 bp, Human papillomavirus type 116
atgaaagtgattgtgattct

SEQ ID NO: 44301 - DNA, 20 bp, Human papillomavirus type 116
tttcaggacagtggattagg

SEQ ID NO: 44302 - DNA, 20 bp, Human papillomavirus type 116
caggacagtggattaggcga

SEQ ID NO: 44303 - DNA, 20 bp, Human papillomavirus type 116
aggacagtggattaggcgaa

SEQ ID NO: 44304 - DNA, 20 bp, Human papillomavirus type 116
ggcgaagatgaagctgaact

SEQ ID NO: 44305 - DNA, 20 bp, Human papillomavirus type 116
tttctgaacaggtagaagtg

SEQ ID NO: 44306 - DNA, 20 bp, Human papillomavirus type 116
gtctgggaccccaactcact

SEQ ID NO: 44307 - DNA, 20 bp, Human papillomavirus type 116
tggcgttcttcgtccgtcgg

SEQ ID NO: 44308 - DNA, 20 bp, Human papillomavirus type 116
ttcgtccgtcggcctcctcg

SEQ ID NO: 44309 - DNA, 20 bp, Human papillomavirus type 116
gtccgtcggcctcctcggtg

SEQ ID NO: 44310 - DNA, 20 bp, Human papillomavirus type 116
gtggtagagtgagttggggt

SEQ ID NO: 44311 - DNA, 20 bp, Human papillomavirus type 116
cacgatcaggtctatcgaga

SEQ ID NO: 44312 - DNA, 20 bp, Human papillomavirus type 116
aacgacttcaaaaggaggct

SEQ ID NO: 44313 - DNA, 20 bp, Human papillomavirus type 116
aaaaggaggctcgggatccg

SEQ ID NO: 44314 - DNA, 20 bp, Human papillomavirus type 116
tatacggatcccgagcctcc

SEQ ID NO: 44315 - DNA, 20 bp, Human papillomavirus type 116
tgaagtcgttcaagtctcga

SEQ ID NO: 44316 - DNA, 20 bp, Human papillomavirus type 116
ggcattggaactggtaaggg

SEQ ID NO: 44317 - DNA, 20 bp, Human papillomavirus type 116
gaactggtaagggtggtgga

SEQ ID NO: 44318 - DNA, 20 bp, Human papillomavirus type 116
tggaggcacaaggcctagca

SEQ ID NO: 44319 - DNA, 20 bp, Human papillomavirus type 116
ggaggcacaaggcctagcat

SEQ ID NO: 44320 - DNA, 20 bp, Human papillomavirus type 116
gaggcacaaggcctagcata

SEQ ID NO: 44321 - DNA, 20 bp, Human papillomavirus type 116
gatcttgtttctgaagtaac

SEQ ID NO: 44322 - DNA, 20 bp, Human papillomavirus type 116
tttctgaagtaactggtgtt

SEQ ID NO: 44323 - DNA, 20 bp, Human papillomavirus type 116
ctgaagtaactggtgttggt

SEQ ID NO: 44324 - DNA, 20 bp, Human papillomavirus type 116
tgaagtaactggtgttggtg

SEQ ID NO: 44325 - DNA, 20 bp, Human papillomavirus type 116
gtgaacatccttccgttaca

SEQ ID NO: 44326 - DNA, 20 bp, Human papillomavirus type 116
agtattgatgttaattactc

SEQ ID NO: 44327 - DNA, 20 bp, Human papillomavirus type 116
gtattgatgttaattactcc

SEQ ID NO: 44328 - DNA, 20 bp, Human papillomavirus type 116
atgttaattactccgattat

SEQ ID NO: 44329 - DNA, 20 bp, Human papillomavirus type 116
attactccgattataatata

SEQ ID NO: 44330 - DNA, 20 bp, Human papillomavirus type 116
ctccgattataatatacatc

SEQ ID NO: 44331 - DNA, 20 bp, Human papillomavirus type 116
ggacagactgttgactgttg

SEQ ID NO: 44332 - DNA, 20 bp, Human papillomavirus type 116
actgttggccatccttactt

SEQ ID NO: 44333 - DNA, 20 bp, Human papillomavirus type 116
gccatccttactttgacgtt

SEQ ID NO: 44334 - DNA, 20 bp, Human papillomavirus type 116
ctttgacgttttgaatgacg

SEQ ID NO: 44335 - DNA, 20 bp, Human papillomavirus type 116
gacgttttgaatgacgctac

SEQ ID NO: 44336 - DNA, 20 bp, Human papillomavirus type 116
tttgacagattggcagatac

SEQ ID NO: 44337 - DNA, 20 bp, Human papillomavirus type 116
gacagattggcagatacgga

SEQ ID NO: 44338 - DNA, 20 bp, Human papillomavirus type 116
acagattggcagatacggaa

SEQ ID NO: 44339 - DNA, 20 bp, Human papillomavirus type 116
gcagatacggaaaatcctaa

SEQ ID NO: 44340 - DNA, 20 bp, Human papillomavirus type 116
atgcccctgcagaggtagat

SEQ ID NO: 44341 - DNA, 20 bp, Hepatitis C virus
acgcagaaagcgtctagcca

SEQ ID NO: 44342 - DNA, 20 bp, Hepatitis C virus
gtatgagtgtcgtgcagcct

SEQ ID NO: 44343 - DNA, 20 bp, Hepatitis C virus
cgcagactactatggctctc

SEQ ID NO: 44344 - DNA, 20 bp, Hepatitis C virus
ctgcgtgaagacagtagttc

SEQ ID NO: 44345 - DNA, 20 bp, Hepatitis C virus
ccgggcggcggccagatcgt

SEQ ID NO: 44346 - DNA, 20 bp, Hepatitis C virus
gtggagtttacttgctgccg

SEQ ID NO: 44347 - DNA, 20 bp, Hepatitis C virus
acttgctgccgcgcaggggc

SEQ ID NO: 44348 - DNA, 20 bp, Hepatitis C virus
cttgctgccgcgcaggggcc

SEQ ID NO: 44349 - DNA, 20 bp, Hepatitis C virus
ctgccgcgcaggggcccacg

SEQ ID NO: 44350 - DNA, 20 bp, Hepatitis C virus
tgtgccttgcgtgagagccg

SEQ ID NO: 44351 - DNA, 20 bp, Hepatitis C virus
cgtgagagccggaaacattt

SEQ ID NO: 44352 - DNA, 20 bp, Hepatitis C virus
cacgctgctggcatcctgtt

SEQ ID NO: 44353 - DNA, 20 bp, Hepatitis C virus
acgctgctggcatcctgttt

SEQ ID NO: 44354 - DNA, 20 bp, Hepatitis C virus
cacccaccctggctgtaccg

SEQ ID NO: 44355 - DNA, 20 bp, Hepatitis C virus
tgagagtgcccgaaatagtg

SEQ ID NO: 44356 - DNA, 20 bp, Hepatitis C virus
gccggcggtcactggggtgt

SEQ ID NO: 44357 - DNA, 20 bp, Hepatitis C virus
cgggcactctcagaatgctc

SEQ ID NO: 44358 - DNA, 20 bp, Hepatitis C virus
gggcactctcagaatgctcg

SEQ ID NO: 44359 - DNA, 20 bp, Hepatitis C virus
ctcagaacggcttggcgcat

SEQ ID NO: 44360 - DNA, 20 bp, Hepatitis C virus
gcgcatgcaagcccttggaa

SEQ ID NO: 44361 - DNA, 20 bp, Hepatitis C virus
gaacacttccagcagggatg

SEQ ID NO: 44362 - DNA, 20 bp, Hepatitis C virus
cagcagggatggggccctat

SEQ ID NO: 44363 - DNA, 20 bp, Hepatitis C virus
gacttgtgggttatagggcc

SEQ ID NO: 44364 - DNA, 20 bp, Hepatitis C virus
gttcgggtgcacgtggatga

SEQ ID NO: 44365 - DNA, 20 bp, Hepatitis C virus
gggtgcacgtggatgaactc

SEQ ID NO: 44366 - DNA, 20 bp, Hepatitis C virus
accaagacctgcggagcccc

SEQ ID NO: 44367 - DNA, 20 bp, Hepatitis C virus
ccagttaatcccaggagact

SEQ ID NO: 44368 - DNA, 20 bp, Hepatitis C virus
atcccaggagactataatag

SEQ ID NO: 44369 - DNA, 20 bp, Hepatitis C virus
ctatcttgccttgcagcttt

SEQ ID NO: 44370 - DNA, 20 bp, Hepatitis C virus
ccttgcagctttaccaccat

SEQ ID NO: 44371 - DNA, 20 bp, Hepatitis C virus
cagctttaccaccatgcccg

SEQ ID NO: 44372 - DNA, 20 bp, Hepatitis C virus
accaccatgcccgccttgtc

SEQ ID NO: 44373 - DNA, 20 bp, Hepatitis C virus
ccaccatgcccgccttgtca

SEQ ID NO: 44374 - DNA, 20 bp, Hepatitis C virus
gagcggctcgtcgtcctcaa

SEQ ID NO: 44375 - DNA, 20 bp, Hepatitis C virus
gtgttggaccctcatcttcc

SEQ ID NO: 44376 - DNA, 20 bp, Hepatitis C virus
gaccctcatcttcctgtgct

SEQ ID NO: 44377 - DNA, 20 bp, Hepatitis C virus
ctgtgctgcgtgtggcacgt

SEQ ID NO: 44378 - DNA, 20 bp, Hepatitis C virus
acgtgccacacgcagcacag

SEQ ID NO: 44379 - DNA, 20 bp, Hepatitis C virus
tcccccatggagaaaaagat

SEQ ID NO: 44380 - DNA, 20 bp, Hepatitis C virus
cccccatggagaaaaagatc

SEQ ID NO: 44381 - DNA, 20 bp, Hepatitis C virus
ccccatggagaaaaagatca

SEQ ID NO: 44382 - DNA, 20 bp, Hepatitis C virus
cgtggggtgcagacaccgct

SEQ ID NO: 44383 - DNA, 20 bp, Hepatitis C virus
aggggtctccctgtgtccgc

SEQ ID NO: 44384 - DNA, 20 bp, Hepatitis C virus
ctggcgaccactatcaacgg

SEQ ID NO: 44385 - DNA, 20 bp, Hepatitis C virus
atcacggtgctggctcgaaa

SEQ ID NO: 44386 - DNA, 20 bp, Hepatitis C virus
tcacggtgctggctcgaaaa

SEQ ID NO: 44387 - DNA, 20 bp, Hepatitis C virus
ccggaccaaaagggcccgta

SEQ ID NO: 44388 - DNA, 20 bp, Hepatitis C virus
accaagacctggtgggctgg

SEQ ID NO: 44389 - DNA, 20 bp, Hepatitis C virus
agggcggccgtgtgtacgag

SEQ ID NO: 44390 - DNA, 20 bp, Hepatitis C virus
atccctgtggagaatatgga

SEQ ID NO: 44391 - DNA, 20 bp, Hepatitis C virus
tgtccatattctccacaggg

SEQ ID NO: 44392 - DNA, 20 bp, Hepatitis C virus
tccacagggatgaagtccag

SEQ ID NO: 44393 - DNA, 20 bp, Hepatitis C virus
gccacgcccctcgtacacac

SEQ ID NO: 44394 - DNA, 20 bp, Hepatitis C virus
aggaggagcatatgatatca

SEQ ID NO: 44395 - DNA, 20 bp, Hepatitis C virus
gcatcggcactgtcctagac

SEQ ID NO: 44396 - DNA, 20 bp, Hepatitis C virus
ctgcctggtctaggacagtg

SEQ ID NO: 44397 - DNA, 20 bp, Hepatitis C virus
tgcctggtctaggacagtgc

SEQ ID NO: 44398 - DNA, 20 bp, Hepatitis C virus
ggtctgtggagtggcactcg

SEQ ID NO: 44399 - DNA, 20 bp, Hepatitis C virus
tatagaggtgtcgatgtggc

SEQ ID NO: 44400 - DNA, 20 bp, Hepatitis C virus
tgaccggctacacgggcgac

SEQ ID NO: 44401 - DNA, 20 bp, Hepatitis C virus
gactctgtcattgattgtaa

SEQ ID NO: 44402 - DNA, 20 bp, Hepatitis C virus
actctgtcattgattgtaac

SEQ ID NO: 44403 - DNA, 20 bp, Hepatitis C virus
caatcaatgacagagtcaaa

SEQ ID NO: 44404 - DNA, 20 bp, Hepatitis C virus
gtctcgcagggggaaagacc

SEQ ID NO: 44405 - DNA, 20 bp, Hepatitis C virus
tctcgcagggggaaagacct

SEQ ID NO: 44406 - DNA, 20 bp, Hepatitis C virus
aggtatgtttgatagcgtcg

SEQ ID NO: 44407 - DNA, 20 bp, Hepatitis C virus
gatagcgtcgtgctctgtga

SEQ ID NO: 44408 - DNA, 20 bp, Hepatitis C virus
atagcgtcgtgctctgtgaa

SEQ ID NO: 44409 - DNA, 20 bp, Hepatitis C virus
agccgaccctcacaggtcct

SEQ ID NO: 44410 - DNA, 20 bp, Hepatitis C virus
gtgattggatgtgttgttac

SEQ ID NO: 44411 - DNA, 20 bp, Hepatitis C virus
tgattggatgtgttgttact

SEQ ID NO: 44412 - DNA, 20 bp, Hepatitis C virus
gatgtgttgttactatctca

SEQ ID NO: 44413 - DNA, 20 bp, Hepatitis C virus
ttactatctcattttggaca

SEQ ID NO: 44414 - DNA, 20 bp, Hepatitis C virus
agggtcagcagattgctgag

SEQ ID NO: 44415 - DNA, 20 bp, Hepatitis C virus
ctgagcagttcaagcaaaag

SEQ ID NO: 44416 - DNA, 20 bp, Hepatitis C virus
aagcaaaaggtccttgggct

SEQ ID NO: 44417 - DNA, 20 bp, Hepatitis C virus
ggctgctccaggccggcacc

SEQ ID NO: 44418 - DNA, 20 bp, Hepatitis C virus
cacgtggcccagggtggagg

SEQ ID NO: 44419 - DNA, 20 bp, Hepatitis C virus
ccaagtagctcccccctccg

SEQ ID NO: 44420 - DNA, 20 bp, Hepatitis C virus
cgtcgtgagcggcttagcag

SEQ ID NO: 44421 - DNA, 20 bp, Hepatitis C virus
gtcgtgagcggcttagcagg

SEQ ID NO: 44422 - DNA, 20 bp, Hepatitis C virus
gcaggcgccacggtggccag

SEQ ID NO: 44423 - DNA, 20 bp, Hepatitis C virus
acttaccatcactagcctgt

SEQ ID NO: 44424 - DNA, 20 bp, Hepatitis C virus
ccatcactagcctgttacgc

SEQ ID NO: 44425 - DNA, 20 bp, Hepatitis C virus
cgcaggctacaccagtggat

SEQ ID NO: 44426 - DNA, 20 bp, Hepatitis C virus
acgaggatacgtccacgcct

SEQ ID NO: 44427 - DNA, 20 bp, Hepatitis C virus
gggtgactttgtttgatgcg

SEQ ID NO: 44428 - DNA, 20 bp, Hepatitis C virus
ctggacacgtgaagaacggg

SEQ ID NO: 44429 - DNA, 20 bp, Hepatitis C virus
gcatggaacgtttccgatca

SEQ ID NO: 44430 - DNA, 20 bp, Hepatitis C virus
tggcgttgatcggaaacgtt

SEQ ID NO: 44431 - DNA, 20 bp, Hepatitis C virus
atcggaaacgttccatgcca

SEQ ID NO: 44432 - DNA, 20 bp, Hepatitis C virus
catgccaagtgttgctgcac

SEQ ID NO: 44433 - DNA, 20 bp, Hepatitis C virus
gagatgaggtgagcttctct

SEQ ID NO: 44434 - DNA, 20 bp, Hepatitis C virus
tctgtgggcctcctagagtt

SEQ ID NO: 44435 - DNA, 20 bp, Hepatitis C virus
gttgtggggtctcagctccc

SEQ ID NO: 44436 - DNA, 20 bp, Hepatitis C virus
ttgtggggtctcagctccct

SEQ ID NO: 44437 - DNA, 20 bp, Hepatitis C virus
tggggtctcagctcccttgt

SEQ ID NO: 44438 - DNA, 20 bp, Hepatitis C virus
cagagtatgacgacagggag

SEQ ID NO: 44439 - DNA, 20 bp, Hepatitis C virus
cctcctgctctcccgatttg

SEQ ID NO: 44440 - DNA, 20 bp, Hepatitis C virus
gggccagacctgactacaat

SEQ ID NO: 44441 - DNA, 20 bp, Hepatitis C virus
ggccagacctgactacaatc

SEQ ID NO: 44442 - DNA, 20 bp, Hepatitis C virus
ccatttctgtaggagaggtg

SEQ ID NO: 44443 - DNA, 20 bp, Hepatitis C virus
gtggaggacactagcacctc

SEQ ID NO: 44444 - DNA, 20 bp, Hepatitis C virus
tggaggacactagcacctca

SEQ ID NO: 44445 - DNA, 20 bp, Hepatitis C virus
tcgggtcaggagatgatggg

SEQ ID NO: 44446 - DNA, 20 bp, Hepatitis C virus
accctccgaggccggagctc

SEQ ID NO: 44447 - DNA, 20 bp, Hepatitis C virus
attgtttatccagacttatc

SEQ ID NO: 44448 - DNA, 20 bp, Hepatitis C virus
tttatccagacttatccgtg

SEQ ID NO: 44449 - DNA, 20 bp, Hepatitis C virus
atccagacttatccgtgcgg

SEQ ID NO: 44450 - DNA, 20 bp, Hepatitis C virus
tccagacttatccgtgcggg

SEQ ID NO: 44451 - DNA, 20 bp, Hepatitis C virus
tccgtgcgggtttgcgagaa

SEQ ID NO: 44452 - DNA, 20 bp, Hepatitis C virus
tggtggcccgatgtttaact

SEQ ID NO: 44453 - DNA, 20 bp, Hepatitis C virus
aactccaaaggggaatcatg

SEQ ID NO: 44454 - DNA, 20 bp, Hepatitis C virus
actccaaaggggaatcatgt

SEQ ID NO: 44455 - DNA, 20 bp, Hepatitis C virus
ggggaacaccctcacttgtt

SEQ ID NO: 44456 - DNA, 20 bp, Hepatitis C virus
gggaacaccctcacttgtta

SEQ ID NO: 44457 - DNA, 20 bp, Hepatitis C virus
ctacctcacccgtgactgta

SEQ ID NO: 44458 - DNA, 20 bp, Hepatitis C virus
cgcgagctgcttgggagaca

SEQ ID NO: 44459 - DNA, 20 bp, Hepatitis C virus
ggagacagctcgccataccc

SEQ ID NO: 44460 - DNA, 20 bp, Hepatitis C virus
acaggggtatggcgagctgt

SEQ ID NO: 44461 - DNA, 20 bp, Hepatitis C virus
gggcgccacccttaagagct

SEQ ID NO: 44462 - DNA, 20 bp, Hepatitis C virus
agagcttggagacatcgagc

SEQ ID NO: 44463 - DNA, 20 bp, Hepatitis C virus
gagacatcgagccagagctg

SEQ ID NO: 44464 - DNA, 20 bp, Hepatitis C virus
gctctgacagctctggctcg

SEQ ID NO: 44465 - DNA, 20 bp, Hepatitis C virus
agggtggcgccccaagcttc

SEQ ID NO: 44466 - DNA, 20 bp, Influenza C virus
aagcctacattgccatttgt

SEQ ID NO: 44467 - DNA, 20 bp, Influenza C virus
ccatttgtaaggaagtgggc

SEQ ID NO: 44468 - DNA, 20 bp, Influenza C virus
gtaaggaagtgggccttaat

SEQ ID NO: 44469 - DNA, 20 bp, Influenza C virus
taaggaagtgggccttaatg

SEQ ID NO: 44470 - DNA, 20 bp, Influenza C virus
atggcgatgaaatgttgatc

SEQ ID NO: 44471 - DNA, 20 bp, Influenza C virus
aaagagctggttcaggcacc

SEQ ID NO: 44472 - DNA, 20 bp, Influenza C virus
aggcaccaatataacctacc

SEQ ID NO: 44473 - DNA, 20 bp, Influenza C virus
ttgaattgacaagccgctca

SEQ ID NO: 44474 - DNA, 20 bp, Influenza C virus
aattgacaagccgctcaaga

SEQ ID NO: 44475 - DNA, 20 bp, Influenza C virus
acaagccgctcaagaattgt

SEQ ID NO: 44476 - DNA, 20 bp, Influenza C virus
gagttcttatagctgacgca

SEQ ID NO: 44477 - DNA, 20 bp, Influenza C virus
ttatagctgacgcaaaaggt

SEQ ID NO: 44478 - DNA, 20 bp, Influenza C virus
tagctgacgcaaaaggttta

SEQ ID NO: 44479 - DNA, 20 bp, Influenza C virus
ccatttattaaaccttttgc

SEQ ID NO: 44480 - DNA, 20 bp, Influenza C virus
catttattaaaccttttgcg

SEQ ID NO: 44481 - DNA, 20 bp, Influenza C virus
aagcctcagataaccaacaa

SEQ ID NO: 44482 - DNA, 20 bp, Influenza C virus
tcatcttgttggttatctga

SEQ ID NO: 44483 - DNA, 20 bp, Influenza C virus
ttggttatctgaggctttaa

SEQ ID NO: 44484 - DNA, 20 bp, Influenza C virus
gttatctgaggctttaacag

SEQ ID NO: 44485 - DNA, 20 bp, Influenza C virus
tctgaggctttaacaggagt

SEQ ID NO: 44486 - DNA, 20 bp, Influenza C virus
ggacttgcttatgaagactt

SEQ ID NO: 44487 - DNA, 20 bp, Influenza C virus
gacttgcttatgaagacttc

SEQ ID NO: 44488 - DNA, 20 bp, Influenza C virus
cttatgaagacttcagtttg

SEQ ID NO: 44489 - DNA, 20 bp, Influenza C virus
tgaagacttcagtttggtct

SEQ ID NO: 44490 - DNA, 20 bp, Influenza C virus
agtttggtctctgctatggt

SEQ ID NO: 44491 - DNA, 20 bp, Influenza C virus
gacccagactacaaccccat

SEQ ID NO: 44492 - DNA, 20 bp, Influenza C virus
aaatatcagcagattggaag

SEQ ID NO: 44493 - DNA, 20 bp, Influenza C virus
gaagaagaaggaatggatga

SEQ ID NO: 44494 - DNA, 20 bp, Influenza C virus
tcatccattccttcttcttc

SEQ ID NO: 44495 - DNA, 20 bp, Influenza C virus
catccattccttcttcttcc

SEQ ID NO: 44496 - DNA, 20 bp, Human papillomavirus type 201
tttgatttagaattgaattg

SEQ ID NO: 44497 - DNA, 20 bp, Human papillomavirus type 201
ttgatttagaattgaattgt

SEQ ID NO: 44498 - DNA, 20 bp, Human papillomavirus type 201
tgatttagaattgaattgta

SEQ ID NO: 44499 - DNA, 20 bp, Human papillomavirus type 201
gatttagaattgaattgtat

SEQ ID NO: 44500 - DNA, 20 bp, Human papillomavirus type 201
atttagaattgaattgtatc

SEQ ID NO: 44501 - DNA, 20 bp, Human papillomavirus type 201
taggattgacactcgttgtc

SEQ ID NO: 44502 - DNA, 20 bp, Human papillomavirus type 201
acactcgttgtcacacttgt

SEQ ID NO: 44503 - DNA, 20 bp, Human papillomavirus type 201
tcacacttgtggaacaggtg

SEQ ID NO: 44504 - DNA, 20 bp, Human papillomavirus type 201
tggaacaggtgtcagatgct

SEQ ID NO: 44505 - DNA, 20 bp, Human papillomavirus type 201
ggtattagacaattagagtt

SEQ ID NO: 44506 - DNA, 20 bp, Human papillomavirus type 201
tttgatgacagtggaatcct

SEQ ID NO: 44507 - DNA, 20 bp, Human papillomavirus type 201
gatgacagtggaatcctaga

SEQ ID NO: 44508 - DNA, 20 bp, Human papillomavirus type 201
atgacagtggaatcctagaa

SEQ ID NO: 44509 - DNA, 20 bp, Human papillomavirus type 201
agaaaatggcgcgaaaaaca

SEQ ID NO: 44510 - DNA, 20 bp, Human papillomavirus type 201
gacatctgcaaaactgacat

SEQ ID NO: 44511 - DNA, 20 bp, Human papillomavirus type 201
cattatttttttataaatca

SEQ ID NO: 44512 - DNA, 20 bp, Human papillomavirus type 201
tttttttataaatcatcttt

SEQ ID NO: 44513 - DNA, 20 bp, Human papillomavirus type 201
ttttataaatcatcttttgg

SEQ ID NO: 44514 - DNA, 20 bp, Human papillomavirus type 201
tttataaatcatcttttgga

SEQ ID NO: 44515 - DNA, 20 bp, Human papillomavirus type 201
ttataaatcatcttttggaa

SEQ ID NO: 44516 - DNA, 20 bp, Human papillomavirus type 201
tattactactaatatagatg

SEQ ID NO: 44517 - DNA, 20 bp, Human papillomavirus type 201
attactactaatatagatgt

SEQ ID NO: 44518 - DNA, 20 bp, Human papillomavirus type 201
ttactactaatatagatgtg

SEQ ID NO: 44519 - DNA, 20 bp, Human papillomavirus type 201
ctactaatatagatgtgcca

SEQ ID NO: 44520 - DNA, 20 bp, Human papillomavirus type 201
acttaaatatttatacagta

SEQ ID NO: 44521 - DNA, 20 bp, Human papillomavirus type 201
gtaaattgggactgcaacct

SEQ ID NO: 44522 - DNA, 20 bp, Human papillomavirus type 201
ggactgcaacctgttcctgc

SEQ ID NO: 44523 - DNA, 20 bp, Human papillomavirus type 201
ctgcactggtagtttctgaa

SEQ ID NO: 44524 - DNA, 20 bp, Human papillomavirus type 201
ctgaatacaatggaaaacaa

SEQ ID NO: 44525 - DNA, 20 bp, Human papillomavirus type 201
tgaatacaatggaaaacaag

SEQ ID NO: 44526 - DNA, 20 bp, Human papillomavirus type 201
taagatatttgctcaggatg

SEQ ID NO: 44527 - DNA, 20 bp, Human papillomavirus type 201
aagatatttgctcaggatgc

SEQ ID NO: 44528 - DNA, 20 bp, Human papillomavirus type 201
agatatttgctcaggatgct

SEQ ID NO: 44529 - DNA, 20 bp, Human papillomavirus type 201
gctcaggatgctgaaatgta

SEQ ID NO: 44530 - DNA, 20 bp, Human papillomavirus type 201
ctcaggatgctgaaatgtat

SEQ ID NO: 44531 - DNA, 20 bp, Human papillomavirus type 201
caagaagaagctagggatcc

SEQ ID NO: 44532 - DNA, 20 bp, Human papillomavirus type 201
taattagaggaggggcaaat

SEQ ID NO: 44533 - DNA, 20 bp, Human papillomavirus type 201
gaggaggggcaaatgcttta

SEQ ID NO: 44534 - DNA, 20 bp, Human papillomavirus type 201
aaaatgcttcagatatagaa

SEQ ID NO: 44535 - DNA, 20 bp, Human papillomavirus type 201
aaatgcttcagatatagaaa

SEQ ID NO: 44536 - DNA, 20 bp, Human papillomavirus type 201
gctacccctagcagagtaat

SEQ ID NO: 44537 - DNA, 20 bp, Human papillomavirus type 201
cagatggcacagttattagg

SEQ ID NO: 44538 - DNA, 20 bp, Human papillomavirus type 201
ttaggcctactgttcctgta

SEQ ID NO: 44539 - DNA, 20 bp, Human papillomavirus type 201
ggcctactgttcctgtagag

SEQ ID NO: 44540 - DNA, 20 bp, Human papillomavirus type 201
ctgtagagcctataggtcca

SEQ ID NO: 44541 - DNA, 20 bp, Human papillomavirus type 201
aaatagaggcgggaaggaaa

SEQ ID NO: 44542 - DNA, 20 bp, Human papillomavirus type 201
gaataggatacgtcacttgt

SEQ ID NO: 44543 - DNA, 20 bp, Human papillomavirus type 201
aataggatacgtcacttgta

SEQ ID NO: 44544 - DNA, 20 bp, Human papillomavirus type 201
tataatagaagaattttaca

SEQ ID NO: 44545 - DNA, 20 bp, Human papillomavirus type 201
tacaacaaccaaccagaaac

SEQ ID NO: 44546 - DNA, 20 bp, Human papillomavirus type 201
tgtagaccctatagctcagt

SEQ ID NO: 44547 - DNA, 20 bp, Human papillomavirus type 201
gtagaccctatagctcagtt

SEQ ID NO: 44548 - DNA, 20 bp, Human papillomavirus type 201
tagaccctatagctcagtta

SEQ ID NO: 44549 - DNA, 20 bp, Human papillomavirus type 201
cagaatacagcatttactga

SEQ ID NO: 44550 - DNA, 20 bp, Human papillomavirus type 201
actgaggctgatttggaaga

SEQ ID NO: 44551 - DNA, 20 bp, Human papillomavirus type 201
ccgttggtcatccttacttt

SEQ ID NO: 44552 - DNA, 20 bp, Human papillomavirus type 201
gtcatccttactttgaaatt

SEQ ID NO: 44553 - DNA, 20 bp, Human papillomavirus type 201
ctttgaaattcgtgacaatg

SEQ ID NO: 44554 - DNA, 20 bp, Human papillomavirus type 201
gaaattcgtgacaatgtaga

SEQ ID NO: 44555 - DNA, 20 bp, Human papillomavirus type 201
aaattcgtgacaatgtagat

SEQ ID NO: 44556 - DNA, 20 bp, Human papillomavirus type 201
ttggagacagtctattcttt

SEQ ID NO: 44557 - DNA, 20 bp, Human papillomavirus type 201
tggagacagtctattctttt

SEQ ID NO: 44558 - DNA, 20 bp, Human papillomavirus type 201
ggagacagtctattctttta

SEQ ID NO: 44559 - DNA, 20 bp, Human papillomavirus type 201
gagacagtctattcttttat

SEQ ID NO: 44560 - DNA, 20 bp, Human papillomavirus type 201
ttttatggaaagcgagaaca

SEQ ID NO: 44561 - DNA, 20 bp, Human papillomavirus type 201
atatttcagctttgtaaaat

SEQ ID NO: 44562 - DNA, 20 bp, Human papillomavirus type 201
cagctttgtaaaattccact

SEQ ID NO: 44563 - DNA, 20 bp, Human papillomavirus type 201
agctttgtaaaattccacta

SEQ ID NO: 44564 - DNA, 20 bp, Human papillomavirus type 201
gtaaaattccactacaggct

SEQ ID NO: 44565 - DNA, 20 bp, Human papillomavirus type 201
taaaattccactacaggctg

SEQ ID NO: 44566 - DNA, 20 bp, Human papillomavirus type 201
cattgctggcagagccatat

SEQ ID NO: 44567 - DNA, 20 bp, Human papillomavirus type 201
attgctggcagagccatatt

SEQ ID NO: 44568 - DNA, 20 bp, Human papillomavirus type 201
ctggcagagccatatttgca

SEQ ID NO: 44569 - DNA, 20 bp, Human papillomavirus type 201
gcaataaatttgcacacttc

SEQ ID NO: 44570 - DNA, 20 bp, Human papillomavirus type 201
caataaatttgcacacttca

SEQ ID NO: 44571 - DNA, 20 bp, Influenza A virus
aactgtataggaaacttaag

SEQ ID NO: 44572 - DNA, 20 bp, Influenza A virus
agagggagataacgttccat

SEQ ID NO: 44573 - DNA, 20 bp, Influenza A virus
catggggccaaagaaatagc

SEQ ID NO: 44574 - DNA, 20 bp, Influenza A virus
ttctgctggtgcacttgcca

SEQ ID NO: 44575 - DNA, 20 bp, Influenza A virus
tgctggtgcacttgccagtt

SEQ ID NO: 44576 - DNA, 20 bp, Influenza A virus
ggatcttgcacttgatattg

SEQ ID NO: 44577 - DNA, 20 bp, Influenza A virus
cacttgatattgtggattct

SEQ ID NO: 44578 - DNA, 20 bp, Influenza A virus
atattgtggattcttgatcg

SEQ ID NO: 44579 - DNA, 20 bp, Influenza A virus
tggattcttgatcgtctttt

SEQ ID NO: 44580 - DNA, 20 bp, Influenza A virus
ttgatcgtctttttttcaaa

SEQ ID NO: 44581 - DNA, 20 bp, Human papillomavirus type 16
tatgtagaggctgtagtgga

SEQ ID NO: 44582 - DNA, 20 bp, Human papillomavirus type 16
atgtagaggctgtagtggaa

SEQ ID NO: 44583 - DNA, 20 bp, Human papillomavirus type 16
tgtagaggctgtagtggaaa

SEQ ID NO: 44584 - DNA, 20 bp, Human papillomavirus type 16
ggtagattttatagtaaatg

SEQ ID NO: 44585 - DNA, 20 bp, Human papillomavirus type 16
gtagattttatagtaaatga

SEQ ID NO: 44586 - DNA, 20 bp, Human papillomavirus type 16
caggtagaagggcgccatga

SEQ ID NO: 44587 - DNA, 20 bp, Human papillomavirus type 16
cagtctcatggcgcccttct

SEQ ID NO: 44588 - DNA, 20 bp, Human papillomavirus type 16
agtctcatggcgcccttcta

SEQ ID NO: 44589 - DNA, 20 bp, Human papillomavirus type 16
tacctgtaacatctgctgag

SEQ ID NO: 44590 - DNA, 20 bp, Human papillomavirus type 16
ccacttcagtattgccatac

SEQ ID NO: 44591 - DNA, 20 bp, Human papillomavirus type 16
gccaacgtttaaatgtgtgt

SEQ ID NO: 44592 - DNA, 20 bp, Human papillomavirus type 16
ccaacgtttaaatgtgtgtc

SEQ ID NO: 44593 - DNA, 20 bp, Human papillomavirus type 16
aaatgtgtgtcaggacaaaa

SEQ ID NO: 44594 - DNA, 20 bp, Human papillomavirus type 16
aatgtgtgtcaggacaaaat

SEQ ID NO: 44595 - DNA, 20 bp, Human papillomavirus type 16
tgaaaatgatagtacagacc

SEQ ID NO: 44596 - DNA, 20 bp, Human papillomavirus type 16
aagtgtatttaactgcacca

SEQ ID NO: 44597 - DNA, 20 bp, Human papillomavirus type 16
aactgcaccaacaggatgta

SEQ ID NO: 44598 - DNA, 20 bp, Human papillomavirus type 16
actgcaccaacaggatgtat

SEQ ID NO: 44599 - DNA, 20 bp, Human papillomavirus type 16
gatggagacatatgcaatac

SEQ ID NO: 44600 - DNA, 20 bp, Human papillomavirus type 16
atggagacatatgcaataca

SEQ ID NO: 44601 - DNA, 20 bp, Human papillomavirus type 16
ccccagatgtatcaggattt

SEQ ID NO: 44602 - DNA, 20 bp, Human papillomavirus type 16
agtattactacttcaactga

SEQ ID NO: 44603 - DNA, 20 bp, Human papillomavirus type 16
gtattactacttcaactgat

SEQ ID NO: 44604 - DNA, 20 bp, Human papillomavirus type 16
ctacttcaactgataccaca

SEQ ID NO: 44605 - DNA, 20 bp, Human papillomavirus type 16
aactgataccacacctgcta

SEQ ID NO: 44606 - DNA, 20 bp, Human papillomavirus type 16
cctcctgtcccagtatctaa

SEQ ID NO: 44607 - DNA, 20 bp, Human papillomavirus type 16
taagcacggatgaatatgtt

SEQ ID NO: 44608 - DNA, 20 bp, Human papillomavirus type 16
cacgcacaaacatatattat

SEQ ID NO: 44609 - DNA, 20 bp, Human papillomavirus type 16
ctgcatgataatatatgttt

SEQ ID NO: 44610 - DNA, 20 bp, Human papillomavirus type 16
gtgcgtgcaacatattcatc

SEQ ID NO: 44611 - DNA, 20 bp, Human papillomavirus type 16
tataatccagatacacagcg

SEQ ID NO: 44612 - DNA, 20 bp, Human papillomavirus type 16
ataatccagatacacagcgg

SEQ ID NO: 44613 - DNA, 20 bp, Human papillomavirus type 16
taatccagatacacagcggc

SEQ ID NO: 44614 - DNA, 20 bp, Human papillomavirus type 16
gggcctgtgtaggtgttgag

SEQ ID NO: 44615 - DNA, 20 bp, Human papillomavirus type 16
ggcctgtgtaggtgttgagg

SEQ ID NO: 44616 - DNA, 20 bp, Human papillomavirus type 16
cagtaaatccaggtgattgt

SEQ ID NO: 44617 - DNA, 20 bp, Human papillomavirus type 16
tccaccattagagttaataa

SEQ ID NO: 44618 - DNA, 20 bp, Human papillomavirus type 16
gagttaataaacacagttat

SEQ ID NO: 44619 - DNA, 20 bp, Human papillomavirus type 16
ataaacacagttattcagga

SEQ ID NO: 44620 - DNA, 20 bp, Human papillomavirus type 16
ttcaggatggtgatatggtt

SEQ ID NO: 44621 - DNA, 20 bp, Human papillomavirus type 16
gtgaaaatgtaccagacgat

SEQ ID NO: 44622 - DNA, 20 bp, Human papillomavirus type 16
atacattaaaggctctgggt

SEQ ID NO: 44623 - DNA, 20 bp, Human papillomavirus type 16
tacattaaaggctctgggtc

SEQ ID NO: 44624 - DNA, 20 bp, Human papillomavirus type 16
aaggctctgggtctactgca

SEQ ID NO: 44625 - DNA, 20 bp, Human papillomavirus type 16
agccagttcaaattattttc

SEQ ID NO: 44626 - DNA, 20 bp, Human papillomavirus type 16
ggaagtaaatttaaaggaaa

SEQ ID NO: 44627 - DNA, 20 bp, Human papillomavirus type 16
aaaggaaaagttttctgcag

SEQ ID NO: 44628 - DNA, 20 bp, Human papillomavirus type 16
aaggaaaagttttctgcaga

SEQ ID NO: 44629 - DNA, 20 bp, Human papillomavirus type 16
tctgcagacctagatcagtt

SEQ ID NO: 44630 - DNA, 20 bp, Human papillomavirus type 16
ctgcagacctagatcagttt

SEQ ID NO: 44631 - DNA, 20 bp, Human papillomavirus type 16
gcacaaaatgtgttttttta

SEQ ID NO: 44632 - DNA, 20 bp, Human papillomavirus type 16
ttttaaatagttctatgtca

SEQ ID NO: 44633 - DNA, 20 bp, Human papillomavirus type 16
tttaaatagttctatgtcag

SEQ ID NO: 44634 - DNA, 20 bp, Human papillomavirus type 16
ttaaatagttctatgtcagc

SEQ ID NO: 44635 - DNA, 20 bp, Human papillomavirus type 16
taaatagttctatgtcagca

SEQ ID NO: 44636 - DNA, 20 bp, Human papillomavirus type 16
caggacccacaggagcgacc

SEQ ID NO: 44637 - DNA, 20 bp, Human papillomavirus type 16
aggacccacaggagcgaccc

SEQ ID NO: 44638 - DNA, 20 bp, Human papillomavirus type 16
ccacagttatgcacagagct

SEQ ID NO: 44639 - DNA, 20 bp, Human papillomavirus type 16
tgcacagagctgcaaacaac

SEQ ID NO: 44640 - DNA, 20 bp, Human papillomavirus type 16
gaatgtgtgtactgcaagca

SEQ ID NO: 44641 - DNA, 20 bp, Human papillomavirus type 16
cataatataaggggtcggtg

SEQ ID NO: 44642 - DNA, 20 bp, Human papillomavirus type 16
tattatggaatctttgcttt

SEQ ID NO: 44643 - DNA, 20 bp, Human papillomavirus type 16
tggaatctttgctttttgtc

SEQ ID NO: 44644 - DNA, 20 bp, Human papillomavirus type 16
gctttttgtccagatgtctt

SEQ ID NO: 44645 - DNA, 20 bp, Human papillomavirus type 16
ctttttgtccagatgtcttt

SEQ ID NO: 44646 - DNA, 20 bp, Human papillomavirus type 16
caatattgtaaccttttgtt

SEQ ID NO: 44647 - DNA, 20 bp, Human papillomavirus type 16
taaccttttgttgcaagtgt

SEQ ID NO: 44648 - DNA, 20 bp, Human papillomavirus type 16
tgttgcaagtgtgactctac

SEQ ID NO: 44649 - DNA, 20 bp, Human papillomavirus type 16
gttgcaagtgtgactctacg

SEQ ID NO: 44650 - DNA, 20 bp, Human papillomavirus type 16
ttgcaagtgtgactctacgc

SEQ ID NO: 44651 - DNA, 20 bp, Influenza A virus
cggaaaaggcaatgaaagaa

SEQ ID NO: 44652 - DNA, 20 bp, Influenza A virus
gcatcaatatgcacacactt

SEQ ID NO: 44653 - DNA, 20 bp, Influenza A virus
gaagtctgcttcatgtactc

SEQ ID NO: 44654 - DNA, 20 bp, Influenza A virus
atgtactctgatttccactt

SEQ ID NO: 44655 - DNA, 20 bp, Influenza A virus
gtcgatgaagtggaaatcag

SEQ ID NO: 44656 - DNA, 20 bp, Influenza A virus
ctcccggatctgtatgacta

SEQ ID NO: 44657 - DNA, 20 bp, Influenza A virus
tcccggatctgtatgactac

SEQ ID NO: 44658 - DNA, 20 bp, Influenza A virus
cattgaaattggagtgacga

SEQ ID NO: 44659 - DNA, 20 bp, Influenza A virus
attgaaattggagtgacgag

SEQ ID NO: 44660 - DNA, 20 bp, Influenza A virus
aaattggagtgacgaggagg

SEQ ID NO: 44661 - DNA, 20 bp, Influenza A virus
aggacattgaaaatgaagag

SEQ ID NO: 44662 - DNA, 20 bp, Influenza A virus
aaaatgaagagaagattcca

SEQ ID NO: 44663 - DNA, 20 bp, Influenza A virus
caaggacaaagaacatgaag

SEQ ID NO: 44664 - DNA, 20 bp, Influenza A virus
aagtgggcactcggtgagaa

SEQ ID NO: 44665 - DNA, 20 bp, Influenza A virus
tccggtgccatgttctcacc

SEQ ID NO: 44666 - DNA, 20 bp, Influenza A virus
ccccaatcgaacacattgca

SEQ ID NO: 44667 - DNA, 20 bp, Influenza A virus
caagcatgagacggaactat

SEQ ID NO: 44668 - DNA, 20 bp, Influenza A virus
tacagcagaggtgtcccact

SEQ ID NO: 44669 - DNA, 20 bp, Influenza A virus
acagcagaggtgtcccactg

SEQ ID NO: 44670 - DNA, 20 bp, Influenza A virus
cagcagaggtgtcccactgc

SEQ ID NO: 44671 - DNA, 20 bp, Influenza A virus
gtaagtatggaattttccct

SEQ ID NO: 44672 - DNA, 20 bp, Influenza A virus
taagtatggaattttccctt

SEQ ID NO: 44673 - DNA, 20 bp, Influenza A virus
tcccttaccgacccaaggtt

SEQ ID NO: 44674 - DNA, 20 bp, Influenza A virus
cccttaccgacccaaggttg

SEQ ID NO: 44675 - DNA, 20 bp, Influenza A virus
ccttaccgacccaaggttgg

SEQ ID NO: 44676 - DNA, 20 bp, Influenza A virus
tttgaaaacaaatcagaaac

SEQ ID NO: 44677 - DNA, 20 bp, Influenza A virus
gaaaacaaatcagaaacatg

SEQ ID NO: 44678 - DNA, 20 bp, Influenza A virus
aaaacaaatcagaaacatgg

SEQ ID NO: 44679 - DNA, 20 bp, Influenza A virus
gagagtcacctaaaggagtg

SEQ ID NO: 44680 - DNA, 20 bp, Influenza A virus
ccgatggaaccttcctccac

SEQ ID NO: 44681 - DNA, 20 bp, Influenza A virus
aatgtaagtgctcttattag

SEQ ID NO: 44682 - DNA, 20 bp, Influenza A virus
ttaggtagctccttttgttc

SEQ ID NO: 44683 - DNA, 20 bp, Influenza A virus
ggtagctccttttgttcagt

SEQ ID NO: 44684 - DNA, 20 bp, Influenza A virus
tgttcagtctttgttttttc

SEQ ID NO: 44685 - DNA, 20 bp, Influenza A virus
gttcagtctttgttttttct

SEQ ID NO: 44686 - DNA, 20 bp, Influenza A virus
agcaatctggcctccctgtc

SEQ ID NO: 44687 - DNA, 20 bp, Influenza A virus
gcaaatgttgtgaggaagat

SEQ ID NO: 44688 - DNA, 20 bp, Influenza A virus
tgaggaagatgatgactaat

SEQ ID NO: 44689 - DNA, 20 bp, Influenza A virus
tgaattagtcatcatcttcc

SEQ ID NO: 44690 - DNA, 20 bp, Influenza A virus
gtcatcatcttcctcacaac

SEQ ID NO: 44691 - DNA, 20 bp, Influenza A virus
ggaaaagggtacatgttcga

SEQ ID NO: 44692 - DNA, 20 bp, Influenza A virus
gaaagtaagagtatgaagtt

SEQ ID NO: 44693 - DNA, 20 bp, Influenza A virus
cggacacaagtaccagcgga

SEQ ID NO: 44694 - DNA, 20 bp, Influenza A virus
caggtcaatatttgcgagca

SEQ ID NO: 44695 - DNA, 20 bp, Influenza A virus
aggtcaatatttgcgagcat

SEQ ID NO: 44696 - DNA, 20 bp, Influenza A virus
gtgggacggactccaatcct

SEQ ID NO: 44697 - DNA, 20 bp, Influenza A virus
gccctcatagtgaatgcacc

SEQ ID NO: 44698 - DNA, 20 bp, Influenza A virus
cctcatgattcggtgcattc

SEQ ID NO: 44699 - DNA, 20 bp, Influenza A virus
ggtgcattcactatgagggc

SEQ ID NO: 44700 - DNA, 20 bp, Influenza A virus
actatgagggcgaagtcatc

SEQ ID NO: 44701 - DNA, 20 bp, Influenza A virus
gtgttacagtaataaagaac

SEQ ID NO: 44702 - DNA, 20 bp, Influenza A virus
cagtaataaagaacaatatg

SEQ ID NO: 44703 - DNA, 20 bp, Influenza A virus
gaccagcaacagcccaaatg

SEQ ID NO: 44704 - DNA, 20 bp, Influenza A virus
agctatttatcaaagactac

SEQ ID NO: 44705 - DNA, 20 bp, Influenza A virus
atcaaagactacagatacac

SEQ ID NO: 44706 - DNA, 20 bp, Influenza A virus
cagaggtctgcttgaaatgg

SEQ ID NO: 44707 - DNA, 20 bp, Influenza A virus
aaatgggaattgatggatga

SEQ ID NO: 44708 - DNA, 20 bp, Influenza A virus
atggatgaagactaccaagg

SEQ ID NO: 44709 - DNA, 20 bp, Influenza A virus
tgtaatcctatgaacccgtt

SEQ ID NO: 44710 - DNA, 20 bp, Influenza A virus
ataggattacacaacctgcc

SEQ ID NO: 44711 - DNA, 20 bp, Human papillomavirus type 63
ccagctttttccttataaaa

SEQ ID NO: 44712 - DNA, 20 bp, Human papillomavirus type 63
ttccttataaaactctggtg

SEQ ID NO: 44713 - DNA, 20 bp, Human papillomavirus type 63
tccttataaaactctggtgg

SEQ ID NO: 44714 - DNA, 20 bp, Human papillomavirus type 63
ccttataaaactctggtggg

SEQ ID NO: 44715 - DNA, 20 bp, Human papillomavirus type 63
cttataaaactctggtggga

SEQ ID NO: 44716 - DNA, 20 bp, Human papillomavirus type 63
gtctgcttgagtttatgctt

SEQ ID NO: 44717 - DNA, 20 bp, Human papillomavirus type 63
agtttatgctttattatcag

SEQ ID NO: 44718 - DNA, 20 bp, Human papillomavirus type 63
atgctttattatcaggagtc

SEQ ID NO: 44719 - DNA, 20 bp, Human papillomavirus type 63
tgctttattatcaggagtct

SEQ ID NO: 44720 - DNA, 20 bp, Human papillomavirus type 63
attatcaggagtctttcgag

SEQ ID NO: 44721 - DNA, 20 bp, Human papillomavirus type 63
ggtgagtcaagaagaaccaa

SEQ ID NO: 44722 - DNA, 20 bp, Human papillomavirus type 63
gtgagtcaagaagaaccaag

SEQ ID NO: 44723 - DNA, 20 bp, Human papillomavirus type 63
ttatgaggatatacctgctg

SEQ ID NO: 44724 - DNA, 20 bp, Human papillomavirus type 63
tgaggatatacctgctgagg

SEQ ID NO: 44725 - DNA, 20 bp, Human papillomavirus type 63
tgcttccttgtggtttgtgc

SEQ ID NO: 44726 - DNA, 20 bp, Human papillomavirus type 63
gtatattgtggatgaggcag

SEQ ID NO: 44727 - DNA, 20 bp, Human papillomavirus type 63
tggatgaggcagaatgtcgg

SEQ ID NO: 44728 - DNA, 20 bp, Human papillomavirus type 63
gaggatttggaggacaccta

SEQ ID NO: 44729 - DNA, 20 bp, Human papillomavirus type 63
ggaggacacctataattcat

SEQ ID NO: 44730 - DNA, 20 bp, Human papillomavirus type 63
gaggacacctataattcatt

SEQ ID NO: 44731 - DNA, 20 bp, Human papillomavirus type 63
aacagtcctccgcaggcaag

SEQ ID NO: 44732 - DNA, 20 bp, Human papillomavirus type 63
gaatctataacaatttcgca

SEQ ID NO: 44733 - DNA, 20 bp, Human papillomavirus type 63
ttatagattccaatctggga

SEQ ID NO: 44734 - DNA, 20 bp, Human papillomavirus type 63
tagattccaatctgggactg

SEQ ID NO: 44735 - DNA, 20 bp, Human papillomavirus type 63
caatctgggactgaggctat

SEQ ID NO: 44736 - DNA, 20 bp, Human papillomavirus type 63
tgaaatgcagtaatacaaga

SEQ ID NO: 44737 - DNA, 20 bp, Human papillomavirus type 63
gaaatgcagtaatacaagat

SEQ ID NO: 44738 - DNA, 20 bp, Human papillomavirus type 63
aaatgcagtaatacaagatc

SEQ ID NO: 44739 - DNA, 20 bp, Human papillomavirus type 63
ccaaatttaaagacacagta

SEQ ID NO: 44740 - DNA, 20 bp, Human papillomavirus type 63
aaagacacagtaggtgtcag

SEQ ID NO: 44741 - DNA, 20 bp, Human papillomavirus type 63
gaaatctttttttgaaaggt

SEQ ID NO: 44742 - DNA, 20 bp, Human papillomavirus type 63
ttttgaaaggttttggagcc

SEQ ID NO: 44743 - DNA, 20 bp, Human papillomavirus type 63
tttgaaaggttttggagcca

SEQ ID NO: 44744 - DNA, 20 bp, Human papillomavirus type 63
ttgaaaggttttggagccag

SEQ ID NO: 44745 - DNA, 20 bp, Human papillomavirus type 63
tgaaaggttttggagccagt

SEQ ID NO: 44746 - DNA, 20 bp, Human papillomavirus type 63
cagcttcccaggataaagca

SEQ ID NO: 44747 - DNA, 20 bp, Human papillomavirus type 63
ccaggataaagcaaaaacag

SEQ ID NO: 44748 - DNA, 20 bp, Human papillomavirus type 63
atcttagtggcctcagagac

SEQ ID NO: 44749 - DNA, 20 bp, Human papillomavirus type 63
tcttagtggcctcagagact

SEQ ID NO: 44750 - DNA, 20 bp, Human papillomavirus type 63
gtggcctcagagactcacaa

SEQ ID NO: 44751 - DNA, 20 bp, Human papillomavirus type 63
gcaagcgacggccctacgga

SEQ ID NO: 44752 - DNA, 20 bp, Human papillomavirus type 63
tggaccttcttcgtccgtag

SEQ ID NO: 44753 - DNA, 20 bp, Human papillomavirus type 63
ttcgtccgtagggccgtcgc

SEQ ID NO: 44754 - DNA, 20 bp, Human papillomavirus type 63
gtccgtagggccgtcgcttg

SEQ ID NO: 44755 - DNA, 20 bp, Human papillomavirus type 63
cgaacagccggcgatttcgg

SEQ ID NO: 44756 - DNA, 20 bp, Human papillomavirus type 63
gacggttcctaagggtgggt

SEQ ID NO: 44757 - DNA, 20 bp, Human papillomavirus type 63
acggttcctaagggtgggtg

SEQ ID NO: 44758 - DNA, 20 bp, Human papillomavirus type 63
ctaagggtgggtgttggggt

SEQ ID NO: 44759 - DNA, 20 bp, Human papillomavirus type 63
gggtatattttgtaatcatg

SEQ ID NO: 44760 - DNA, 20 bp, Human papillomavirus type 63
tgtaatcatgttaagagtac

SEQ ID NO: 44761 - DNA, 20 bp, Human papillomavirus type 63
atattccacaagaaagtcct

SEQ ID NO: 44762 - DNA, 20 bp, Human papillomavirus type 63
cacaagaaagtcctgctgca

SEQ ID NO: 44763 - DNA, 20 bp, Human papillomavirus type 63
ccaatacaataatcctttat

SEQ ID NO: 44764 - DNA, 20 bp, Human papillomavirus type 63
attcaggatcacagctagtg

SEQ ID NO: 44765 - DNA, 20 bp, Human papillomavirus type 63
ttcaggatcacagctagtgc

SEQ ID NO: 44766 - DNA, 20 bp, Human papillomavirus type 63
ctataatagacgctattatg

SEQ ID NO: 44767 - DNA, 20 bp, Human papillomavirus type 63
tataatagacgctattatga

SEQ ID NO: 44768 - DNA, 20 bp, Human papillomavirus type 63
tgaacaagtgccagttactg

SEQ ID NO: 44769 - DNA, 20 bp, Human papillomavirus type 63
ctgcacctgaatttatcaca

SEQ ID NO: 44770 - DNA, 20 bp, Human papillomavirus type 63
tgataaattcaggtgcagta

SEQ ID NO: 44771 - DNA, 20 bp, Human papillomavirus type 63
tatatggatattagctctat

SEQ ID NO: 44772 - DNA, 20 bp, Human papillomavirus type 63
atatggatattagctctatc

SEQ ID NO: 44773 - DNA, 20 bp, Human papillomavirus type 63
tatggatattagctctatct

SEQ ID NO: 44774 - DNA, 20 bp, Human papillomavirus type 63
gctctatctcctcaaatgat

SEQ ID NO: 44775 - DNA, 20 bp, Human papillomavirus type 63
agttacaaacactgggtgaa

SEQ ID NO: 44776 - DNA, 20 bp, Human papillomavirus type 63
tgatttacatccaagtttgc

SEQ ID NO: 44777 - DNA, 20 bp, Human papillomavirus type 63
acatccaagtttgcgtaaac

SEQ ID NO: 44778 - DNA, 20 bp, Human papillomavirus type 63
catccaagtttgcgtaaacg

SEQ ID NO: 44779 - DNA, 20 bp, Human papillomavirus type 63
gcgtaaacgtcgcaaattag

SEQ ID NO: 44780 - DNA, 20 bp, Human papillomavirus type 63
cgtaaacgtcgcaaattagt

SEQ ID NO: 44781 - DNA, 20 bp, Human papillomavirus type 63
ctccaaatcagtatagagtc

SEQ ID NO: 44782 - DNA, 20 bp, Human papillomavirus type 63
tccaaatcagtatagagtct

SEQ ID NO: 44783 - DNA, 20 bp, Human papillomavirus type 63
cgtgttagatttccagatcc

SEQ ID NO: 44784 - DNA, 20 bp, Human papillomavirus type 63
gtgttagatttccagatcct

SEQ ID NO: 44785 - DNA, 20 bp, Human papillomavirus type 63
gatttccagatcctaaccga

SEQ ID NO: 44786 - DNA, 20 bp, Human papillomavirus type 63
ctaattggctgtacaccagc

SEQ ID NO: 44787 - DNA, 20 bp, Human papillomavirus type 63
taattggctgtacaccagcc

SEQ ID NO: 44788 - DNA, 20 bp, Human papillomavirus type 63
gctgtacaccagccactggg

SEQ ID NO: 44789 - DNA, 20 bp, Human papillomavirus type 63
cagcttggagattgtcctcc

SEQ ID NO: 44790 - DNA, 20 bp, Human papillomavirus type 63
agcttggagattgtcctcct

SEQ ID NO: 44791 - DNA, 20 bp, Human papillomavirus type 63
ttgtatcaaagtggtcttgc

SEQ ID NO: 44792 - DNA, 20 bp, Human papillomavirus type 63
tgtatcaaagtggtcttgca

SEQ ID NO: 44793 - DNA, 20 bp, Human papillomavirus type 63
gtatcaaagtggtcttgcac

SEQ ID NO: 44794 - DNA, 20 bp, Human papillomavirus type 63
tatcaaagtggtcttgcaca

SEQ ID NO: 44795 - DNA, 20 bp, Human papillomavirus type 63
cacagcgttctgttccaaaa

SEQ ID NO: 44796 - DNA, 20 bp, Human papillomavirus type 63
acctgtcttcgagtcattat

SEQ ID NO: 44797 - DNA, 20 bp, Human papillomavirus type 63
cctgtcttcgagtcattatt

SEQ ID NO: 44798 - DNA, 20 bp, Human papillomavirus type 63
gagtcattattgcctagtca

SEQ ID NO: 44799 - DNA, 20 bp, Human papillomavirus type 63
ttgcctagtcatatagcctc

SEQ ID NO: 44800 - DNA, 20 bp, Human papillomavirus type 63
cctagtcatatagcctcatg

SEQ ID NO: 44801 - DNA, 20 bp, Influenza A virus
gtggaatcgggagattctac

SEQ ID NO: 44802 - DNA, 20 bp, Influenza A virus
tacatccaaatgtgcactga

SEQ ID NO: 44803 - DNA, 20 bp, Influenza A virus
ggatgtagaatctcccgatt

SEQ ID NO: 44804 - DNA, 20 bp, Influenza A virus
gatgtagaatctcccgattc

SEQ ID NO: 44805 - DNA, 20 bp, Influenza A virus
caccaatcattcttccgaca

SEQ ID NO: 44806 - DNA, 20 bp, Influenza A virus
ctggaggggtgaaaatggac

SEQ ID NO: 44807 - DNA, 20 bp, Influenza A virus
tggaggggtgaaaatggacg

SEQ ID NO: 44808 - DNA, 20 bp, Influenza A virus
cttatgaaagaatgtgcaat

SEQ ID NO: 44809 - DNA, 20 bp, Influenza A virus
tgaaagaatgtgcaatatcc

SEQ ID NO: 44810 - DNA, 20 bp, Influenza A virus
cacattctttcataagcaac

SEQ ID NO: 44811 - DNA, 20 bp, Influenza A virus
tgtgtatgggcttgcagtag

SEQ ID NO: 44812 - DNA, 20 bp, Influenza A virus
cagtagcaagtgggcatgac

SEQ ID NO: 44813 - DNA, 20 bp, Influenza A virus
gaaagggaagggtactcact

SEQ ID NO: 44814 - DNA, 20 bp, Influenza A virus
aaagggaagggtactcactg

SEQ ID NO: 44815 - DNA, 20 bp, Influenza A virus
gaatgggtctatcccgacca

SEQ ID NO: 44816 - DNA, 20 bp, Influenza A virus
caagaggaaagctttccaca

SEQ ID NO: 44817 - DNA, 20 bp, Influenza A virus
ccacaagaggggtccagatt

SEQ ID NO: 44818 - DNA, 20 bp, Influenza A virus
cacaagaggggtccagattg

SEQ ID NO: 44819 - DNA, 20 bp, Influenza A virus
cttcaaatgagaatgtggaa

SEQ ID NO: 44820 - DNA, 20 bp, Influenza A virus
aaatgagaatgtggaaacca

SEQ ID NO: 44821 - DNA, 20 bp, Influenza A virus
caaaggagacgtttttgtca

SEQ ID NO: 44822 - DNA, 20 bp, Influenza A virus
ttgtcataagagagcccttt

SEQ ID NO: 44823 - DNA, 20 bp, Influenza A virus
tgtcataagagagcccttta

SEQ ID NO: 44824 - DNA, 20 bp, Influenza A virus
gtcataagagagccctttat

SEQ ID NO: 44825 - DNA, 20 bp, Influenza A virus
tcataagagagccctttatt

SEQ ID NO: 44826 - DNA, 20 bp, Influenza A virus
caggtccagataatggagca

SEQ ID NO: 44827 - DNA, 20 bp, Influenza A virus
aggtccagataatggagcag

SEQ ID NO: 44828 - DNA, 20 bp, Influenza A virus
aaatacaacggcataataac

SEQ ID NO: 44829 - DNA, 20 bp, Influenza A virus
gaggaagaaaatattgagga

SEQ ID NO: 44830 - DNA, 20 bp, Influenza A virus
aggacacaagagtctgaatg

SEQ ID NO: 44831 - DNA, 20 bp, Influenza A virus
ctgttaccctgataccggca

SEQ ID NO: 44832 - DNA, 20 bp, Influenza A virus
ccctgataccggcaaagtga

SEQ ID NO: 44833 - DNA, 20 bp, Influenza A virus
gcatggttcgaaccggccat

SEQ ID NO: 44834 - DNA, 20 bp, Influenza A virus
gaaccggccatgggtgtctt

SEQ ID NO: 44835 - DNA, 20 bp, Influenza A virus
tgatcgaaagacacccatgg

SEQ ID NO: 44836 - DNA, 20 bp, Influenza A virus
cagacatgggtttgagatga

SEQ ID NO: 44837 - DNA, 20 bp, Influenza A virus
gagatgatttgggatcctaa

SEQ ID NO: 44838 - DNA, 20 bp, Influenza A virus
agatgatttgggatcctaat

SEQ ID NO: 44839 - DNA, 20 bp, Influenza A virus
gggatcctaatggatggaca

SEQ ID NO: 44840 - DNA, 20 bp, Influenza A virus
ggatcctaatggatggacag

SEQ ID NO: 44841 - DNA, 20 bp, Influenza A virus
ccttgaagaatcccacccag

SEQ ID NO: 44842 - DNA, 20 bp, Influenza A virus
cttgaagaatcccacccagg

SEQ ID NO: 44843 - DNA, 20 bp, Influenza A virus
aagaatcccacccagggatc

SEQ ID NO: 44844 - DNA, 20 bp, Influenza A virus
gaaaactcgtgtcttgaaac

SEQ ID NO: 44845 - DNA, 20 bp, Influenza A virus
aaaactcgtgtcttgaaacg

SEQ ID NO: 44846 - DNA, 20 bp, Influenza A virus
agcaatctggactccccgtc

SEQ ID NO: 44847 - DNA, 20 bp, Influenza A virus
gcaaatgtcgtgaggaagat

SEQ ID NO: 44848 - DNA, 20 bp, Influenza A virus
tgagttagtcatcatcttcc

SEQ ID NO: 44849 - DNA, 20 bp, Influenza A virus
gtcatcatcttcctcacgac

SEQ ID NO: 44850 - DNA, 20 bp, Influenza A virus
ctcacgacatttgccaattt

SEQ ID NO: 44851 - DNA, 20 bp, Influenza A virus
ctcctataatgttctcaaac

SEQ ID NO: 44852 - DNA, 20 bp, Influenza A virus
tcaaacaagatggcaagatt

SEQ ID NO: 44853 - DNA, 20 bp, Influenza A virus
gggaaaggatacatgttcga

SEQ ID NO: 44854 - DNA, 20 bp, Influenza A virus
gaaagtaagagcatgaagct

SEQ ID NO: 44855 - DNA, 20 bp, Influenza A virus
ctgctggtatttgtgtccgt

SEQ ID NO: 44856 - DNA, 20 bp, Influenza A virus
ggcagaagaggtacaccaaa

SEQ ID NO: 44857 - DNA, 20 bp, Influenza A virus
cgctctcatagtgaatgcac

SEQ ID NO: 44858 - DNA, 20 bp, Influenza A virus
gctctcatagtgaatgcacc

SEQ ID NO: 44859 - DNA, 20 bp, Influenza A virus
ggtgcattcactatgagagc

SEQ ID NO: 44860 - DNA, 20 bp, Influenza A virus
gtgcattcactatgagagcg

SEQ ID NO: 44861 - DNA, 20 bp, Influenza A virus
ggagtgtctgggattaatga

SEQ ID NO: 44862 - DNA, 20 bp, Influenza A virus
gagtgtctgggattaatgaa

SEQ ID NO: 44863 - DNA, 20 bp, Influenza A virus
atgaatcggctgacatgagc

SEQ ID NO: 44864 - DNA, 20 bp, Influenza A virus
gtgttacagtgataaagaac

SEQ ID NO: 44865 - DNA, 20 bp, Influenza A virus
cagtgataaagaacaatatg

SEQ ID NO: 44866 - DNA, 20 bp, Human papillomavirus 18
gaggatccaacacggcgacc

SEQ ID NO: 44867 - DNA, 20 bp, Human papillomavirus 18
aggatccaacacggcgaccc

SEQ ID NO: 44868 - DNA, 20 bp, Human papillomavirus 18
cgtgcacagatcaggtagct

SEQ ID NO: 44869 - DNA, 20 bp, Human papillomavirus 18
tagggtcgccgtgttggatc

SEQ ID NO: 44870 - DNA, 20 bp, Human papillomavirus 18
gatcctcaaagcgcgccata

SEQ ID NO: 44871 - DNA, 20 bp, Human papillomavirus 18
ttattctagaattagagaat

SEQ ID NO: 44872 - DNA, 20 bp, Human papillomavirus 18
tattctagaattagagaatt

SEQ ID NO: 44873 - DNA, 20 bp, Human papillomavirus 18
attctagaattagagaatta

SEQ ID NO: 44874 - DNA, 20 bp, Human papillomavirus 18
ttctagaattagagaattaa

SEQ ID NO: 44875 - DNA, 20 bp, Human papillomavirus 18
tagaattagagaattaagac

SEQ ID NO: 44876 - DNA, 20 bp, Human papillomavirus 18
caagacattgtattgcattt

SEQ ID NO: 44877 - DNA, 20 bp, Human papillomavirus 18
tattgcatttagagccccaa

SEQ ID NO: 44878 - DNA, 20 bp, Human papillomavirus 18
catttagagccccaaaatga

SEQ ID NO: 44879 - DNA, 20 bp, Human papillomavirus 18
agagccccaaaatgaaattc

SEQ ID NO: 44880 - DNA, 20 bp, Human papillomavirus 18
gagccccaaaatgaaattcc

SEQ ID NO: 44881 - DNA, 20 bp, Human papillomavirus 18
ttccatgcgcaggaggtcca

SEQ ID NO: 44882 - DNA, 20 bp, Human papillomavirus 18
catgcgcaggaggtccacaa

SEQ ID NO: 44883 - DNA, 20 bp, Human papillomavirus 18
catgttttaaaacgaaagtt

SEQ ID NO: 44884 - DNA, 20 bp, Human papillomavirus 18
taaaacgaaagtttgcagga

SEQ ID NO: 44885 - DNA, 20 bp, Human papillomavirus 18
aaaacgaaagtttgcaggag

SEQ ID NO: 44886 - DNA, 20 bp, Human papillomavirus 18
aggtaactacaaatggcgaa

SEQ ID NO: 44887 - DNA, 20 bp, Human papillomavirus 18
ttgccctctgtgcccccgtt

SEQ ID NO: 44888 - DNA, 20 bp, Human papillomavirus 18
ccctctgtgcccccgttgtc

SEQ ID NO: 44889 - DNA, 20 bp, Human papillomavirus 18
tctatagcctccgtactgcc

SEQ ID NO: 44890 - DNA, 20 bp, Human papillomavirus 18
ccgccatgttcgccatttgt

SEQ ID NO: 44891 - DNA, 20 bp, Human papillomavirus 18
taggcgagcccaaaaacgac

SEQ ID NO: 44892 - DNA, 20 bp, Human papillomavirus 18
agatgttcaaaaatagatga

SEQ ID NO: 44893 - DNA, 20 bp, Human papillomavirus 18
gatgttcaaaaatagatgaa

SEQ ID NO: 44894 - DNA, 20 bp, Human papillomavirus 18
aaaaatagatgaagggggag

SEQ ID NO: 44895 - DNA, 20 bp, Human papillomavirus 18
gagaccaatagtgcaattcc

SEQ ID NO: 44896 - DNA, 20 bp, Human papillomavirus 18
gcaactaatacgttgggaaa

SEQ ID NO: 44897 - DNA, 20 bp, Human papillomavirus 18
ggaaaatgcaatattctttg

SEQ ID NO: 44898 - DNA, 20 bp, Human papillomavirus 18
tttgcagcaagggaacatgg

SEQ ID NO: 44899 - DNA, 20 bp, Human papillomavirus 18
gcagcaagggaacatggcat

SEQ ID NO: 44900 - DNA, 20 bp, Human papillomavirus 18
cagcaagggaacatggcata

SEQ ID NO: 44901 - DNA, 20 bp, Human papillomavirus 18
tatgactgatgcaggaacat

SEQ ID NO: 44902 - DNA, 20 bp, Human papillomavirus 18
acataatacaatcccctgtg

SEQ ID NO: 44903 - DNA, 20 bp, Human papillomavirus 18
cataatacaatcccctgtga

SEQ ID NO: 44904 - DNA, 20 bp, Human papillomavirus 18
cacaggtagcggttttgtcc

SEQ ID NO: 44905 - DNA, 20 bp, Human papillomavirus 18
tgtcccatgttcctgcatca

SEQ ID NO: 44906 - DNA, 20 bp, Human papillomavirus 18
ttaaacagctacagcacacc

SEQ ID NO: 44907 - DNA, 20 bp, Human papillomavirus 18
aacagctacagcacaccccc

SEQ ID NO: 44908 - DNA, 20 bp, Human papillomavirus 18
cagcaccgtgtccgtgggca

SEQ ID NO: 44909 - DNA, 20 bp, Human papillomavirus 18
gcggtgcccacggacacggt

SEQ ID NO: 44910 - DNA, 20 bp, Human papillomavirus 18
cggtgcccacggacacggtg

SEQ ID NO: 44911 - DNA, 20 bp, Human papillomavirus 18
cgaaaacatagcgaccacta

SEQ ID NO: 44912 - DNA, 20 bp, Human papillomavirus 18
gacaggtgcaggcaatgaaa

SEQ ID NO: 44913 - DNA, 20 bp, Human papillomavirus 18
cagtcagtattcctgttttt

SEQ ID NO: 44914 - DNA, 20 bp, Human papillomavirus 18
ctgttttttcattgcctgca

SEQ ID NO: 44915 - DNA, 20 bp, Human papillomavirus 18
tttcattgcctgcacctgtc

SEQ ID NO: 44916 - DNA, 20 bp, Human papillomavirus 18
tgccatctgtctgtatgtgt

SEQ ID NO: 44917 - DNA, 20 bp, Human papillomavirus 18
gccatctgtctgtatgtgtg

SEQ ID NO: 44918 - DNA, 20 bp, Human papillomavirus 18
ccatctgtctgtatgtgtgc

SEQ ID NO: 44919 - DNA, 20 bp, Human papillomavirus 18
gtatttgtgtatattgtggt

SEQ ID NO: 44920 - DNA, 20 bp, Human papillomavirus 18
gtgtatattgtggtaataac

SEQ ID NO: 44921 - DNA, 20 bp, Human papillomavirus 18
gagcctgtggacactacatt

SEQ ID NO: 44922 - DNA, 20 bp, Human papillomavirus 18
agcctgtggacactacatta

SEQ ID NO: 44923 - DNA, 20 bp, Human papillomavirus 18
acatttgatcctcgtagtga

SEQ ID NO: 44924 - DNA, 20 bp, Human papillomavirus 18
gatcctcgtagtgatgttcc

SEQ ID NO: 44925 - DNA, 20 bp, Human papillomavirus 18
atcctcgtagtgatgttcct

SEQ ID NO: 44926 - DNA, 20 bp, Human papillomavirus 18
tttgatatatatgcagatga

SEQ ID NO: 44927 - DNA, 20 bp, Human papillomavirus 18
gatatatatgcagatgacat

SEQ ID NO: 44928 - DNA, 20 bp, Human papillomavirus 18
atatatatgcagatgacatg

SEQ ID NO: 44929 - DNA, 20 bp, Human papillomavirus 18
tactacctcctttgcatttt

SEQ ID NO: 44930 - DNA, 20 bp, Human papillomavirus 18
aaaaaatgcaaaggaggtag

SEQ ID NO: 44931 - DNA, 20 bp, Human papillomavirus 18
taagcagacacagttatgta

SEQ ID NO: 44932 - DNA, 20 bp, Human papillomavirus 18
tgtattttgggctgtgcccc

SEQ ID NO: 44933 - DNA, 20 bp, Human papillomavirus 18
tgggctgtgcccctgctatt

SEQ ID NO: 44934 - DNA, 20 bp, Human papillomavirus 18
gggctgtgcccctgctattg

SEQ ID NO: 44935 - DNA, 20 bp, Human papillomavirus 18
ggctgtgcccctgctattgg

SEQ ID NO: 44936 - DNA, 20 bp, Human papillomavirus 18
cttacggcgtgagcagcttt

SEQ ID NO: 44937 - DNA, 20 bp, Human papillomavirus 18
cggcgtgagcagctttttgc

SEQ ID NO: 44938 - DNA, 20 bp, Human papillomavirus 18
ttgctaggcatttttggaat

SEQ ID NO: 44939 - DNA, 20 bp, Human papillomavirus 18
tgctaggcatttttggaata

SEQ ID NO: 44940 - DNA, 20 bp, Human papillomavirus 18
gctaggcatttttggaatag

SEQ ID NO: 44941 - DNA, 20 bp, Human papillomavirus 18
tttgttactgtggtagatac

SEQ ID NO: 44942 - DNA, 20 bp, Human papillomavirus 18
gttactgtggtagataccac

SEQ ID NO: 44943 - DNA, 20 bp, Human papillomavirus 18
ttactgtggtagataccact

SEQ ID NO: 44944 - DNA, 20 bp, Human papillomavirus 18
ctgtggtagataccactccc

SEQ ID NO: 44945 - DNA, 20 bp, Human papillomavirus 18
aacaatatgtgcttctacac

SEQ ID NO: 44946 - DNA, 20 bp, Human papillomavirus 18
cttgttgggctatatattgt

SEQ ID NO: 44947 - DNA, 20 bp, Human papillomavirus 18
ttgggctatatattgtcctg

SEQ ID NO: 44948 - DNA, 20 bp, Human papillomavirus 18
ggctatatattgtcctgtat

SEQ ID NO: 44949 - DNA, 20 bp, Human papillomavirus 18
tcctgtatttcaagttataa

SEQ ID NO: 44950 - DNA, 20 bp, Human papillomavirus 18
caagttataaaactgcacac

SEQ ID NO: 44951 - DNA, 20 bp, Influenza A virus
cttttcttaaaagtgccagc

SEQ ID NO: 44952 - DNA, 20 bp, Influenza A virus
tcttaaaagtgccagcacaa

SEQ ID NO: 44953 - DNA, 20 bp, Influenza A virus
cttaaaagtgccagcacaaa

SEQ ID NO: 44954 - DNA, 20 bp, Influenza A virus
ttaaaagtgccagcacaaaa

SEQ ID NO: 44955 - DNA, 20 bp, Influenza A virus
aaagtgccagcacaaaatgc

SEQ ID NO: 44956 - DNA, 20 bp, Influenza A virus
ccttgaggaatcccatcctg

SEQ ID NO: 44957 - DNA, 20 bp, Influenza A virus
cttgaggaatcccatcctgg

SEQ ID NO: 44958 - DNA, 20 bp, Influenza A virus
aggaatcccatcctggtatt

SEQ ID NO: 44959 - DNA, 20 bp, Influenza A virus
ttgaaaactcgtgtattgaa

SEQ ID NO: 44960 - DNA, 20 bp, Influenza A virus
tgaaaactcgtgtattgaaa

SEQ ID NO: 44961 - DNA, 20 bp, Influenza A virus
aacaatcagggttgccagtt

SEQ ID NO: 44962 - DNA, 20 bp, Influenza A virus
ccagttggaggcaatgagaa

SEQ ID NO: 44963 - DNA, 20 bp, Influenza A virus
gaggcaatgagaagaaagca

SEQ ID NO: 44964 - DNA, 20 bp, Influenza A virus
gcaaatgttgtaaggaagat

SEQ ID NO: 44965 - DNA, 20 bp, Influenza A virus
taaggaagatgatgaccaat

SEQ ID NO: 44966 - DNA, 20 bp, Influenza A virus
gacaaaagagatacaccaag

SEQ ID NO: 44967 - DNA, 20 bp, Influenza A virus
ctggtgggatggtcttcaat

SEQ ID NO: 44968 - DNA, 20 bp, Influenza A virus
aatcctctgacgattttgct

SEQ ID NO: 44969 - DNA, 20 bp, Influenza A virus
tgctctgattgtgaatgcac

SEQ ID NO: 44970 - DNA, 20 bp, Influenza A virus
gctctgattgtgaatgcacc

SEQ ID NO: 44971 - DNA, 20 bp, Influenza A virus
ccagttttggtgtgtctggg

SEQ ID NO: 44972 - DNA, 20 bp, Influenza A virus
tggtgtgtctgggagcaacg

SEQ ID NO: 44973 - DNA, 20 bp, Influenza A virus
ggtgtgtctgggagcaacga

SEQ ID NO: 44974 - DNA, 20 bp, Influenza A virus
gtgtgtctgggagcaacgag

SEQ ID NO: 44975 - DNA, 20 bp, Influenza A virus
gagttactgtcatcaaaaac

SEQ ID NO: 44976 - DNA, 20 bp, Influenza A virus
aagatgaacaaatgtaccaa

SEQ ID NO: 44977 - DNA, 20 bp, Influenza A virus
atttgaaaaattcttcccca

SEQ ID NO: 44978 - DNA, 20 bp, Influenza A virus
tttgaaaaattcttccccag

SEQ ID NO: 44979 - DNA, 20 bp, Influenza A virus
gaaaaattcttccccagcag

SEQ ID NO: 44980 - DNA, 20 bp, Influenza A virus
aaaaattcttccccagcagt

SEQ ID NO: 44981 - DNA, 20 bp, Hepatitis GB virus A
gggttcgtaggtggtaaatc

SEQ ID NO: 44982 - DNA, 20 bp, Hepatitis GB virus A
gtaggtggtaaatcccagca

SEQ ID NO: 44983 - DNA, 20 bp, Hepatitis GB virus A
ccacctgtgctgggatttac

SEQ ID NO: 44984 - DNA, 20 bp, Hepatitis GB virus A
accacctacgaaccctaaca

SEQ ID NO: 44985 - DNA, 20 bp, Hepatitis GB virus A
ccacctacgaaccctaacac

SEQ ID NO: 44986 - DNA, 20 bp, Hepatitis GB virus A
acaatgccagtggggggccg

SEQ ID NO: 44987 - DNA, 20 bp, Hepatitis GB virus A
ttgtgggctccgagttcctc

SEQ ID NO: 44988 - DNA, 20 bp, Hepatitis GB virus A
tgggctccgagttcctctag

SEQ ID NO: 44989 - DNA, 20 bp, Hepatitis GB virus A
ctctagggatggccgaaagg

SEQ ID NO: 44990 - DNA, 20 bp, Hepatitis GB virus A
cggccatccctagaggaact

SEQ ID NO: 44991 - DNA, 20 bp, Hepatitis GB virus A
ttgggaagtttggcggagcc

SEQ ID NO: 44992 - DNA, 20 bp, Hepatitis GB virus A
ggaagtttggcggagcctta

SEQ ID NO: 44993 - DNA, 20 bp, Hepatitis GB virus A
ggcggagccttaggcccggt

SEQ ID NO: 44994 - DNA, 20 bp, Hepatitis GB virus A
gcggagccttaggcccggtg

SEQ ID NO: 44995 - DNA, 20 bp, Hepatitis GB virus A
ggcccggtggcctcagctgc

SEQ ID NO: 44996 - DNA, 20 bp, Hepatitis GB virus A
cctactacttttagtggtgg

SEQ ID NO: 44997 - DNA, 20 bp, Hepatitis GB virus A
ctactacttttagtggtggg

SEQ ID NO: 44998 - DNA, 20 bp, Hepatitis GB virus A
tagtggtgggcgaggcacag

SEQ ID NO: 44999 - DNA, 20 bp, Hepatitis GB virus A
agtggtgggcgaggcacagg

SEQ ID NO: 45000 - DNA, 20 bp, Hepatitis GB virus A
gtggtgggcgaggcacaggg

SEQ ID NO: 45001 - DNA, 20 bp, Hepatitis GB virus A
ttggcacagtgtcggccgtt

SEQ ID NO: 45002 - DNA, 20 bp, Hepatitis GB virus A
gcacagtgtcggccgtttgc

SEQ ID NO: 45003 - DNA, 20 bp, Hepatitis GB virus A
gccagtggggctccgcgtac

SEQ ID NO: 45004 - DNA, 20 bp, Hepatitis GB virus A
ccagtggggctccgcgtact

SEQ ID NO: 45005 - DNA, 20 bp, Hepatitis GB virus A
ggcgactgggtgccattgta

SEQ ID NO: 45006 - DNA, 20 bp, Hepatitis GB virus A
tatggtgcagttaagaagct

SEQ ID NO: 45007 - DNA, 20 bp, Hepatitis GB virus A
atggtgcagttaagaagctt

SEQ ID NO: 45008 - DNA, 20 bp, Hepatitis GB virus A
tggtgcagttaagaagcttg

SEQ ID NO: 45009 - DNA, 20 bp, Hepatitis GB virus A
agaagcttggggtcaacatg

SEQ ID NO: 45010 - DNA, 20 bp, Hepatitis GB virus A
gggtcaacatgactgtgagc

SEQ ID NO: 45011 - DNA, 20 bp, Hepatitis GB virus A
gcttttgacttcccgggaga

SEQ ID NO: 45012 - DNA, 20 bp, Hepatitis GB virus A
tgacttcccgggagatcaca

SEQ ID NO: 45013 - DNA, 20 bp, Hepatitis GB virus A
gacttcccgggagatcacaa

SEQ ID NO: 45014 - DNA, 20 bp, Hepatitis GB virus A
acttcccgggagatcacaat

SEQ ID NO: 45015 - DNA, 20 bp, Hepatitis GB virus A
ccgggagatcacaatggatt

SEQ ID NO: 45016 - DNA, 20 bp, Hepatitis GB virus A
gccctgcccgaactcgacca

SEQ ID NO: 45017 - DNA, 20 bp, Hepatitis GB virus A
ccctgcccgaactcgaccac

SEQ ID NO: 45018 - DNA, 20 bp, Hepatitis GB virus A
ggtgattcagtcagtaacgc

SEQ ID NO: 45019 - DNA, 20 bp, Hepatitis GB virus A
agtcagtaacgccgcctgct

SEQ ID NO: 45020 - DNA, 20 bp, Hepatitis GB virus A
gctggttccgacttgtggct

SEQ ID NO: 45021 - DNA, 20 bp, Hepatitis GB virus A
tgtggtcgcttaccttgggg

SEQ ID NO: 45022 - DNA, 20 bp, Hepatitis GB virus A
ccttggggttctcggcactg

SEQ ID NO: 45023 - DNA, 20 bp, Hepatitis GB virus A
gggttctcggcactgccaga

SEQ ID NO: 45024 - DNA, 20 bp, Hepatitis GB virus A
tcggcactgccagatgctgc

SEQ ID NO: 45025 - DNA, 20 bp, Hepatitis GB virus A
gcaagaggtgcgctgcccct

SEQ ID NO: 45026 - DNA, 20 bp, Hepatitis GB virus A
gcctgcgcctgttggacact

SEQ ID NO: 45027 - DNA, 20 bp, Hepatitis GB virus A
gacactcccataggcaaccg

SEQ ID NO: 45028 - DNA, 20 bp, Hepatitis GB virus A
gtgcaaactgtggctggtgg

SEQ ID NO: 45029 - DNA, 20 bp, Hepatitis GB virus A
tgcaaactgtggctggtggc

SEQ ID NO: 45030 - DNA, 20 bp, Hepatitis GB virus A
gcacaaaggccggcgggggc

SEQ ID NO: 45031 - DNA, 20 bp, Hepatitis GB virus A
cgggaatggggttttgccct

SEQ ID NO: 45032 - DNA, 20 bp, Hepatitis GB virus A
tgccctagagcccgtcgctg

SEQ ID NO: 45033 - DNA, 20 bp, Hepatitis GB virus A
gccctagagcccgtcgctgt

SEQ ID NO: 45034 - DNA, 20 bp, Hepatitis GB virus A
ccctagagcccgtcgctgtg

SEQ ID NO: 45035 - DNA, 20 bp, Hepatitis GB virus A
gggatgccgcacgagtgttg

SEQ ID NO: 45036 - DNA, 20 bp, Hepatitis GB virus A
ccaatgggggctacctgctt

SEQ ID NO: 45037 - DNA, 20 bp, Hepatitis GB virus A
gaaccttgcaaatgctcacc

SEQ ID NO: 45038 - DNA, 20 bp, Hepatitis GB virus A
caaatgctcaccgcagggcg

SEQ ID NO: 45039 - DNA, 20 bp, Hepatitis GB virus A
gcaaggttccaagcaggtag

SEQ ID NO: 45040 - DNA, 20 bp, Hepatitis GB virus A
caaggttccaagcaggtagc

SEQ ID NO: 45041 - DNA, 20 bp, Hepatitis GB virus A
gcgtattgcatcgtggcaat

SEQ ID NO: 45042 - DNA, 20 bp, Hepatitis GB virus A
catcgtggcaatcgggtcac

SEQ ID NO: 45043 - DNA, 20 bp, Hepatitis GB virus A
ggagaccctccctagggagg

SEQ ID NO: 45044 - DNA, 20 bp, Hepatitis GB virus A
gtctgagcctccctagggag

SEQ ID NO: 45045 - DNA, 20 bp, Hepatitis GB virus A
gtatagcgtatcccagtgac

SEQ ID NO: 45046 - DNA, 20 bp, Hepatitis GB virus A
gtgttctgggcatgggacgt

SEQ ID NO: 45047 - DNA, 20 bp, Hepatitis GB virus A
tgggcatgggacgtgcccgg

SEQ ID NO: 45048 - DNA, 20 bp, Hepatitis GB virus A
ctggcgaaagaatgtcgggt

SEQ ID NO: 45049 - DNA, 20 bp, Hepatitis GB virus A
tttcgccagcaaccgggcac

SEQ ID NO: 45050 - DNA, 20 bp, Hepatitis GB virus A
cgccagcaaccgggcacgtc

SEQ ID NO: 45051 - DNA, 20 bp, Hepatitis GB virus A
tctgccactcaaaggttgag

SEQ ID NO: 45052 - DNA, 20 bp, Hepatitis GB virus A
ctgccactcaaaggttgagt

SEQ ID NO: 45053 - DNA, 20 bp, Hepatitis GB virus A
tgccactcaaaggttgagtg

SEQ ID NO: 45054 - DNA, 20 bp, Hepatitis GB virus A
agtgcgagaggacgtgcgca

SEQ ID NO: 45055 - DNA, 20 bp, Hepatitis GB virus A
ctacaggggcagggaaacag

SEQ ID NO: 45056 - DNA, 20 bp, Hepatitis GB virus A
ttactcaggtgggggggcca

SEQ ID NO: 45057 - DNA, 20 bp, Hepatitis GB virus A
ctcaggtgggggggccaact

SEQ ID NO: 45058 - DNA, 20 bp, Hepatitis GB virus A
gtgtgrccgagggttayacc

SEQ ID NO: 45059 - DNA, 20 bp, Hepatitis GB virus A
cggtagttggcccccccacc

SEQ ID NO: 45060 - DNA, 20 bp, Hepatitis GB virus A
gcccccccacctgagtaata

SEQ ID NO: 45061 - DNA, 20 bp, Hepatitis GB virus A
tccagttgtagtggtycccc

SEQ ID NO: 45062 - DNA, 20 bp, Hepatitis GB virus A
tagtggtycccccctgtgag

SEQ ID NO: 45063 - DNA, 20 bp, Hepatitis GB virus A
cgccaccggcttcacatcac

SEQ ID NO: 45064 - DNA, 20 bp, Hepatitis GB virus A
acatcacaggggtagcgctc

SEQ ID NO: 45065 - DNA, 20 bp, Hepatitis GB virus A
cctgctgggaatgtcagccg

SEQ ID NO: 45066 - DNA, 20 bp, Hepatitis GB virus A
ctgctgggaatgtcagccgg

SEQ ID NO: 45067 - DNA, 20 bp, Hepatitis GB virus A
ccagcaggaaagaggccgcc

SEQ ID NO: 45068 - DNA, 20 bp, Hepatitis GB virus A
ctcttagccccataggcagc

SEQ ID NO: 45069 - DNA, 20 bp, Hepatitis GB virus A
gccccataggcagctgtgya

SEQ ID NO: 45070 - DNA, 20 bp, Hepatitis GB virus A
tactctggagtgtcaagaag

SEQ ID NO: 45071 - DNA, 20 bp, Hepatitis GB virus A
ttgacactccagagtagaac

SEQ ID NO: 45072 - DNA, 20 bp, Hepatitis GB virus A
acactccagagtagaacgcc

SEQ ID NO: 45073 - DNA, 20 bp, Hepatitis GB virus A
aggaagatcaaaacaacctt

SEQ ID NO: 45074 - DNA, 20 bp, Hepatitis GB virus A
ccgcgcctcaaaatccctct

SEQ ID NO: 45075 - DNA, 20 bp, Hepatitis GB virus A
ccttcccagggtccggccca

SEQ ID NO: 45076 - DNA, 20 bp, Hepatitis GB virus A
ccagggtccggcccatcctt

SEQ ID NO: 45077 - DNA, 20 bp, Hepatitis GB virus A
gctgcaccccatcagaggga

SEQ ID NO: 45078 - DNA, 20 bp, Hepatitis GB virus A
aggcgttggtggtctctggc

SEQ ID NO: 45079 - DNA, 20 bp, Hepatitis GB virus A
gtggtctctggcacggttac

SEQ ID NO: 45080 - DNA, 20 bp, Hepatitis GB virus A
cggtgacggcgtctagcgcc

SEQ ID NO: 45081 - DNA, 20 bp, Hepatitis GB virus A
aacagcccgcctcacctcgg

SEQ ID NO: 45082 - DNA, 20 bp, Hepatitis GB virus A
acagcccgcctcacctcggc

SEQ ID NO: 45083 - DNA, 20 bp, Hepatitis GB virus A
caggctctggaggatgctgc

SEQ ID NO: 45084 - DNA, 20 bp, Hepatitis GB virus A
tgacaggcacatggggcagt

SEQ ID NO: 45085 - DNA, 20 bp, Hepatitis GB virus A
cgcagcctcttggctaggga

SEQ ID NO: 45086 - DNA, 20 bp, Hepatitis GB virus A
ccacccccctgacagacaca

SEQ ID NO: 45087 - DNA, 20 bp, Hepatitis GB virus A
agctggtgtgcaggagagaa

SEQ ID NO: 45088 - DNA, 20 bp, Hepatitis GB virus A
ccccgaccagacgtatgagt

SEQ ID NO: 45089 - DNA, 20 bp, Hepatitis GB virus A
tctcctgcacaccagctcaa

SEQ ID NO: 45090 - DNA, 20 bp, Hepatitis GB virus A
ctttgattcgtcaatcgacg

SEQ ID NO: 45091 - DNA, 20 bp, Hepatitis GB virus A
gattcgtcaatcgacgaaca

SEQ ID NO: 45092 - DNA, 20 bp, Hepatitis GB virus A
attcgtcaatcgacgaacat

SEQ ID NO: 45093 - DNA, 20 bp, Hepatitis GB virus A
gtcaatcgacgaacatgaca

SEQ ID NO: 45094 - DNA, 20 bp, Hepatitis GB virus A
gcggccgctagtgacgaccc

SEQ ID NO: 45095 - DNA, 20 bp, Hepatitis GB virus A
caggtgtgaccctgtcaagc

SEQ ID NO: 45096 - DNA, 20 bp, Hepatitis GB virus A
ggatacagctgagtgttgct

SEQ ID NO: 45097 - DNA, 20 bp, Hepatitis GB virus A
gatacagctgagtgttgctc

SEQ ID NO: 45098 - DNA, 20 bp, Hepatitis GB virus A
ctcggcctacttggctgaat

SEQ ID NO: 45099 - DNA, 20 bp, Hepatitis GB virus A
gctgaatgtgttgctggggg

SEQ ID NO: 45100 - DNA, 20 bp, Hepatitis GB virus A
cgcacgtgttgatcatggca

SEQ ID NO: 45101 - DNA, 20 bp, Hepatitis GB virus A
atcatggcataccgaagtgg

SEQ ID NO: 45102 - DNA, 20 bp, Hepatitis GB virus A
atcaccggatgagttggtga

SEQ ID NO: 45103 - DNA, 20 bp, Hepatitis GB virus A
gtgatgtgccaggtccaagg

SEQ ID NO: 45104 - DNA, 20 bp, Hepatitis GB virus A
ccttggacctggcacatcac

SEQ ID NO: 45105 - DNA, 20 bp, Human papillomavirus type 5
ggcatccctgtgattgattg

SEQ ID NO: 45106 - DNA, 20 bp, Human papillomavirus type 5
attgtttaataccttgcaat

SEQ ID NO: 45107 - DNA, 20 bp, Human papillomavirus type 5
tttaataccttgcaatttct

SEQ ID NO: 45108 - DNA, 20 bp, Human papillomavirus type 5
aataccttgcaatttctgtg

SEQ ID NO: 45109 - DNA, 20 bp, Human papillomavirus type 5
ataccttgcaatttctgtgg

SEQ ID NO: 45110 - DNA, 20 bp, Human papillomavirus type 5
cctttcataaggtgaggaac

SEQ ID NO: 45111 - DNA, 20 bp, Human papillomavirus type 5
cataaggtgaggaacgcctg

SEQ ID NO: 45112 - DNA, 20 bp, Human papillomavirus type 5
ataaggtgaggaacgcctgg

SEQ ID NO: 45113 - DNA, 20 bp, Human papillomavirus type 5
ttatcatgattggtaaagag

SEQ ID NO: 45114 - DNA, 20 bp, Human papillomavirus type 5
tatcatgattggtaaagagg

SEQ ID NO: 45115 - DNA, 20 bp, Human papillomavirus type 5
gttagatgatactgaactgg

SEQ ID NO: 45116 - DNA, 20 bp, Human papillomavirus type 5
ttagatgatactgaactgga

SEQ ID NO: 45117 - DNA, 20 bp, Human papillomavirus type 5
gatgatactgaactggagca

SEQ ID NO: 45118 - DNA, 20 bp, Human papillomavirus type 5
cctggaactatttcatcaac

SEQ ID NO: 45119 - DNA, 20 bp, Human papillomavirus type 5
catcaacaggagtgtgagca

SEQ ID NO: 45120 - DNA, 20 bp, Human papillomavirus type 5
actctcggccggatgacgag

SEQ ID NO: 45121 - DNA, 20 bp, Human papillomavirus type 5
aggggacgtagatatacatt

SEQ ID NO: 45122 - DNA, 20 bp, Human papillomavirus type 5
cactgcattgttgcgttcta

SEQ ID NO: 45123 - DNA, 20 bp, Human papillomavirus type 5
ttgcgttctagcaacaaaaa

SEQ ID NO: 45124 - DNA, 20 bp, Human papillomavirus type 5
cgttctagcaacaaaaaagc

SEQ ID NO: 45125 - DNA, 20 bp, Human papillomavirus type 5
caacagcattgtgactatat

SEQ ID NO: 45126 - DNA, 20 bp, Human papillomavirus type 5
tgactatatctgggtccgtg

SEQ ID NO: 45127 - DNA, 20 bp, Human papillomavirus type 5
tacctattgtgttttaaggc

SEQ ID NO: 45128 - DNA, 20 bp, Human papillomavirus type 5
tgttttaaggcgggaaaaaa

SEQ ID NO: 45129 - DNA, 20 bp, Human papillomavirus type 5
tttcccgccttaaaacacaa

SEQ ID NO: 45130 - DNA, 20 bp, Human papillomavirus type 5
cataatcacttattagacga

SEQ ID NO: 45131 - DNA, 20 bp, Human papillomavirus type 5
ataatcacttattagacgaa

SEQ ID NO: 45132 - DNA, 20 bp, Human papillomavirus type 5
ttagacgaagcagatatagc

SEQ ID NO: 45133 - DNA, 20 bp, Human papillomavirus type 5
gacgaagcagatatagcata

SEQ ID NO: 45134 - DNA, 20 bp, Human papillomavirus type 5
ctcccgaagacgcgaatgca

SEQ ID NO: 45135 - DNA, 20 bp, Human papillomavirus type 5
tggaaagtcatcatttgcaa

SEQ ID NO: 45136 - DNA, 20 bp, Human papillomavirus type 5
gcaatgtcattaataagagt

SEQ ID NO: 45137 - DNA, 20 bp, Human papillomavirus type 5
caatgtcattaataagagtg

SEQ ID NO: 45138 - DNA, 20 bp, Human papillomavirus type 5
ataagagtgttgaagggtag

SEQ ID NO: 45139 - DNA, 20 bp, Human papillomavirus type 5
aagggtagagtgttgtcatt

SEQ ID NO: 45140 - DNA, 20 bp, Human papillomavirus type 5
gaactaactgaccaaagctg

SEQ ID NO: 45141 - DNA, 20 bp, Human papillomavirus type 5
ttttacaaggctttggacac

SEQ ID NO: 45142 - DNA, 20 bp, Human papillomavirus type 5
tttacaaggctttggacaca

SEQ ID NO: 45143 - DNA, 20 bp, Human papillomavirus type 5
ttacaaggctttggacacaa

SEQ ID NO: 45144 - DNA, 20 bp, Human papillomavirus type 5
tacaaggctttggacacaat

SEQ ID NO: 45145 - DNA, 20 bp, Human papillomavirus type 5
actccacgtccagacagctc

SEQ ID NO: 45146 - DNA, 20 bp, Human papillomavirus type 5
tgatgtggtgagctgtctgg

SEQ ID NO: 45147 - DNA, 20 bp, Human papillomavirus type 5
gatgtggtgagctgtctgga

SEQ ID NO: 45148 - DNA, 20 bp, Human papillomavirus type 5
atgtggtgagctgtctggac

SEQ ID NO: 45149 - DNA, 20 bp, Human papillomavirus type 5
tggaggtggtgggggtcgcg

SEQ ID NO: 45150 - DNA, 20 bp, Human papillomavirus type 5
atcgccgcctgggtgacctt

SEQ ID NO: 45151 - DNA, 20 bp, Human papillomavirus type 5
cacctccccttctgcaggtg

SEQ ID NO: 45152 - DNA, 20 bp, Human papillomavirus type 5
tgcaggtggttggggacctt

SEQ ID NO: 45153 - DNA, 20 bp, Human papillomavirus type 5
gggaccttcctctggatcgc

SEQ ID NO: 45154 - DNA, 20 bp, Human papillomavirus type 5
gttcaaagcatacaggacga

SEQ ID NO: 45155 - DNA, 20 bp, Human papillomavirus type 5
aaagcatacaggacgacttg

SEQ ID NO: 45156 - DNA, 20 bp, Human papillomavirus type 5
gaagattactggaagaagct

SEQ ID NO: 45157 - DNA, 20 bp, Human papillomavirus type 5
ctggaagaagctcgcgaccc

SEQ ID NO: 45158 - DNA, 20 bp, Human papillomavirus type 5
tcaaaggggcggctaacaca

SEQ ID NO: 45159 - DNA, 20 bp, Human papillomavirus type 5
ataaggcctatggcaacctg

SEQ ID NO: 45160 - DNA, 20 bp, Human papillomavirus type 5
aacatttactaatgctgctt

SEQ ID NO: 45161 - DNA, 20 bp, Human papillomavirus type 5
acatttactaatgctgcttt

SEQ ID NO: 45162 - DNA, 20 bp, Human papillomavirus type 5
actaatgctgcttttgctac

SEQ ID NO: 45163 - DNA, 20 bp, Human papillomavirus type 5
ctaatgctgcttttgctact

SEQ ID NO: 45164 - DNA, 20 bp, Human papillomavirus type 5
acttccaggtgaagtagaaa

SEQ ID NO: 45165 - DNA, 20 bp, Human papillomavirus type 5
cttccaggtgaagtagaaac

SEQ ID NO: 45166 - DNA, 20 bp, Human papillomavirus type 5
caggtgaagtagaaacaatt

SEQ ID NO: 45167 - DNA, 20 bp, Human papillomavirus type 5
ctgaaatccatcctgtacct

SEQ ID NO: 45168 - DNA, 20 bp, Human papillomavirus type 5
ccactagcacaggttccagt

SEQ ID NO: 45169 - DNA, 20 bp, Human papillomavirus type 5
ttgaggaagaagtgactaat

SEQ ID NO: 45170 - DNA, 20 bp, Human papillomavirus type 5
tgaggaagaagtgactaata

SEQ ID NO: 45171 - DNA, 20 bp, Human papillomavirus type 5
gaggaagaagtgactaatat

SEQ ID NO: 45172 - DNA, 20 bp, Human papillomavirus type 5
aggaagaagtgactaatata

SEQ ID NO: 45173 - DNA, 20 bp, Human papillomavirus type 5
gaaaatgatctggatgtctt

SEQ ID NO: 45174 - DNA, 20 bp, Human papillomavirus type 5
tgttgcatatccagagtcac

SEQ ID NO: 45175 - DNA, 20 bp, Human papillomavirus type 5
catatccagagtcacgtaat

SEQ ID NO: 45176 - DNA, 20 bp, Human papillomavirus type 5
atcctacacctgatattcct

SEQ ID NO: 45177 - DNA, 20 bp, Human papillomavirus type 5
tcctacacctgatattcctg

SEQ ID NO: 45178 - DNA, 20 bp, Human papillomavirus type 5
ctgtagtcattatacaccct

SEQ ID NO: 45179 - DNA, 20 bp, Human papillomavirus type 5
tctaaagatgacagacagga

SEQ ID NO: 45180 - DNA, 20 bp, Human papillomavirus type 5
ctaaagatgacagacaggat

SEQ ID NO: 45181 - DNA, 20 bp, Human papillomavirus type 5
taaagatgacagacaggata

SEQ ID NO: 45182 - DNA, 20 bp, Human papillomavirus type 5
tgatcctaaacagatccaaa

SEQ ID NO: 45183 - DNA, 20 bp, Human papillomavirus type 5
gatcctaaacagatccaaat

SEQ ID NO: 45184 - DNA, 20 bp, Human papillomavirus type 5
catgtatttcccaactgtta

SEQ ID NO: 45185 - DNA, 20 bp, Human papillomavirus type 5
cccaactgttagtggctcat

SEQ ID NO: 45186 - DNA, 20 bp, Human papillomavirus type 5
ccaactgttagtggctcatt

SEQ ID NO: 45187 - DNA, 20 bp, Human papillomavirus type 5
gtggctcattagtatccagt

SEQ ID NO: 45188 - DNA, 20 bp, Human papillomavirus type 5
gtatccagtgatgctcaatt

SEQ ID NO: 45189 - DNA, 20 bp, Human papillomavirus type 5
acggtacaaaagcagtgtct

SEQ ID NO: 45190 - DNA, 20 bp, Human papillomavirus type 5
taaagggtctaatagaggaa

SEQ ID NO: 45191 - DNA, 20 bp, Human papillomavirus type 5
aggtctgaccgaaagtggta

SEQ ID NO: 45192 - DNA, 20 bp, Human papillomavirus type 5
ataaaaatgtaccactttcg

SEQ ID NO: 45193 - DNA, 20 bp, Human papillomavirus type 5
taaaaatgtaccactttcgg

SEQ ID NO: 45194 - DNA, 20 bp, Influenza A virus
ccatcttagcaacgactatg

SEQ ID NO: 45195 - DNA, 20 bp, Influenza A virus
gcaacgactatgacactaca

SEQ ID NO: 45196 - DNA, 20 bp, Influenza A virus
caatgaatgtaccaacccat

SEQ ID NO: 45197 - DNA, 20 bp, Influenza A virus
aatgaatgtaccaacccatc

SEQ ID NO: 45198 - DNA, 20 bp, Influenza A virus
ctattatgattggttcacat

SEQ ID NO: 45199 - DNA, 20 bp, Influenza A virus
ggctttctgcaggcggggat

SEQ ID NO: 45200 - DNA, 20 bp, Influenza A virus
ctgcaggcggggatatttgg

SEQ ID NO: 45201 - DNA, 20 bp, Influenza A virus
tgcaggcggggatatttggg

SEQ ID NO: 45202 - DNA, 20 bp, Influenza A virus
gggtgacaagagaaccttat

SEQ ID NO: 45203 - DNA, 20 bp, Influenza A virus
ggtgacaagagaaccttatg

SEQ ID NO: 45204 - DNA, 20 bp, Influenza A virus
catgtttgtgtcactgggga

SEQ ID NO: 45205 - DNA, 20 bp, Influenza A virus
gtgtcactggggatgataga

SEQ ID NO: 45206 - DNA, 20 bp, Influenza A virus
tgtcactggggatgatagaa

SEQ ID NO: 45207 - DNA, 20 bp, Influenza A virus
atgatgggatgcttaccgac

SEQ ID NO: 45208 - DNA, 20 bp, Influenza A virus
tgatgggatgcttaccgaca

SEQ ID NO: 45209 - DNA, 20 bp, Influenza A virus
cccccggtatccagaagtta

SEQ ID NO: 45210 - DNA, 20 bp, Influenza A virus
gatgtgtttgcagagacaat

SEQ ID NO: 45211 - DNA, 20 bp, Influenza A virus
gcagagacaattggaagggc

SEQ ID NO: 45212 - DNA, 20 bp, Influenza A virus
cagagacaattggaagggct

SEQ ID NO: 45213 - DNA, 20 bp, Influenza A virus
gagcccttccaattgtctct

SEQ ID NO: 45214 - DNA, 20 bp, Influenza A virus
ggatgggacgaacaatcaag

SEQ ID NO: 45215 - DNA, 20 bp, Influenza A virus
gatgggacgaacaatcaaga

SEQ ID NO: 45216 - DNA, 20 bp, Influenza A virus
gcgctctggttatgagactt

SEQ ID NO: 45217 - DNA, 20 bp, Influenza A virus
tgagactttcagggtcgttg

SEQ ID NO: 45218 - DNA, 20 bp, Influenza A virus
cagggtcgttggtggttgga

SEQ ID NO: 45219 - DNA, 20 bp, Influenza B virus
acagtataaataccggaaca

SEQ ID NO: 45220 - DNA, 20 bp, Influenza B virus
ctggcttgatgattggtctg

SEQ ID NO: 45221 - DNA, 20 bp, Influenza B virus
atgattggtctggttgcccc

SEQ ID NO: 45222 - DNA, 20 bp, Influenza B virus
gtctggttgccccactggtt

SEQ ID NO: 45223 - DNA, 20 bp, Influenza B virus
ccccactggttccgggagtc

SEQ ID NO: 45224 - DNA, 20 bp, Influenza B virus
tacaaccagatgatggtcaa

SEQ ID NO: 45225 - DNA, 20 bp, Influenza B virus
atgatgacatggaaaggaat

SEQ ID NO: 45226 - DNA, 20 bp, Influenza B virus
aaaatgcacaagctgtggag

SEQ ID NO: 45227 - DNA, 20 bp, Influenza B virus
cagccaataggattctctcc

SEQ ID NO: 45228 - DNA, 20 bp, Influenza B virus
tctccacagcttgtgcattt

SEQ ID NO: 45229 - DNA, 20 bp, Influenza B virus
cattgggaagaaaatgtttc

SEQ ID NO: 45230 - DNA, 20 bp, Influenza B virus
attgggaagaaaatgtttca

SEQ ID NO: 45231 - DNA, 20 bp, Influenza B virus
ggaagaaaatgtttcaaata

SEQ ID NO: 45232 - DNA, 20 bp, Influenza B virus
caaatatcagacaaaaacaa

SEQ ID NO: 45233 - DNA, 20 bp, Influenza B virus
aaatatcagacaaaaacaaa

SEQ ID NO: 45234 - DNA, 20 bp, Human papillomavirus type 172
caccctaagaaactatgcac

SEQ ID NO: 45235 - DNA, 20 bp, Human papillomavirus type 172
cggtcatggaatttatctct

SEQ ID NO: 45236 - DNA, 20 bp, Human papillomavirus type 172
ggtcatggaatttatctctc

SEQ ID NO: 45237 - DNA, 20 bp, Human papillomavirus type 172
atctctcctatcattgttgg

SEQ ID NO: 45238 - DNA, 20 bp, Human papillomavirus type 172
tctctcctatcattgttggc

SEQ ID NO: 45239 - DNA, 20 bp, Human papillomavirus type 172
ctgtttaattcgttgtcatt

SEQ ID NO: 45240 - DNA, 20 bp, Human papillomavirus type 172
tgtttaattcgttgtcattg

SEQ ID NO: 45241 - DNA, 20 bp, Human papillomavirus type 172
aattcgttgtcattggagaa

SEQ ID NO: 45242 - DNA, 20 bp, Human papillomavirus type 172
attcgttgtcattggagaaa

SEQ ID NO: 45243 - DNA, 20 bp, Human papillomavirus type 172
gttgtcattggagaaattgc

SEQ ID NO: 45244 - DNA, 20 bp, Human papillomavirus type 172
tagcatcaagattatcaatc

SEQ ID NO: 45245 - DNA, 20 bp, Human papillomavirus type 172
tcaatccttacatttgagca

SEQ ID NO: 45246 - DNA, 20 bp, Human papillomavirus type 172
catttgagcaattattgatt

SEQ ID NO: 45247 - DNA, 20 bp, Human papillomavirus type 172
gagcaattattgattggaga

SEQ ID NO: 45248 - DNA, 20 bp, Human papillomavirus type 172
agcaattattgattggagag

SEQ ID NO: 45249 - DNA, 20 bp, Human papillomavirus type 172
atagatgaggttgactgcag

SEQ ID NO: 45250 - DNA, 20 bp, Human papillomavirus type 172
actgcagccagggaaattcc

SEQ ID NO: 45251 - DNA, 20 bp, Human papillomavirus type 172
cctggcattgtttaatgaac

SEQ ID NO: 45252 - DNA, 20 bp, Human papillomavirus type 172
tttaatgaacatgaaacgga

SEQ ID NO: 45253 - DNA, 20 bp, Human papillomavirus type 172
aatgaacatgaaacggagga

SEQ ID NO: 45254 - DNA, 20 bp, Human papillomavirus type 172
gatttgagtcagatggttca

SEQ ID NO: 45255 - DNA, 20 bp, Human papillomavirus type 172
atttgagtcagatggttcag

SEQ ID NO: 45256 - DNA, 20 bp, Human papillomavirus type 172
gagtcagatggttcagtttt

SEQ ID NO: 45257 - DNA, 20 bp, Human papillomavirus type 172
agtcagatggttcagttttg

SEQ ID NO: 45258 - DNA, 20 bp, Human papillomavirus type 172
agttttgttatgataacaat

SEQ ID NO: 45259 - DNA, 20 bp, Human papillomavirus type 172
caaccattattggatggaaa

SEQ ID NO: 45260 - DNA, 20 bp, Human papillomavirus type 172
ttggatggaaaaatgggatt

SEQ ID NO: 45261 - DNA, 20 bp, Human papillomavirus type 172
gatggaaaaatgggatttat

SEQ ID NO: 45262 - DNA, 20 bp, Human papillomavirus type 172
atagatgatgtaacctatcc

SEQ ID NO: 45263 - DNA, 20 bp, Human papillomavirus type 172
tagatgatgtaacctatcct

SEQ ID NO: 45264 - DNA, 20 bp, Human papillomavirus type 172
ttttagaaaacttgggaatc

SEQ ID NO: 45265 - DNA, 20 bp, Human papillomavirus type 172
tttagaaaacttgggaatca

SEQ ID NO: 45266 - DNA, 20 bp, Human papillomavirus type 172
ttagaaaacttgggaatcaa

SEQ ID NO: 45267 - DNA, 20 bp, Human papillomavirus type 172
tagaaaacttgggaatcaaa

SEQ ID NO: 45268 - DNA, 20 bp, Human papillomavirus type 172
agaaaacttgggaatcaaat

SEQ ID NO: 45269 - DNA, 20 bp, Human papillomavirus type 172
ccgtaccgcaaaccccaaga

SEQ ID NO: 45270 - DNA, 20 bp, Human papillomavirus type 172
agctagctcctccctcttcg

SEQ ID NO: 45271 - DNA, 20 bp, Human papillomavirus type 172
gcctttttgtcgtcttgggg

SEQ ID NO: 45272 - DNA, 20 bp, Human papillomavirus type 172
ttgtcgtcttggggtttgcg

SEQ ID NO: 45273 - DNA, 20 bp, Human papillomavirus type 172
tgtcgtcttggggtttgcgg

SEQ ID NO: 45274 - DNA, 20 bp, Human papillomavirus type 172
taacagacaccacatcaata

SEQ ID NO: 45275 - DNA, 20 bp, Human papillomavirus type 172
caatctccagaaaatggggt

SEQ ID NO: 45276 - DNA, 20 bp, Human papillomavirus type 172
aatctccagaaaatggggtt

SEQ ID NO: 45277 - DNA, 20 bp, Human papillomavirus type 172
caattttaaatgttacacct

SEQ ID NO: 45278 - DNA, 20 bp, Human papillomavirus type 172
taaatgttacacctgcagat

SEQ ID NO: 45279 - DNA, 20 bp, Human papillomavirus type 172
gaaccaataaatccagtgca

SEQ ID NO: 45280 - DNA, 20 bp, Human papillomavirus type 172
caaattgaggacttaccaac

SEQ ID NO: 45281 - DNA, 20 bp, Human papillomavirus type 172
aaattgaggacttaccaact

SEQ ID NO: 45282 - DNA, 20 bp, Human papillomavirus type 172
aggacttaccaactactagc

SEQ ID NO: 45283 - DNA, 20 bp, Human papillomavirus type 172
ccaactactagcacccctat

SEQ ID NO: 45284 - DNA, 20 bp, Human papillomavirus type 172
taatgattttataatacatc

SEQ ID NO: 45285 - DNA, 20 bp, Human papillomavirus type 172
tataatacatcctagtgtac

SEQ ID NO: 45286 - DNA, 20 bp, Human papillomavirus type 172
ataatacatcctagtgtact

SEQ ID NO: 45287 - DNA, 20 bp, Human papillomavirus type 172
taatacatcctagtgtactg

SEQ ID NO: 45288 - DNA, 20 bp, Human papillomavirus type 172
tttctaatttttttcagatg

SEQ ID NO: 45289 - DNA, 20 bp, Human papillomavirus type 172
caaaggtttctgccaatcag

SEQ ID NO: 45290 - DNA, 20 bp, Human papillomavirus type 172
ctgccaatcagtacagggtt

SEQ ID NO: 45291 - DNA, 20 bp, Human papillomavirus type 172
tgccaatcagtacagggtta

SEQ ID NO: 45292 - DNA, 20 bp, Human papillomavirus type 172
ttagactacaatttccagat

SEQ ID NO: 45293 - DNA, 20 bp, Human papillomavirus type 172
gactacaatttccagatcca

SEQ ID NO: 45294 - DNA, 20 bp, Human papillomavirus type 172
tagacaggatatggcatttg

SEQ ID NO: 45295 - DNA, 20 bp, Human papillomavirus type 172
gaccctaaacaggttcaaat

SEQ ID NO: 45296 - DNA, 20 bp, Human papillomavirus type 172
accctaaacaggttcaaatg

SEQ ID NO: 45297 - DNA, 20 bp, Human papillomavirus type 172
aaatgtgtattgtgggctgc

SEQ ID NO: 45298 - DNA, 20 bp, Human papillomavirus type 172
gaacctgtttagggtcaaat

SEQ ID NO: 45299 - DNA, 20 bp, Human papillomavirus type 172
taatcaagacagagccagtg

SEQ ID NO: 45300 - DNA, 20 bp, Human papillomavirus type 172
aatcaagacagagccagtgt

SEQ ID NO: 45301 - DNA, 20 bp, Human papillomavirus type 172
atcaagacagagccagtgta

SEQ ID NO: 45302 - DNA, 20 bp, Human papillomavirus type 172
agagcttacgaatgaaatca

SEQ ID NO: 45303 - DNA, 20 bp, Human papillomavirus type 172
gagcttacgaatgaaatcag

SEQ ID NO: 45304 - DNA, 20 bp, Human papillomavirus type 172
aatcgcccatattttttaca

SEQ ID NO: 45305 - DNA, 20 bp, Human papillomavirus type 172
tttacatagggcattaggag

SEQ ID NO: 45306 - DNA, 20 bp, Human papillomavirus type 172
ttacatagggcattaggagc

SEQ ID NO: 45307 - DNA, 20 bp, Human papillomavirus type 172
tacatagggcattaggagcc

SEQ ID NO: 45308 - DNA, 20 bp, Human papillomavirus type 172
acatagggcattaggagcca

SEQ ID NO: 45309 - DNA, 20 bp, Human papillomavirus type 172
tctcagacaccattgggtaa

SEQ ID NO: 45310 - DNA, 20 bp, Human papillomavirus type 172
ggtaaacgatttttgtatca

SEQ ID NO: 45311 - DNA, 20 bp, Human papillomavirus type 172
ttgtatcaaagaggacagct

SEQ ID NO: 45312 - DNA, 20 bp, Human papillomavirus type 172
tgtatcaaagaggacagcta

SEQ ID NO: 45313 - DNA, 20 bp, Human papillomavirus type 172
gtatcaaagaggacagctag

SEQ ID NO: 45314 - DNA, 20 bp, Influenza A virus
ctaaaggttccagcgcaaaa

SEQ ID NO: 45315 - DNA, 20 bp, Influenza A virus
cagcgcaaaatgccataagc

SEQ ID NO: 45316 - DNA, 20 bp, Influenza A virus
ccttatactggagatcctcc

SEQ ID NO: 45317 - DNA, 20 bp, Influenza A virus
tactggagatcctccataca

SEQ ID NO: 45318 - DNA, 20 bp, Influenza A virus
ctgttccatggctgtatgga

SEQ ID NO: 45319 - DNA, 20 bp, Influenza A virus
cttgaagaatcccacccagg

SEQ ID NO: 45320 - DNA, 20 bp, Influenza A virus
aagaatcccacccaggtatc

SEQ ID NO: 45321 - DNA, 20 bp, Influenza A virus
gagaactcatgccttgaaac

SEQ ID NO: 45322 - DNA, 20 bp, Influenza A virus
agaactcatgccttgaaaca

SEQ ID NO: 45323 - DNA, 20 bp, Influenza A virus
aaacaatggaagtcgttcaa

SEQ ID NO: 45324 - DNA, 20 bp, Influenza A virus
caaagaaaaaggagagtaag

SEQ ID NO: 45325 - DNA, 20 bp, Influenza A virus
aaagaaaaaggagagtaaga

SEQ ID NO: 45326 - DNA, 20 bp, Influenza A virus
ttcactctttgttttttctt

SEQ ID NO: 45327 - DNA, 20 bp, Influenza A virus
actctttgttttttcttccc

SEQ ID NO: 45328 - DNA, 20 bp, Influenza A virus
gttttttcttccctattgtt

SEQ ID NO: 45329 - DNA, 20 bp, Influenza A virus
gcgaaaagcttgaacagtct

SEQ ID NO: 45330 - DNA, 20 bp, Influenza A virus
cgaaaagcttgaacagtctg

SEQ ID NO: 45331 - DNA, 20 bp, Influenza A virus
aacagtctggacttccggtt

SEQ ID NO: 45332 - DNA, 20 bp, Influenza A virus
cggttgggggtaatgaaaag

SEQ ID NO: 45333 - DNA, 20 bp, Influenza A virus
ggggtaatgaaaagaaggcc

SEQ ID NO: 45334 - DNA, 20 bp, Influenza A virus
tcaaacaaaatggcaagact

SEQ ID NO: 45335 - DNA, 20 bp, Influenza A virus
gagagtaagagaatgaagct

SEQ ID NO: 45336 - DNA, 20 bp, Influenza A virus
ctagcatttctgcgggtatt

SEQ ID NO: 45337 - DNA, 20 bp, Influenza A virus
ctgcgggtatttgtgttcgg

SEQ ID NO: 45338 - DNA, 20 bp, Influenza A virus
tgcgggtatttgtgttcgga

SEQ ID NO: 45339 - DNA, 20 bp, Influenza A virus
ggcaaaagaaatacaccaag

SEQ ID NO: 45340 - DNA, 20 bp, Influenza A virus
tgccctcatagtgaatgcac

SEQ ID NO: 45341 - DNA, 20 bp, Influenza A virus
gccctcatagtgaatgcacc

SEQ ID NO: 45342 - DNA, 20 bp, Influenza A virus
ccctcatagtgaatgcacca

SEQ ID NO: 45343 - DNA, 20 bp, Influenza A virus
tattccctcatgatttggtg

SEQ ID NO: 45344 - DNA, 20 bp, Influenza A virus
gagtaacagtgataaagaac

SEQ ID NO: 45345 - DNA, 20 bp, Influenza A virus
ggccagcaacagcccagatg

SEQ ID NO: 45346 - DNA, 20 bp, Influenza A virus
ttcatcaaagactacagata

SEQ ID NO: 45347 - DNA, 20 bp, Influenza A virus
atcaaagactacagatatac

SEQ ID NO: 45348 - DNA, 20 bp, Influenza A virus
gatgaacaattggagagcca

SEQ ID NO: 45349 - DNA, 20 bp, Influenza A virus
gtatcagatgggggaccaaa

SEQ ID NO: 45350 - DNA, 20 bp, Influenza A virus
tacaatatccggaaccttca

SEQ ID NO: 45351 - DNA, 20 bp, Influenza A virus
acatccctgaagtctgctta

SEQ ID NO: 45352 - DNA, 20 bp, Influenza A virus
aagtgggagctaatggatga

SEQ ID NO: 45353 - DNA, 20 bp, Influenza A virus
cccgataattctcatccatt

SEQ ID NO: 45354 - DNA, 20 bp, Influenza A virus
aggatgaacagatgtaccaa

SEQ ID NO: 45355 - DNA, 20 bp, Influenza A virus
ttcgagaaatttttccctag

SEQ ID NO: 45356 - DNA, 20 bp, Influenza A virus
gagaaatttttccctagtag

SEQ ID NO: 45357 - DNA, 20 bp, Influenza A virus
ttccctagtagttcatatag

SEQ ID NO: 45358 - DNA, 20 bp, Influenza A virus
tccctagtagttcatatagg

SEQ ID NO: 45359 - DNA, 20 bp, Human papillomavirus type 50
gaaggagactgatggagcct

SEQ ID NO: 45360 - DNA, 20 bp, Human papillomavirus type 50
aaggagactgatggagcctc

SEQ ID NO: 45361 - DNA, 20 bp, Human papillomavirus type 50
ggtggactattgcaagcaac

SEQ ID NO: 45362 - DNA, 20 bp, Human papillomavirus type 50
gtggactattgcaagcaaca

SEQ ID NO: 45363 - DNA, 20 bp, Human papillomavirus type 50
caagcaacaacagattagtt

SEQ ID NO: 45364 - DNA, 20 bp, Human papillomavirus type 50
ttttgcctgtgaatttgctt

SEQ ID NO: 45365 - DNA, 20 bp, Human papillomavirus type 50
tgcctgtgaatttgcttagt

SEQ ID NO: 45366 - DNA, 20 bp, Human papillomavirus type 50
gcctgtgaatttgcttagtg

SEQ ID NO: 45367 - DNA, 20 bp, Human papillomavirus type 50
cctgtgaatttgcttagtga

SEQ ID NO: 45368 - DNA, 20 bp, Human papillomavirus type 50
gcttagtgacgaatctattg

SEQ ID NO: 45369 - DNA, 20 bp, Human papillomavirus type 50
gagtccgagactttcagcgg

SEQ ID NO: 45370 - DNA, 20 bp, Human papillomavirus type 50
agtccgagactttcagcggt

SEQ ID NO: 45371 - DNA, 20 bp, Human papillomavirus type 50
cagcggtgcatataacacca

SEQ ID NO: 45372 - DNA, 20 bp, Human papillomavirus type 50
agcggtgcatataacaccag

SEQ ID NO: 45373 - DNA, 20 bp, Human papillomavirus type 50
tggattgtctttctggtgtt

SEQ ID NO: 45374 - DNA, 20 bp, Human papillomavirus type 50
tatttaaaaacaaaactatt

SEQ ID NO: 45375 - DNA, 20 bp, Human papillomavirus type 50
aaaaacaaaactattcattc

SEQ ID NO: 45376 - DNA, 20 bp, Human papillomavirus type 50
aaaacaaaactattcattcc

SEQ ID NO: 45377 - DNA, 20 bp, Human papillomavirus type 50
attcctctgtcactagctcc

SEQ ID NO: 45378 - DNA, 20 bp, Human papillomavirus type 50
ctctgtcactagctcctcaa

SEQ ID NO: 45379 - DNA, 20 bp, Human papillomavirus type 50
ggcccaaaatcagagggata

SEQ ID NO: 45380 - DNA, 20 bp, Human papillomavirus type 50
cttattgcttttaaaaatcc

SEQ ID NO: 45381 - DNA, 20 bp, Human papillomavirus type 50
ttgcttttaaaaatcctgaa

SEQ ID NO: 45382 - DNA, 20 bp, Human papillomavirus type 50
cttttaaaaatcctgaacaa

SEQ ID NO: 45383 - DNA, 20 bp, Human papillomavirus type 50
taaaaatcctgaacaaaggc

SEQ ID NO: 45384 - DNA, 20 bp, Human papillomavirus type 50
gttattgaaaatatttggag

SEQ ID NO: 45385 - DNA, 20 bp, Human papillomavirus type 50
ttgaaaatatttggaggttt

SEQ ID NO: 45386 - DNA, 20 bp, Human papillomavirus type 50
aaaatatttggaggtttagt

SEQ ID NO: 45387 - DNA, 20 bp, Human papillomavirus type 50
ggaggtttagtatactttgg

SEQ ID NO: 45388 - DNA, 20 bp, Human papillomavirus type 50
gaggtttagtatactttggc

SEQ ID NO: 45389 - DNA, 20 bp, Human papillomavirus type 50
gatttgcagctccagatgct

SEQ ID NO: 45390 - DNA, 20 bp, Human papillomavirus type 50
gcagctccagatgctggacc

SEQ ID NO: 45391 - DNA, 20 bp, Human papillomavirus type 50
cagctccagatgctggacct

SEQ ID NO: 45392 - DNA, 20 bp, Human papillomavirus type 50
aattatatactataacaaat

SEQ ID NO: 45393 - DNA, 20 bp, Human papillomavirus type 50
tatactataacaaattccac

SEQ ID NO: 45394 - DNA, 20 bp, Human papillomavirus type 50
gcaggagacactgtaggtga

SEQ ID NO: 45395 - DNA, 20 bp, Human papillomavirus type 50
caggagacactgtaggtgac

SEQ ID NO: 45396 - DNA, 20 bp, Human papillomavirus type 50
tatgaagagatacctttgga

SEQ ID NO: 45397 - DNA, 20 bp, Human papillomavirus type 50
atgaagagatacctttggaa

SEQ ID NO: 45398 - DNA, 20 bp, Human papillomavirus type 50
tgaagagatacctttggaac

SEQ ID NO: 45399 - DNA, 20 bp, Human papillomavirus type 50
gacccagatgtgagcctata

SEQ ID NO: 45400 - DNA, 20 bp, Human papillomavirus type 50
acccagatgtgagcctatac

SEQ ID NO: 45401 - DNA, 20 bp, Human papillomavirus type 50
gagcgggatttggaaggcct

SEQ ID NO: 45402 - DNA, 20 bp, Human papillomavirus type 50
agcgggatttggaaggcctc

SEQ ID NO: 45403 - DNA, 20 bp, Human papillomavirus type 50
ggaaggcctcagggcagcgc

SEQ ID NO: 45404 - DNA, 20 bp, Human papillomavirus type 50
taagcaccgatgaatatgtg

SEQ ID NO: 45405 - DNA, 20 bp, Human papillomavirus type 50
aagcaccgatgaatatgtga

SEQ ID NO: 45406 - DNA, 20 bp, Human papillomavirus type 50
agcaccgatgaatatgtgaa

SEQ ID NO: 45407 - DNA, 20 bp, Human papillomavirus type 50
actttcatgcacgcagtgag

SEQ ID NO: 45408 - DNA, 20 bp, Human papillomavirus type 50
ctttcatgcacgcagtgagc

SEQ ID NO: 45409 - DNA, 20 bp, Human papillomavirus type 50
aggtgttggatctactggtc

SEQ ID NO: 45410 - DNA, 20 bp, Human papillomavirus type 50
ggtgttggatctactggtca

SEQ ID NO: 45411 - DNA, 20 bp, Human papillomavirus type 50
gatctactggtcatcccttg

SEQ ID NO: 45412 - DNA, 20 bp, Human papillomavirus type 50
tttaataaggttggagacac

SEQ ID NO: 45413 - DNA, 20 bp, Human papillomavirus type 50
aataaggttggagacacaga

SEQ ID NO: 45414 - DNA, 20 bp, Human papillomavirus type 50
tattcaggatggtgatatgg

SEQ ID NO: 45415 - DNA, 20 bp, Human papillomavirus type 50
aggatggtgatatgggagat

SEQ ID NO: 45416 - DNA, 20 bp, Human papillomavirus type 50
ggtaatgcaaactttcctaa

SEQ ID NO: 45417 - DNA, 20 bp, Human papillomavirus type 50
gtaatgcaaactttcctaaa

SEQ ID NO: 45418 - DNA, 20 bp, Human papillomavirus type 50
cctaaactacaacaggacag

SEQ ID NO: 45419 - DNA, 20 bp, Human papillomavirus type 109
tattgcctgttaatctgctt

SEQ ID NO: 45420 - DNA, 20 bp, Human papillomavirus type 109
cctgttaatctgctttgtaa

SEQ ID NO: 45421 - DNA, 20 bp, Human papillomavirus type 109
atctgctttgtaacgaggat

SEQ ID NO: 45422 - DNA, 20 bp, Human papillomavirus type 109
gtaacgaggatttgtcacaa

SEQ ID NO: 45423 - DNA, 20 bp, Human papillomavirus type 109
taacgaggatttgtcacaag

SEQ ID NO: 45424 - DNA, 20 bp, Human papillomavirus type 109
cagtgtgtaagcctttcagc

SEQ ID NO: 45425 - DNA, 20 bp, Human papillomavirus type 109
cagcttcttcaaagaacatt

SEQ ID NO: 45426 - DNA, 20 bp, Human papillomavirus type 109
agcttcttcaaagaacatta

SEQ ID NO: 45427 - DNA, 20 bp, Human papillomavirus type 109
ttcaaagaacattaaaagac

SEQ ID NO: 45428 - DNA, 20 bp, Human papillomavirus type 109
aaagaacattaaaagacgtc

SEQ ID NO: 45429 - DNA, 20 bp, Human papillomavirus type 109
gacgacgacgacgagaaaga

SEQ ID NO: 45430 - DNA, 20 bp, Human papillomavirus type 109
tctttctcgtcgtcgtcgtc

SEQ ID NO: 45431 - DNA, 20 bp, Human papillomavirus type 109
ctcgtcgtcgtcgtcgaagt

SEQ ID NO: 45432 - DNA, 20 bp, Human papillomavirus type 109
tcgtcgtcgtcgtcgaagtc

SEQ ID NO: 45433 - DNA, 20 bp, Human papillomavirus type 109
taggcgtcgacgcactggtg

SEQ ID NO: 45434 - DNA, 20 bp, Human papillomavirus type 109
tttgcttaaaaggtcctgct

SEQ ID NO: 45435 - DNA, 20 bp, Human papillomavirus type 109
gcttaaaaggtcctgctaat

SEQ ID NO: 45436 - DNA, 20 bp, Human papillomavirus type 109
cttaaaaggtcctgctaata

SEQ ID NO: 45437 - DNA, 20 bp, Human papillomavirus type 109
aaaggtcctgctaatacatt

SEQ ID NO: 45438 - DNA, 20 bp, Human papillomavirus type 109
aaatgctggagatatcgctg

SEQ ID NO: 45439 - DNA, 20 bp, Human papillomavirus type 109
tgattagaccaaacatagtg

SEQ ID NO: 45440 - DNA, 20 bp, Human papillomavirus type 109
gaccaaacatagtggttgaa

SEQ ID NO: 45441 - DNA, 20 bp, Human papillomavirus type 109
aacctgtaggaccttcagaa

SEQ ID NO: 45442 - DNA, 20 bp, Human papillomavirus type 109
agaattggtgccaatagacg

SEQ ID NO: 45443 - DNA, 20 bp, Human papillomavirus type 109
gtgccaatagacgccctaaa

SEQ ID NO: 45444 - DNA, 20 bp, Human papillomavirus type 109
gaaaacctagatgtgctagt

SEQ ID NO: 45445 - DNA, 20 bp, Human papillomavirus type 109
cacttctattattgcagctg

SEQ ID NO: 45446 - DNA, 20 bp, Human papillomavirus type 109
tattattgcagctgtatcgt

SEQ ID NO: 45447 - DNA, 20 bp, Human papillomavirus type 109
ttgcagctgtatcgtctgca

SEQ ID NO: 45448 - DNA, 20 bp, Human papillomavirus type 109
cagctgtatcgtctgcagtt

SEQ ID NO: 45449 - DNA, 20 bp, Human papillomavirus type 109
tagtagagctttttttagag

SEQ ID NO: 45450 - DNA, 20 bp, Human papillomavirus type 109
agtagagctttttttagagc

SEQ ID NO: 45451 - DNA, 20 bp, Human papillomavirus type 109
gtagagctttttttagagca

SEQ ID NO: 45452 - DNA, 20 bp, Human papillomavirus type 109
ttttagagcaagggagttgt

SEQ ID NO: 45453 - DNA, 20 bp, Human papillomavirus type 109
tttagagcaagggagttgta

SEQ ID NO: 45454 - DNA, 20 bp, Human papillomavirus type 109
attatttcctgaagaggagt

SEQ ID NO: 45455 - DNA, 20 bp, Human papillomavirus type 109
ttatttcctgaagaggagtt

SEQ ID NO: 45456 - DNA, 20 bp, Human papillomavirus type 109
tttcctgaagaggagttagt

SEQ ID NO: 45457 - DNA, 20 bp, Human papillomavirus type 109
cctgaagaggagttagtaga

SEQ ID NO: 45458 - DNA, 20 bp, Human papillomavirus type 109
ctgaagaggagttagtagat

SEQ ID NO: 45459 - DNA, 20 bp, Human papillomavirus type 109
ttaatattttacagatgtca

SEQ ID NO: 45460 - DNA, 20 bp, Human papillomavirus type 109
taatattttacagatgtcat

SEQ ID NO: 45461 - DNA, 20 bp, Human papillomavirus type 109
aatattttacagatgtcata

SEQ ID NO: 45462 - DNA, 20 bp, Human papillomavirus type 109
atattttacagatgtcatat

SEQ ID NO: 45463 - DNA, 20 bp, Human papillomavirus type 109
tacagatgtcatattggctg

SEQ ID NO: 45464 - DNA, 20 bp, Human papillomavirus type 109
gtttagctgcaagaacaaat

SEQ ID NO: 45465 - DNA, 20 bp, Human papillomavirus type 109
agctgcaagaacaaattctt

SEQ ID NO: 45466 - DNA, 20 bp, Human papillomavirus type 109
gctgcaagaacaaattcttt

SEQ ID NO: 45467 - DNA, 20 bp, Human papillomavirus type 109
tttgacaggtaaacgtaaac

SEQ ID NO: 45468 - DNA, 20 bp, Human papillomavirus type 109
gacaggtaaacgtaaacgtg

SEQ ID NO: 45469 - DNA, 20 bp, Human papillomavirus type 109
ggccaattgccatgcaggtg

SEQ ID NO: 45470 - DNA, 20 bp, Human papillomavirus type 109
gccaattgccatgcaggtgg

SEQ ID NO: 45471 - DNA, 20 bp, Human papillomavirus type 109
ccatgcaggtggtaccccac

SEQ ID NO: 45472 - DNA, 20 bp, Human papillomavirus type 109
ataggtatatcctggactca

SEQ ID NO: 45473 - DNA, 20 bp, Human papillomavirus type 109
taaacacaaagtgttttgga

SEQ ID NO: 45474 - DNA, 20 bp, Human papillomavirus type 121
taacacctttggcttttctt

SEQ ID NO: 45475 - DNA, 20 bp, Human papillomavirus type 121
ggcttttctttaaaggacat

SEQ ID NO: 45476 - DNA, 20 bp, Human papillomavirus type 121
gcttttctttaaaggacatt

SEQ ID NO: 45477 - DNA, 20 bp, Human papillomavirus type 121
tctttaaaggacattagact

SEQ ID NO: 45478 - DNA, 20 bp, Human papillomavirus type 121
ctttaaaggacattagacta

SEQ ID NO: 45479 - DNA, 20 bp, Human papillomavirus type 121
gatgagcaaccttatagaat

SEQ ID NO: 45480 - DNA, 20 bp, Human papillomavirus type 121
tagaatagattcagtgtgca

SEQ ID NO: 45481 - DNA, 20 bp, Human papillomavirus type 121
agtgtgcagagtttgtaaaa

SEQ ID NO: 45482 - DNA, 20 bp, Human papillomavirus type 121
gtaaaacgtcaatcagattt

SEQ ID NO: 45483 - DNA, 20 bp, Human papillomavirus type 121
taaaacgtcaatcagatttt

SEQ ID NO: 45484 - DNA, 20 bp, Human papillomavirus type 121
gtcttcacaaaaaaacagta

SEQ ID NO: 45485 - DNA, 20 bp, Human papillomavirus type 121
tcttcacaaaaaaacagtaa

SEQ ID NO: 45486 - DNA, 20 bp, Human papillomavirus type 121
acaaaaaaacagtaaaagac

SEQ ID NO: 45487 - DNA, 20 bp, Human papillomavirus type 121
tttgagaacagtggcagtgc

SEQ ID NO: 45488 - DNA, 20 bp, Human papillomavirus type 121
gagaacagtggcagtgcaga

SEQ ID NO: 45489 - DNA, 20 bp, Human papillomavirus type 121
atatttctataagtgtacaa

SEQ ID NO: 45490 - DNA, 20 bp, Human papillomavirus type 121
tatttctataagtgtacaac

SEQ ID NO: 45491 - DNA, 20 bp, Human papillomavirus type 121
ctataagtgtacaactggaa

SEQ ID NO: 45492 - DNA, 20 bp, Human papillomavirus type 121
tataagtgtacaactggaaa

SEQ ID NO: 45493 - DNA, 20 bp, Human papillomavirus type 121
atggtagaacatcaatcagc

SEQ ID NO: 45494 - DNA, 20 bp, Human papillomavirus type 121
catgaatagtcacagtcatt

SEQ ID NO: 45495 - DNA, 20 bp, Human papillomavirus type 121
ttggattcaaccattgatag

SEQ ID NO: 45496 - DNA, 20 bp, Human papillomavirus type 121
tggattcaaccattgataga

SEQ ID NO: 45497 - DNA, 20 bp, Human papillomavirus type 121
ggattcaaccattgatagat

SEQ ID NO: 45498 - DNA, 20 bp, Human papillomavirus type 121
gattcaaccattgatagatt

SEQ ID NO: 45499 - DNA, 20 bp, Human papillomavirus type 121
gatgctgtgcaagaagctct

SEQ ID NO: 45500 - DNA, 20 bp, Human papillomavirus type 121
actctatatgaaaatgctgc

SEQ ID NO: 45501 - DNA, 20 bp, Human papillomavirus type 121
atacacaaatacagcactgg

SEQ ID NO: 45502 - DNA, 20 bp, Human papillomavirus type 121
ataattcccagtgctgtatt

SEQ ID NO: 45503 - DNA, 20 bp, Human papillomavirus type 121
ccagtgctgtatttgtgtat

SEQ ID NO: 45504 - DNA, 20 bp, Human papillomavirus type 121
tcagttactggagaatggga

SEQ ID NO: 45505 - DNA, 20 bp, Human papillomavirus type 121
ctggagaatgggaggtgaaa

SEQ ID NO: 45506 - DNA, 20 bp, Human papillomavirus type 121
ctccctctgttacctctagc

SEQ ID NO: 45507 - DNA, 20 bp, Human papillomavirus type 121
tccctctgttacctctagct

SEQ ID NO: 45508 - DNA, 20 bp, Human papillomavirus type 121
cctctagctcctctcccact

SEQ ID NO: 45509 - DNA, 20 bp, Human papillomavirus type 121
ttatcctttaaagacactgc

SEQ ID NO: 45510 - DNA, 20 bp, Human papillomavirus type 121
tcctttaaagacactgcaca

SEQ ID NO: 45511 - DNA, 20 bp, Human papillomavirus type 121
aaagacactgcacaaagaca

SEQ ID NO: 45512 - DNA, 20 bp, Human papillomavirus type 121
aagacactgcacaaagacaa

SEQ ID NO: 45513 - DNA, 20 bp, Human papillomavirus type 121
tttttggacactgtcacact

SEQ ID NO: 45514 - DNA, 20 bp, Human papillomavirus type 121
ttcctatagatactgttgat

SEQ ID NO: 45515 - DNA, 20 bp, Human papillomavirus type 121
ctatagatactgttgatcca

SEQ ID NO: 45516 - DNA, 20 bp, Human papillomavirus type 121
atccagcagggcctgctttg

SEQ ID NO: 45517 - DNA, 20 bp, Human papillomavirus type 121
ggtgcctctaaatgaaggca

SEQ ID NO: 45518 - DNA, 20 bp, Human papillomavirus type 121
gtgcctctaaatgaaggcaa

SEQ ID NO: 45519 - DNA, 20 bp, Human papillomavirus type 121
taaagctcgtgacctctata

SEQ ID NO: 45520 - DNA, 20 bp, Human papillomavirus type 121
ttaaatcagccttcccgcct

SEQ ID NO: 45521 - DNA, 20 bp, Human papillomavirus type 121
taaatcagccttcccgccta

SEQ ID NO: 45522 - DNA, 20 bp, Human papillomavirus type 121
aaatcagccttcccgcctag

SEQ ID NO: 45523 - DNA, 20 bp, Human papillomavirus type 121
aatcagccttcccgcctagt

SEQ ID NO: 45524 - DNA, 20 bp, Human papillomavirus type 121
gaaggtgtttgtaacagata

SEQ ID NO: 45525 - DNA, 20 bp, Human papillomavirus type 121
aaggtgtttgtaacagatat

SEQ ID NO: 45526 - DNA, 20 bp, Human papillomavirus type 121
gtaacagatatagcacaacc

SEQ ID NO: 45527 - DNA, 20 bp, Human papillomavirus type 121
taacagatatagcacaacca

SEQ ID NO: 45528 - DNA, 20 bp, Human papillomavirus type 121
gtgtcatacccacaaacaaa

SEQ ID NO: 45529 - DNA, 20 bp, Human papillomavirus type 121
agggttatgctgccagatcc

SEQ ID NO: 45530 - DNA, 20 bp, Human papillomavirus type 121
tgctgccagatccaaacaaa

SEQ ID NO: 45531 - DNA, 20 bp, Human papillomavirus type 121
gcattagttgatacagatgt

SEQ ID NO: 45532 - DNA, 20 bp, Human papillomavirus type 121
cattagttgatacagatgtt

SEQ ID NO: 45533 - DNA, 20 bp, Human papillomavirus type 121
gttgatacagatgtttataa

SEQ ID NO: 45534 - DNA, 20 bp, Human papillomavirus type 121
tacctgtaagtggcccgatt

SEQ ID NO: 45535 - DNA, 20 bp, Human papillomavirus type 121
tgttaaaatgacaaaggaat

SEQ ID NO: 45536 - DNA, 20 bp, Human papillomavirus type 121
gttaaaatgacaaaggaatc

SEQ ID NO: 45537 - DNA, 20 bp, Human papillomavirus type 121
ttaaaatgacaaaggaatcc

SEQ ID NO: 45538 - DNA, 20 bp, Human papillomavirus type 121
aaatgacaaaggaatcctat

SEQ ID NO: 45539 - DNA, 20 bp, Human papillomavirus type 121
tgtctcatattaatgctatg

SEQ ID NO: 45540 - DNA, 20 bp, Human papillomavirus type 121
gtctcatattaatgctatga

SEQ ID NO: 45541 - DNA, 20 bp, Human papillomavirus type 121
tctcatattaatgctatgaa

SEQ ID NO: 45542 - DNA, 20 bp, Human papillomavirus type 121
atgctatgaatccttctata

SEQ ID NO: 45543 - DNA, 20 bp, Human papillomavirus type 121
tatattagaagactggaatt

SEQ ID NO: 45544 - DNA, 20 bp, Human papillomavirus type 121
aataaaattgcaatgcttgc

SEQ ID NO: 45545 - DNA, 20 bp, Human papillomavirus type 121
ataaaattgcaatgcttgca

SEQ ID NO: 45546 - DNA, 20 bp, Human papillomavirus type 121
caatgcttgcaccttaatgt

SEQ ID NO: 45547 - DNA, 20 bp, Human papillomavirus type 121
caccttaatgtttcattgct

SEQ ID NO: 45548 - DNA, 20 bp, Human papillomavirus type 121
atgtttcattgcttttgttt

SEQ ID NO: 45549 - DNA, 20 bp, Human papillomavirus type 121
cgttactggctgtgtgcctt

SEQ ID NO: 45550 - DNA, 20 bp, Human papillomavirus type 121
gttactggctgtgtgccttt

SEQ ID NO: 45551 - DNA, 20 bp, Human papillomavirus type 121
ctggctgtgtgcctttgtac

SEQ ID NO: 45552 - DNA, 20 bp, Human papillomavirus type 121
gtaccgggagtggtaactgc

SEQ ID NO: 45553 - DNA, 20 bp, Human papillomavirus type 121
taccgggagtggtaactgct

SEQ ID NO: 45554 - DNA, 20 bp, Human herpesvirus 1
cgtgaacaagactatcacgg

SEQ ID NO: 45555 - DNA, 20 bp, Human herpesvirus 1
cccgtctccatgtccaggat

SEQ ID NO: 45556 - DNA, 20 bp, Human herpesvirus 1
ttcacgtaaggcgacagggc

SEQ ID NO: 45557 - DNA, 20 bp, Human herpesvirus 1
acgtaaggcgacagggcgac

SEQ ID NO: 45558 - DNA, 20 bp, Human herpesvirus 1
cgtcctcaagttttcgcacc

SEQ ID NO: 45559 - DNA, 20 bp, Human herpesvirus 1
tcgcacccgtcgcccctctc

SEQ ID NO: 45560 - DNA, 20 bp, Human herpesvirus 1
cgcacccgtcgcccctctcc

SEQ ID NO: 45561 - DNA, 20 bp, Human herpesvirus 1
gcacccgtcgcccctctcca

SEQ ID NO: 45562 - DNA, 20 bp, Human herpesvirus 1
cgaacggaaccttggagagg

SEQ ID NO: 45563 - DNA, 20 bp, Human herpesvirus 1
gacacgccaaaccacgagtc

SEQ ID NO: 45564 - DNA, 20 bp, Human herpesvirus 1
cattcggggtgccgctgtgg

SEQ ID NO: 45565 - DNA, 20 bp, Human herpesvirus 1
ggggtgccgctgtggcctca

SEQ ID NO: 45566 - DNA, 20 bp, Human herpesvirus 1
cgggcccccgtgtaaaggtt

SEQ ID NO: 45567 - DNA, 20 bp, Human herpesvirus 1
gtcaggtgaggccacagcgg

SEQ ID NO: 45568 - DNA, 20 bp, Human herpesvirus 1
aggcgcaggttgccgggcgt

SEQ ID NO: 45569 - DNA, 20 bp, Human herpesvirus 1
ccgggcgtaaagcagatggc

SEQ ID NO: 45570 - DNA, 20 bp, Human herpesvirus 1
tccaggctaaggccctggga

SEQ ID NO: 45571 - DNA, 20 bp, Human herpesvirus 1
ccatgaccatcacgcgctcc

SEQ ID NO: 45572 - DNA, 20 bp, Human herpesvirus 1
gcctggacaaggtcgccatc

SEQ ID NO: 45573 - DNA, 20 bp, Human herpesvirus 1
gtcccgcaagaccacgtaag

SEQ ID NO: 45574 - DNA, 20 bp, Human herpesvirus 1
cagtaactcggccacgttgg

SEQ ID NO: 45575 - DNA, 20 bp, Human herpesvirus 1
gccgtcgcgtgccgcctccg

SEQ ID NO: 45576 - DNA, 20 bp, Human herpesvirus 1
ctggaagaggcccccctgcc

SEQ ID NO: 45577 - DNA, 20 bp, Human herpesvirus 1
cgtggtcttgcgggaccaac

SEQ ID NO: 45578 - DNA, 20 bp, Human herpesvirus 1
gctgtgcacctcgcagcgca

SEQ ID NO: 45579 - DNA, 20 bp, Human herpesvirus 1
ctgtgcacctcgcagcgcat

SEQ ID NO: 45580 - DNA, 20 bp, Human herpesvirus 1
gtgatgcggctggcgttggc

SEQ ID NO: 45581 - DNA, 20 bp, Human herpesvirus 1
gccgtgagccacttttcaat

SEQ ID NO: 45582 - DNA, 20 bp, Human herpesvirus 1
aaaagtggctcacggccaac

SEQ ID NO: 45583 - DNA, 20 bp, Human herpesvirus 1
aggtaggcgtggagcttggc

SEQ ID NO: 45584 - DNA, 20 bp, Human herpesvirus 1
gccatgtacgcgctcacctc

SEQ ID NO: 45585 - DNA, 20 bp, Human herpesvirus 1
gtgggaggagaacagccgcg

SEQ ID NO: 45586 - DNA, 20 bp, Human herpesvirus 1
tgggaggagaacagccgcgt

SEQ ID NO: 45587 - DNA, 20 bp, Human herpesvirus 1
tcctcccacaaagaggtgag

SEQ ID NO: 45588 - DNA, 20 bp, Human herpesvirus 1
ctggtgctcgaaggtcgact

SEQ ID NO: 45589 - DNA, 20 bp, Human herpesvirus 1
tggtgctcgaaggtcgactc

SEQ ID NO: 45590 - DNA, 20 bp, Human herpesvirus 1
gtgtgtgtgggctcgccgac

SEQ ID NO: 45591 - DNA, 20 bp, Human herpesvirus 1
gagcaccagaaactgcggtg

SEQ ID NO: 45592 - DNA, 20 bp, Human herpesvirus 1
gagcttgcctgtctgctgat

SEQ ID NO: 45593 - DNA, 20 bp, Human herpesvirus 1
agcttgcctgtctgctgatg

SEQ ID NO: 45594 - DNA, 20 bp, Human herpesvirus 1
cctgtctgctgatgtacctg

SEQ ID NO: 45595 - DNA, 20 bp, Human herpesvirus 1
gcaaaggtcgacggggtggc

SEQ ID NO: 45596 - DNA, 20 bp, Human herpesvirus 1
gggggcagttctccaggtac

SEQ ID NO: 45597 - DNA, 20 bp, Human herpesvirus 1
atggtgcacgtaaaaccgtt

SEQ ID NO: 45598 - DNA, 20 bp, Human herpesvirus 1
gacgacgagttcgtcctgcc

SEQ ID NO: 45599 - DNA, 20 bp, Human herpesvirus 1
gtcctgccccactggtacat

SEQ ID NO: 45600 - DNA, 20 bp, Human herpesvirus 1
ttggccagcaggtaccgggc

SEQ ID NO: 45601 - DNA, 20 bp, Human herpesvirus 1
gccagcaggtaccgggccat

SEQ ID NO: 45602 - DNA, 20 bp, Human herpesvirus 1
gccccagattatcttgaaca

SEQ ID NO: 45603 - DNA, 20 bp, Human herpesvirus 1
tcttgaacagcgccaccgcg

SEQ ID NO: 45604 - DNA, 20 bp, Human herpesvirus 1
aacagcgccaccgcgtggtc

SEQ ID NO: 45605 - DNA, 20 bp, Human herpesvirus 1
gcgagacggaccacgcggtg

SEQ ID NO: 45606 - DNA, 20 bp, Human herpesvirus 1
aagataatctggggcgaact

SEQ ID NO: 45607 - DNA, 20 bp, Human herpesvirus 1
ggactcggcggccgggggat

SEQ ID NO: 45608 - DNA, 20 bp, Human herpesvirus 1
ggccccgatgacgtgctgga

SEQ ID NO: 45609 - DNA, 20 bp, Human herpesvirus 1
tttcgtcgacggtctccttc

SEQ ID NO: 45610 - DNA, 20 bp, Human herpesvirus 1
ttcgtcgacggtctccttcg

SEQ ID NO: 45611 - DNA, 20 bp, Human herpesvirus 1
tcgtcgacggtctccttcgc

SEQ ID NO: 45612 - DNA, 20 bp, Human herpesvirus 1
cgtcgacggtctccttcgcg

SEQ ID NO: 45613 - DNA, 20 bp, Human herpesvirus 1
gtcgacggtctccttcgcgg

SEQ ID NO: 45614 - DNA, 20 bp, Human herpesvirus 1
ccgcagccagcggatcagcg

SEQ ID NO: 45615 - DNA, 20 bp, Human herpesvirus 1
ttcccgaccccattggcgcg

SEQ ID NO: 45616 - DNA, 20 bp, Human herpesvirus 1
tcccgaccccattggcgcgc

SEQ ID NO: 45617 - DNA, 20 bp, Human herpesvirus 1
cccgaccccattggcgcgcg

SEQ ID NO: 45618 - DNA, 20 bp, Human herpesvirus 1
ccgaccccattggcgcgcgg

SEQ ID NO: 45619 - DNA, 20 bp, Human herpesvirus 1
ctggcccatcgcatcagcca

SEQ ID NO: 45620 - DNA, 20 bp, Human herpesvirus 1
acgtcctgcactttgcgtgt

SEQ ID NO: 45621 - DNA, 20 bp, Human herpesvirus 1
cgtcctgcactttgcgtgtc

SEQ ID NO: 45622 - DNA, 20 bp, Human herpesvirus 1
gcgtgtctggtgtattttgc

SEQ ID NO: 45623 - DNA, 20 bp, Human herpesvirus 1
cgtgtctggtgtattttgcg

SEQ ID NO: 45624 - DNA, 20 bp, Human herpesvirus 1
gctggatggccttatagatc

SEQ ID NO: 45625 - DNA, 20 bp, Human herpesvirus 1
gacgacacgctcgccgagct

SEQ ID NO: 45626 - DNA, 20 bp, Human herpesvirus 1
tccggggcccggccctgctg

SEQ ID NO: 45627 - DNA, 20 bp, Human herpesvirus 1
cgccctcctccgcgctggtg

SEQ ID NO: 45628 - DNA, 20 bp, Human herpesvirus 1
atcggcaggcaccgcaccag

SEQ ID NO: 45629 - DNA, 20 bp, Human herpesvirus 1
tcggcaggcaccgcaccagc

SEQ ID NO: 45630 - DNA, 20 bp, Human herpesvirus 1
cgcctggaggacggcgccgg

SEQ ID NO: 45631 - DNA, 20 bp, Human herpesvirus 1
acgggcgaatgggagctcgg

SEQ ID NO: 45632 - DNA, 20 bp, Human herpesvirus 1
gcccgttaaccccccacgtg

SEQ ID NO: 45633 - DNA, 20 bp, Human herpesvirus 1
accccccacgtgatcagcac

SEQ ID NO: 45634 - DNA, 20 bp, Human herpesvirus 1
agctcgggaggcagcgccac

SEQ ID NO: 45635 - DNA, 20 bp, Human herpesvirus 1
tgtgtgtgctggtaatttat

SEQ ID NO: 45636 - DNA, 20 bp, Human herpesvirus 1
atacaccgatccgtaaacgc

SEQ ID NO: 45637 - DNA, 20 bp, Human herpesvirus 1
tacaccgatccgtaaacgcg

SEQ ID NO: 45638 - DNA, 20 bp, Human herpesvirus 1
acggatcggtgtataaatta

SEQ ID NO: 45639 - DNA, 20 bp, Human herpesvirus 1
gggccccggggatctcgagg

SEQ ID NO: 45640 - DNA, 20 bp, Human herpesvirus 1
atggcgaacacggggctgca

SEQ ID NO: 45641 - DNA, 20 bp, Human herpesvirus 1
cggatgcgcgtgagggtgag

SEQ ID NO: 45642 - DNA, 20 bp, Human herpesvirus 1
gccatcaaccccgccctaca

SEQ ID NO: 45643 - DNA, 20 bp, Human herpesvirus 1
ctcctcctggtccgcaagac

SEQ ID NO: 45644 - DNA, 20 bp, Human herpesvirus 1
ctaaccgcacaccgacggta

SEQ ID NO: 45645 - DNA, 20 bp, Human herpesvirus 1
taaccgcacaccgacggtac

SEQ ID NO: 45646 - DNA, 20 bp, Human herpesvirus 1
gtgagcgcctggacgccgtg

SEQ ID NO: 45647 - DNA, 20 bp, Human herpesvirus 1
cggaccaggaggagcaactc

SEQ ID NO: 45648 - DNA, 20 bp, Human herpesvirus 1
caagtgggccgcctttgcag

SEQ ID NO: 45649 - DNA, 20 bp, Human herpesvirus 1
gcagccataaaggcgccaac

SEQ ID NO: 45650 - DNA, 20 bp, Human herpesvirus 1
cagccataaaggcgccaaca

SEQ ID NO: 45651 - DNA, 20 bp, Human herpesvirus 1
ggtgctgacgccctcccggt

SEQ ID NO: 45652 - DNA, 20 bp, Human herpesvirus 1
gttggcgcctttatggctgc

SEQ ID NO: 45653 - DNA, 20 bp, Human herpesvirus 1
gcacgcatacgggcggccac

SEQ ID NO: 45654 - DNA, 20 bp, Human herpesvirus 1
ggaagggccacctgacacag

SEQ ID NO: 45655 - DNA, 20 bp, Human herpesvirus 1
ggtgtctaacggtcctcacc

SEQ ID NO: 45656 - DNA, 20 bp, Human herpesvirus 1
ctaacccagaccccgggcgc

SEQ ID NO: 45657 - DNA, 20 bp, Human herpesvirus 1
gccaagtgcgcgttcatggt

SEQ ID NO: 45658 - DNA, 20 bp, Human herpesvirus 1
atggttcgggggtgggtgtg

SEQ ID NO: 45659 - DNA, 20 bp, Human herpesvirus 1
gggggtgggtgtgggtgtgt

SEQ ID NO: 45660 - DNA, 20 bp, Human herpesvirus 1
ccgcggactcgggggacccg

SEQ ID NO: 45661 - DNA, 20 bp, Human herpesvirus 1
gccaacgaggtccagtacga

SEQ ID NO: 45662 - DNA, 20 bp, Human herpesvirus 1
tgaccaagtctgcgggggag

SEQ ID NO: 45663 - DNA, 20 bp, Human herpesvirus 1
ctgttgtaccgcccctcgac

SEQ ID NO: 45664 - DNA, 20 bp, Human herpesvirus 1
tgttgtaccgcccctcgacc

SEQ ID NO: 45665 - DNA, 20 bp, Human herpesvirus 1
taccgcccctcgaccaccac

SEQ ID NO: 45666 - DNA, 20 bp, Human herpesvirus 1
gtcagaacgggccggtcgtc

SEQ ID NO: 45667 - DNA, 20 bp, Human herpesvirus 1
cggaaaacggaacggcgcct

SEQ ID NO: 45668 - DNA, 20 bp, Human herpesvirus 1
tggtcgccgtcattatggcc

SEQ ID NO: 45669 - DNA, 20 bp, Human herpesvirus 1
tggccatctacctcgcggcc

SEQ ID NO: 45670 - DNA, 20 bp, Human herpesvirus 1
cgttttccggaatacgtacg

SEQ ID NO: 45671 - DNA, 20 bp, Human herpesvirus 1
tccggaatacgtacggacgt

SEQ ID NO: 45672 - DNA, 20 bp, Human herpesvirus 1
gctctccatcctgcatcagg

SEQ ID NO: 45673 - DNA, 20 bp, Human herpesvirus 1
ggggtgaatgagctgggcgg

SEQ ID NO: 45674 - DNA, 20 bp, Human herpesvirus 1
accccgaagccccggccctg

SEQ ID NO: 45675 - DNA, 20 bp, Human herpesvirus 1
acgaggcgctcgtcgcctgg

SEQ ID NO: 45676 - DNA, 20 bp, Human herpesvirus 1
cgaggcgctcgtcgcctggc

SEQ ID NO: 45677 - DNA, 20 bp, Human herpesvirus 1
aggtcccggatgcccctggc

SEQ ID NO: 45678 - DNA, 20 bp, Human herpesvirus 1
cgcgcgccaggggcgatgga

SEQ ID NO: 45679 - DNA, 20 bp, Human herpesvirus 1
gcgcgccaggggcgatggaa

SEQ ID NO: 45680 - DNA, 20 bp, Human herpesvirus 1
cggtttcccgttccgcttcc

SEQ ID NO: 45681 - DNA, 20 bp, Human herpesvirus 1
cccgttccgcttccatcgcc

SEQ ID NO: 45682 - DNA, 20 bp, Human herpesvirus 1
ggcggcgatgtcggccgacg

SEQ ID NO: 45683 - DNA, 20 bp, Human herpesvirus 1
gcggcgatgtcggccgacgt

SEQ ID NO: 45684 - DNA, 20 bp, Human herpesvirus 1
aagttctttacgtcggccga

SEQ ID NO: 45685 - DNA, 20 bp, Human herpesvirus 1
agttctttacgtcggccgac

SEQ ID NO: 45686 - DNA, 20 bp, Human herpesvirus 1
tttacgtcggccgacatcgc

SEQ ID NO: 45687 - DNA, 20 bp, Human herpesvirus 1
tcagtcacaaagcggtcctg

SEQ ID NO: 45688 - DNA, 20 bp, Human herpesvirus 1
gggttcaccgtcgtccgaca

SEQ ID NO: 45689 - DNA, 20 bp, Human herpesvirus 1
ggttcaccgtcgtccgacag

SEQ ID NO: 45690 - DNA, 20 bp, Human herpesvirus 1
accgtcgtccgacaggaccg

SEQ ID NO: 45691 - DNA, 20 bp, Human herpesvirus 1
gtgactgagaacgtgctgtt

SEQ ID NO: 45692 - DNA, 20 bp, Human herpesvirus 1
ttccagtagctggtgatgca

SEQ ID NO: 45693 - DNA, 20 bp, Human herpesvirus 1
cagtagctggtgatgcactg

SEQ ID NO: 45694 - DNA, 20 bp, Human herpesvirus 1
tgcgccctggcccggctcgt

SEQ ID NO: 45695 - DNA, 20 bp, Human herpesvirus 1
tccagcagcacgtgcagcat

SEQ ID NO: 45696 - DNA, 20 bp, Human herpesvirus 1
ccagcagcacgtgcagcatc

SEQ ID NO: 45697 - DNA, 20 bp, Human herpesvirus 1
cagcagcacgtgcagcatct

SEQ ID NO: 45698 - DNA, 20 bp, Human herpesvirus 1
gagcgcggcacggccgacca

SEQ ID NO: 45699 - DNA, 20 bp, Human herpesvirus 1
agcgcggcacggccgaccag

SEQ ID NO: 45700 - DNA, 20 bp, Human herpesvirus 1
caatacgaccccagcagggc

SEQ ID NO: 45701 - DNA, 20 bp, Human herpesvirus 1
gacgccctgctggggtcgta

SEQ ID NO: 45702 - DNA, 20 bp, Human herpesvirus 1
caacaccctgtcgctcgtgc

SEQ ID NO: 45703 - DNA, 20 bp, Human herpesvirus 1
ctggagctcgggttgtcggt

SEQ ID NO: 45704 - DNA, 20 bp, Human herpesvirus 1
tggagctcgggttgtcggtg

SEQ ID NO: 45705 - DNA, 20 bp, Human herpesvirus 1
ggttggtggcgataaagtgg

SEQ ID NO: 45706 - DNA, 20 bp, Human herpesvirus 1
gttggtggcgataaagtgga

SEQ ID NO: 45707 - DNA, 20 bp, Human herpesvirus 1
gtggcgataaagtggaaaag

SEQ ID NO: 45708 - DNA, 20 bp, Human herpesvirus 1
ttgggaggcacggccctgtg

SEQ ID NO: 45709 - DNA, 20 bp, Human herpesvirus 1
tgggaggcacggccctgtgt

SEQ ID NO: 45710 - DNA, 20 bp, Human herpesvirus 1
cgtcgccgcccgcgatggag

SEQ ID NO: 45711 - DNA, 20 bp, Human herpesvirus 1
gctacgccaccaccatgcac

SEQ ID NO: 45712 - DNA, 20 bp, Human herpesvirus 1
gaccggggtctcggatcggg

SEQ ID NO: 45713 - DNA, 20 bp, Human herpesvirus 1
gcgtgggcggcgttcacgaa

SEQ ID NO: 45714 - DNA, 20 bp, Human herpesvirus 1
cgtgggcggcgttcacgaaa

SEQ ID NO: 45715 - DNA, 20 bp, Human herpesvirus 1
acgaaagcaaaacccgacgt

SEQ ID NO: 45716 - DNA, 20 bp, Human herpesvirus 1
ggcgccagaagagagggggg

SEQ ID NO: 45717 - DNA, 20 bp, Human herpesvirus 1
tggcgcctaacggggctgct

SEQ ID NO: 45718 - DNA, 20 bp, Human herpesvirus 1
ggccaggcggtcgatgtgtc

SEQ ID NO: 45719 - DNA, 20 bp, Human herpesvirus 1
gccaggcggtcgatgtgtct

SEQ ID NO: 45720 - DNA, 20 bp, Human herpesvirus 1
cccggcacaaacatcgtgtt

SEQ ID NO: 45721 - DNA, 20 bp, Human herpesvirus 1
ggggcccttccggaggacag

SEQ ID NO: 45722 - DNA, 20 bp, Human herpesvirus 1
cggaggacagacacatcgac

SEQ ID NO: 45723 - DNA, 20 bp, Human herpesvirus 1
tacaaggcgctggccgaaga

SEQ ID NO: 45724 - DNA, 20 bp, Human herpesvirus 1
cacgccaccaagatctgcgg

SEQ ID NO: 45725 - DNA, 20 bp, Human herpesvirus 1
acgccaccaagatctgcggc

SEQ ID NO: 45726 - DNA, 20 bp, Human herpesvirus 1
acgctgttaagcgggtcgct

SEQ ID NO: 45727 - DNA, 20 bp, Human herpesvirus 1
agcgggtcgctgcagggtcg

SEQ ID NO: 45728 - DNA, 20 bp, Human herpesvirus 1
cgttccttccccctcccccc

SEQ ID NO: 45729 - DNA, 20 bp, Human herpesvirus 1
gttccttccccctccccccg

SEQ ID NO: 45730 - DNA, 20 bp, Human herpesvirus 1
cttccccctccccccgcgtc

SEQ ID NO: 45731 - DNA, 20 bp, Human herpesvirus 1
cccctccccccgcgtcagac

SEQ ID NO: 45732 - DNA, 20 bp, Human herpesvirus 1
agcggtggttagggtttgtc

SEQ ID NO: 45733 - DNA, 20 bp, Human herpesvirus 1
atagtcgccgattcccgaaa

SEQ ID NO: 45734 - DNA, 20 bp, Human herpesvirus 1
ccgaaacttcatcacccccg

SEQ ID NO: 45735 - DNA, 20 bp, Human herpesvirus 1
atcacccccgagttcccccg

SEQ ID NO: 45736 - DNA, 20 bp, Human herpesvirus 1
ccccgggacttttggatgtc

SEQ ID NO: 45737 - DNA, 20 bp, Human herpesvirus 1
tggatgtcgcccgtctttaa

SEQ ID NO: 45738 - DNA, 20 bp, Human herpesvirus 1
cgggacggccgtatgtccaa

SEQ ID NO: 45739 - DNA, 20 bp, Human herpesvirus 1
gggacggccgtatgtccaag

SEQ ID NO: 45740 - DNA, 20 bp, Human herpesvirus 1
atgacggcgctggtactgtc

SEQ ID NO: 45741 - DNA, 20 bp, Human herpesvirus 1
gacatacggccgtcccgaaa

SEQ ID NO: 45742 - DNA, 20 bp, Human herpesvirus 1
gcctcgtcaaagtcgccgcc

SEQ ID NO: 45743 - DNA, 20 bp, Human herpesvirus 1
gacgaggccaagctagccga

SEQ ID NO: 45744 - DNA, 20 bp, Human herpesvirus 1
acgaggccaagctagccgag

SEQ ID NO: 45745 - DNA, 20 bp, Human herpesvirus 1
aggtcgatgaaggtgctgac

SEQ ID NO: 45746 - DNA, 20 bp, Human herpesvirus 1
gaggagtacgcgtactccca

SEQ ID NO: 45747 - DNA, 20 bp, Human herpesvirus 1
atcgacctcaacatcaccat

SEQ ID NO: 45748 - DNA, 20 bp, Human herpesvirus 1
gggttcagcttgcgggcctc

SEQ ID NO: 45749 - DNA, 20 bp, Human herpesvirus 1
agcttgcgggcctcgttcca

SEQ ID NO: 45750 - DNA, 20 bp, Human herpesvirus 1
cgggcctcgttccacagggt

SEQ ID NO: 45751 - DNA, 20 bp, Human herpesvirus 1
cacagggtcagctcgtgatt

SEQ ID NO: 45752 - DNA, 20 bp, Human herpesvirus 1
gccaggtagtactgcggctg

SEQ ID NO: 45753 - DNA, 20 bp, Human herpesvirus 1
atgtgcgtcgcgttgtacct

SEQ ID NO: 45754 - DNA, 20 bp, Human herpesvirus 1
tacctgcgggcgaagatgcg

SEQ ID NO: 45755 - DNA, 20 bp, Human herpesvirus 1
gcccgcaggtacaacgcgac

SEQ ID NO: 45756 - DNA, 20 bp, Human herpesvirus 1
gtcatggtgcagaccgacgg

SEQ ID NO: 45757 - DNA, 20 bp, Human herpesvirus 1
ggctggttggaccccggggg

SEQ ID NO: 45758 - DNA, 20 bp, Human herpesvirus 1
gaccccgggggcttgccgtt

SEQ ID NO: 45759 - DNA, 20 bp, Human herpesvirus 1
ccgttggggaagatggccgc

SEQ ID NO: 45760 - DNA, 20 bp, Human herpesvirus 1
gggaagatggccgcgtggaa

SEQ ID NO: 45761 - DNA, 20 bp, Human herpesvirus 1
agcagaaagcccagcggtcc

SEQ ID NO: 45762 - DNA, 20 bp, Human herpesvirus 1
ttaaacatgtccatcacgcg

SEQ ID NO: 45763 - DNA, 20 bp, Human herpesvirus 1
aacatgtccatcacgcgccg

SEQ ID NO: 45764 - DNA, 20 bp, Human herpesvirus 1
gaattgattgcgaaagttgc

SEQ ID NO: 45765 - DNA, 20 bp, Human herpesvirus 1
attgcgaaagttgcgcccct

SEQ ID NO: 45766 - DNA, 20 bp, Human herpesvirus 1
cgaaagttgcgcccctcgac

SEQ ID NO: 45767 - DNA, 20 bp, Human herpesvirus 1
ggccatgacgcgctcggtcg

SEQ ID NO: 45768 - DNA, 20 bp, Human herpesvirus 1
ccttgtccgagcctcccagg

SEQ ID NO: 45769 - DNA, 20 bp, Human herpesvirus 1
tccgagcctcccaggtgcag

SEQ ID NO: 45770 - DNA, 20 bp, Human herpesvirus 1
ctgcacctgggaggctcgga

SEQ ID NO: 45771 - DNA, 20 bp, Human herpesvirus 1
tgcacctgggaggctcggac

SEQ ID NO: 45772 - DNA, 20 bp, Human herpesvirus 1
atggtggttgccgtcttggg

SEQ ID NO: 45773 - DNA, 20 bp, Human herpesvirus 1
ccgtcttgggctttgtctcc

SEQ ID NO: 45774 - DNA, 20 bp, Human herpesvirus 1
ggctttgtctccatgtcctt

SEQ ID NO: 45775 - DNA, 20 bp, Human herpesvirus 1
gtctccatgtccttttgtca

SEQ ID NO: 45776 - DNA, 20 bp, Human herpesvirus 1
tctccatgtccttttgtcaa

SEQ ID NO: 45777 - DNA, 20 bp, Human herpesvirus 1
taccgcgtctacgtccgaag

SEQ ID NO: 45778 - DNA, 20 bp, Human herpesvirus 1
accgcgtctacgtccgaagc

SEQ ID NO: 45779 - DNA, 20 bp, Human herpesvirus 1
ccgcgtctacgtccgaagcg

SEQ ID NO: 45780 - DNA, 20 bp, Human herpesvirus 1
tcgcacaggtacgacagcac

SEQ ID NO: 45781 - DNA, 20 bp, Human herpesvirus 1
ggacgtagacgcggtaaaac

SEQ ID NO: 45782 - DNA, 20 bp, Human herpesvirus 1
cccagagcagccccgaggag

SEQ ID NO: 45783 - DNA, 20 bp, Human herpesvirus 1
tccaggagcacggcctcctc

SEQ ID NO: 45784 - DNA, 20 bp, Human herpesvirus 1
cgcatggcgagccagtcccg

SEQ ID NO: 45785 - DNA, 20 bp, Human herpesvirus 1
gcatggcgagccagtcccgc

SEQ ID NO: 45786 - DNA, 20 bp, Human herpesvirus 1
ctgccccccatcaaactcga

SEQ ID NO: 45787 - DNA, 20 bp, Human herpesvirus 1
tgccccccatcaaactcgag

SEQ ID NO: 45788 - DNA, 20 bp, Human herpesvirus 1
gatggggggcagaaacagcg

SEQ ID NO: 45789 - DNA, 20 bp, Human herpesvirus 1
atggggggcagaaacagcgc

SEQ ID NO: 45790 - DNA, 20 bp, Human herpesvirus 1
tcgcccacggccgtcagccc

SEQ ID NO: 45791 - DNA, 20 bp, Human herpesvirus 1
ttttacccggaccccactta

SEQ ID NO: 45792 - DNA, 20 bp, Human herpesvirus 1
tacccggaccccacttacgg

SEQ ID NO: 45793 - DNA, 20 bp, Human herpesvirus 1
acccggaccccacttacggg

SEQ ID NO: 45794 - DNA, 20 bp, Human herpesvirus 1
cccggaccccacttacgggg

SEQ ID NO: 45795 - DNA, 20 bp, Human herpesvirus 1
cgggggccacatgctgtacg

SEQ ID NO: 45796 - DNA, 20 bp, Human herpesvirus 1
agagccaggaggctgggatc

SEQ ID NO: 45797 - DNA, 20 bp, Human herpesvirus 1
gagcgcgcgtatgtggcctt

SEQ ID NO: 45798 - DNA, 20 bp, Human herpesvirus 1
gatcccagcctcctggctct

SEQ ID NO: 45799 - DNA, 20 bp, Human herpesvirus 1
acgaggctctctgcgccgag

SEQ ID NO: 45800 - DNA, 20 bp, Human herpesvirus 1
gtgcgcatgccccgcgtgca

SEQ ID NO: 45801 - DNA, 20 bp, Human herpesvirus 1
tgcgcatgccccgcgtgcag

SEQ ID NO: 45802 - DNA, 20 bp, Human herpesvirus 1
cgttctatcagcccttggtt

SEQ ID NO: 45803 - DNA, 20 bp, Human herpesvirus 1
tatcagcccttggttggcgg

SEQ ID NO: 45804 - DNA, 20 bp, Human herpesvirus 1
gttggcggcgtccgtcagga

SEQ ID NO: 45805 - DNA, 20 bp, Human herpesvirus 1
gcggcgtccgtcaggacgga

SEQ ID NO: 45806 - DNA, 20 bp, Human herpesvirus 1
ggagcgtgtacgacaggggg

SEQ ID NO: 45807 - DNA, 20 bp, Human herpesvirus 1
tgtctccagcaggcccgccg

SEQ ID NO: 45808 - DNA, 20 bp, Human herpesvirus 1
ttcggggagcccgcggcggg

SEQ ID NO: 45809 - DNA, 20 bp, Human herpesvirus 1
ggggagcccgcggcgggcct

SEQ ID NO: 45810 - DNA, 20 bp, Human herpesvirus 1
ttcgccggcccgtgggccct

SEQ ID NO: 45811 - DNA, 20 bp, Human herpesvirus 1
cgagcaccggtgaccacgat

SEQ ID NO: 45812 - DNA, 20 bp, Human herpesvirus 1
catcgtggagtgcggtgggg

SEQ ID NO: 45813 - DNA, 20 bp, Human herpesvirus 1
gcgcccgacctggagccggg

SEQ ID NO: 45814 - DNA, 20 bp, Human herpesvirus 1
cccgcccggtcgagttcgcc

SEQ ID NO: 45815 - DNA, 20 bp, Human herpesvirus 1
gccctgcgtgtgttggcctg

SEQ ID NO: 45816 - DNA, 20 bp, Human herpesvirus 1
gcctgggcccgggactttgg

SEQ ID NO: 45817 - DNA, 20 bp, Human herpesvirus 1
ctcaccagggccaagaaccg

SEQ ID NO: 45818 - DNA, 20 bp, Human herpesvirus 1
cacgaacggggcggggaaga

SEQ ID NO: 45819 - DNA, 20 bp, Human herpesvirus 1
cccgccccgttcgtgcaaga

SEQ ID NO: 45820 - DNA, 20 bp, Human herpesvirus 1
gtgcaagagggcctccggtt

SEQ ID NO: 45821 - DNA, 20 bp, Human herpesvirus 1
ttggccctggtgagtaatcg

SEQ ID NO: 45822 - DNA, 20 bp, Human herpesvirus 1
ggctgtggggtgggtggttc

SEQ ID NO: 45823 - DNA, 20 bp, Human herpesvirus 1
gctgtggggtgggtggttcc

SEQ ID NO: 45824 - DNA, 20 bp, Human herpesvirus 1
cgccttgcgtgagtgtcctt

SEQ ID NO: 45825 - DNA, 20 bp, Human herpesvirus 1
cgtgagtgtcctttcgaccc

SEQ ID NO: 45826 - DNA, 20 bp, Human herpesvirus 1
cgacccccccccccctccct

SEQ ID NO: 45827 - DNA, 20 bp, Human herpesvirus 1
tgggtttcactgaaactggc

SEQ ID NO: 45828 - DNA, 20 bp, Human herpesvirus 1
gggtttcactgaaactggcc

SEQ ID NO: 45829 - DNA, 20 bp, Human herpesvirus 1
ggtttcactgaaactggccc

SEQ ID NO: 45830 - DNA, 20 bp, Human herpesvirus 1
cactgaaactggcccgcgcc

SEQ ID NO: 45831 - DNA, 20 bp, Human herpesvirus 1
actgaaactggcccgcgccc

SEQ ID NO: 45832 - DNA, 20 bp, Human herpesvirus 1
aacgactccggccccgggac

SEQ ID NO: 45833 - DNA, 20 bp, Human herpesvirus 1
acgactccggccccgggacc

SEQ ID NO: 45834 - DNA, 20 bp, Human herpesvirus 1
aacgcctgcacgcatagccc

SEQ ID NO: 45835 - DNA, 20 bp, Human herpesvirus 1
cgggcgaggatggcactgac

SEQ ID NO: 45836 - DNA, 20 bp, Human herpesvirus 1
gaggccggatggacgatctc

SEQ ID NO: 45837 - DNA, 20 bp, Human herpesvirus 1
gagccggcgatggccgcccc

SEQ ID NO: 45838 - DNA, 20 bp, Human herpesvirus 1
ctggagcagttgcggaccca

SEQ ID NO: 45839 - DNA, 20 bp, Human herpesvirus 1
tggagcagttgcggacccag

SEQ ID NO: 45840 - DNA, 20 bp, Human herpesvirus 1
cggacccaggcccccccacc

SEQ ID NO: 45841 - DNA, 20 bp, Human herpesvirus 1
ggggagcaggtgttcctgcc

SEQ ID NO: 45842 - DNA, 20 bp, Human herpesvirus 1
gggagcaggtgttcctgccc

SEQ ID NO: 45843 - DNA, 20 bp, Human herpesvirus 1
ctgcccctggaacactcgca

SEQ ID NO: 45844 - DNA, 20 bp, Human herpesvirus 1
agtcggtatcgctggcgcgg

SEQ ID NO: 45845 - DNA, 20 bp, Human herpesvirus 1
cgagtgttccaggggcagga

SEQ ID NO: 45846 - DNA, 20 bp, Human herpesvirus 1
acgcgaccggggccgatagt

SEQ ID NO: 45847 - DNA, 20 bp, Human herpesvirus 1
gagctcggggttaacggcaa

SEQ ID NO: 45848 - DNA, 20 bp, Human herpesvirus 1
acggcaaattttccgtgttc

SEQ ID NO: 45849 - DNA, 20 bp, Human herpesvirus 1
gccgttaaccccgagctcga

SEQ ID NO: 45850 - DNA, 20 bp, Human herpesvirus 1
ccgttaaccccgagctcgaa

SEQ ID NO: 45851 - DNA, 20 bp, Human herpesvirus 1
cggaaggggacacgggctac

SEQ ID NO: 45852 - DNA, 20 bp, Human herpesvirus 1
cggaatttatacccgggccc

SEQ ID NO: 45853 - DNA, 20 bp, Human herpesvirus 1
atacccgggccccatccggg

SEQ ID NO: 45854 - DNA, 20 bp, Human herpesvirus 1
tacccgggccccatccgggg

SEQ ID NO: 45855 - DNA, 20 bp, Human herpesvirus 1
aaggcgacgtgcacggccgc

SEQ ID NO: 45856 - DNA, 20 bp, Human herpesvirus 1
gtctggttcgaggacgacca

SEQ ID NO: 45857 - DNA, 20 bp, Human herpesvirus 1
tctggttcgaggacgaccac

SEQ ID NO: 45858 - DNA, 20 bp, Human herpesvirus 1
gaggacgaccaccaggtgtt

SEQ ID NO: 45859 - DNA, 20 bp, Human herpesvirus 1
aacacctggtggtcgtcctc

SEQ ID NO: 45860 - DNA, 20 bp, Human herpesvirus 1
gacgggggattcacggcccc

SEQ ID NO: 45861 - DNA, 20 bp, Human herpesvirus 1
acgggggattcacggccccc

SEQ ID NO: 45862 - DNA, 20 bp, Human herpesvirus 1
acggcccccgaggtgggcac

SEQ ID NO: 45863 - DNA, 20 bp, Human herpesvirus 1
ctccccgcgggacacacgcg

SEQ ID NO: 45864 - DNA, 20 bp, Human herpesvirus 1
tccccgcgggacacacgcgc

SEQ ID NO: 45865 - DNA, 20 bp, Human herpesvirus 1
tggggggaagtgggcagcgg

SEQ ID NO: 45866 - DNA, 20 bp, Human herpesvirus 1
ccgaggaatgacagcccgtg

SEQ ID NO: 45867 - DNA, 20 bp, Human herpesvirus 1
aagcaacccgcacgggccgc

SEQ ID NO: 45868 - DNA, 20 bp, Human herpesvirus 1
agcaacccgcacgggccgcc

SEQ ID NO: 45869 - DNA, 20 bp, Human herpesvirus 1
cttaaatgcgtggtggcgac

SEQ ID NO: 45870 - DNA, 20 bp, Human herpesvirus 1
accaactcgttggcgcgctg

SEQ ID NO: 45871 - DNA, 20 bp, Human herpesvirus 1
gcgcgctgaagcaggttttt

SEQ ID NO: 45872 - DNA, 20 bp, Human herpesvirus 1
ttgccctcgcagaccgtcac

SEQ ID NO: 45873 - DNA, 20 bp, Human herpesvirus 1
tgccctcgcagaccgtcacg

SEQ ID NO: 45874 - DNA, 20 bp, Human herpesvirus 1
agcgcgccaacgagttggtg

SEQ ID NO: 45875 - DNA, 20 bp, Human herpesvirus 1
ggacggcgggggtggtgcag

SEQ ID NO: 45876 - DNA, 20 bp, Human herpesvirus 1
tgcggaccctctcttctctc

SEQ ID NO: 45877 - DNA, 20 bp, Human herpesvirus 1
gcggaccctctcttctctcc

SEQ ID NO: 45878 - DNA, 20 bp, Human herpesvirus 1
cggaccctctcttctctccc

SEQ ID NO: 45879 - DNA, 20 bp, Human herpesvirus 1
tctcccgggccgcccctatc

SEQ ID NO: 45880 - DNA, 20 bp, Human herpesvirus 1
taggttcaccatgcaggcgt

SEQ ID NO: 45881 - DNA, 20 bp, Human herpesvirus 1
accatgcaggcgtggtacgt

SEQ ID NO: 45882 - DNA, 20 bp, Human herpesvirus 1
gcccgcacgtaccacgcctg

SEQ ID NO: 45883 - DNA, 20 bp, Human herpesvirus 1
tctaacgatgcggggggtgg

SEQ ID NO: 45884 - DNA, 20 bp, Human herpesvirus 1
gagaaccgtggacgacgtac

SEQ ID NO: 45885 - DNA, 20 bp, Human herpesvirus 1
gtcgcgctgagcgtcggggc

SEQ ID NO: 45886 - DNA, 20 bp, Human herpesvirus 1
tgtcagcagtgctttgccgc

SEQ ID NO: 45887 - DNA, 20 bp, Human herpesvirus 1
ggcggcaaagcactgctgac

SEQ ID NO: 45888 - DNA, 20 bp, Human herpesvirus 1
gcggcaaagcactgctgaca

SEQ ID NO: 45889 - DNA, 20 bp, Human herpesvirus 1
ttggccccgacgctcagcgc

SEQ ID NO: 45890 - DNA, 20 bp, Human herpesvirus 1
ataacggcgtacggcctcgt

SEQ ID NO: 45891 - DNA, 20 bp, Human herpesvirus 1
ggtgccagtccgctgcaccg

SEQ ID NO: 45892 - DNA, 20 bp, Human herpesvirus 1
ctgtatctggcgttcgtcgc

SEQ ID NO: 45893 - DNA, 20 bp, Human herpesvirus 1
gtcgccctccaccaacgccg

SEQ ID NO: 45894 - DNA, 20 bp, Human herpesvirus 1
ggcgtcgtgagtcccgccca

SEQ ID NO: 45895 - DNA, 20 bp, Human herpesvirus 1
gcgtcgtgagtcccgcccac

SEQ ID NO: 45896 - DNA, 20 bp, Human herpesvirus 1
tgggcgggactcacgacgcc

SEQ ID NO: 45897 - DNA, 20 bp, Human herpesvirus 1
ctcgtcggacgaggacatgg

SEQ ID NO: 45898 - DNA, 20 bp, Human herpesvirus 1
catgtcctcgtccgacgagg

SEQ ID NO: 45899 - DNA, 20 bp, Human herpesvirus 1
caggtcgtcgcggcggctct

SEQ ID NO: 45900 - DNA, 20 bp, Human herpesvirus 1
ctgcctcaacgccacctggc

SEQ ID NO: 45901 - DNA, 20 bp, Human herpesvirus 1
tgctggtgtgcatggccgtt

SEQ ID NO: 45902 - DNA, 20 bp, Human herpesvirus 1
gctggtgtgcatggccgttt

SEQ ID NO: 45903 - DNA, 20 bp, Human herpesvirus 1
ctggtgtgcatggccgtttc

SEQ ID NO: 45904 - DNA, 20 bp, Human herpesvirus 1
cggcctgccaggtggcgttg

SEQ ID NO: 45905 - DNA, 20 bp, Human herpesvirus 1
cgttcgtcgctggtcgtcgg

SEQ ID NO: 45906 - DNA, 20 bp, Human herpesvirus 1
gtcgctggtcgtcgggcgcc

SEQ ID NO: 45907 - DNA, 20 bp, Human herpesvirus 1
ggtcgaacgaacggccacga

SEQ ID NO: 45908 - DNA, 20 bp, Human herpesvirus 1
gttcgaccgaacagccgtcc

SEQ ID NO: 45909 - DNA, 20 bp, Human herpesvirus 1
gaccgaacagccgtccgggg

SEQ ID NO: 45910 - DNA, 20 bp, Human herpesvirus 1
ctaccagacaagctatcgta

SEQ ID NO: 45911 - DNA, 20 bp, Human herpesvirus 1
tctggtaggaacgaggggcc

SEQ ID NO: 45912 - DNA, 20 bp, Human herpesvirus 1
gtcgttattgatctggacac

SEQ ID NO: 45913 - DNA, 20 bp, Human herpesvirus 1
tcgttattgatctggacacc

SEQ ID NO: 45914 - DNA, 20 bp, Human herpesvirus 1
ttgatctggacacccccacg

SEQ ID NO: 45915 - DNA, 20 bp, Human herpesvirus 1
gggtaatggaaaaggcccta

SEQ ID NO: 45916 - DNA, 20 bp, Human herpesvirus 1
acgggctacgccttcgggaa

SEQ ID NO: 45917 - DNA, 20 bp, Human herpesvirus 1
ccgaaggcgtagcccgttaa

SEQ ID NO: 45918 - DNA, 20 bp, Human herpesvirus 1
acttggctggcttggatggg

SEQ ID NO: 45919 - DNA, 20 bp, Human herpesvirus 1
gctggcttggatggggagta

SEQ ID NO: 45920 - DNA, 20 bp, Human herpesvirus 1
ctcccccgttatcccactcg

SEQ ID NO: 45921 - DNA, 20 bp, Human herpesvirus 1
tcccactcgtcgagggcgcc

SEQ ID NO: 45922 - DNA, 20 bp, Human herpesvirus 1
aacaaagacgccgcgtttcc

SEQ ID NO: 45923 - DNA, 20 bp, Human herpesvirus 1
gttgaacgacaccggggcgc

SEQ ID NO: 45924 - DNA, 20 bp, Human herpesvirus 1
ttgaacgacaccggggcgcc

SEQ ID NO: 45925 - DNA, 20 bp, Human herpesvirus 1
gggggcggttttttctggac

SEQ ID NO: 45926 - DNA, 20 bp, Human herpesvirus 1
tttctggacatgtcggcgga

SEQ ID NO: 45927 - DNA, 20 bp, Human herpesvirus 1
ttctggacatgtcggcggaa

SEQ ID NO: 45928 - DNA, 20 bp, Human herpesvirus 1
tctggacatgtcggcggaat

SEQ ID NO: 45929 - DNA, 20 bp, Human herpesvirus 1
ctggacatgtcggcggaatc

SEQ ID NO: 45930 - DNA, 20 bp, Human herpesvirus 1
gccgcgaacggcgatcagag

SEQ ID NO: 45931 - DNA, 20 bp, Human herpesvirus 1
cttgcggaccacggcccggc

SEQ ID NO: 45932 - DNA, 20 bp, Human herpesvirus 1
ttgcggaccacggcccggcg

SEQ ID NO: 45933 - DNA, 20 bp, Human herpesvirus 1
cggaccacggcccggcgatg

SEQ ID NO: 45934 - DNA, 20 bp, Human herpesvirus 1
ctcgtctgggacctcgggca

SEQ ID NO: 45935 - DNA, 20 bp, Human herpesvirus 1
gcggaggacagccccttgga

SEQ ID NO: 45936 - DNA, 20 bp, Human herpesvirus 1
cggaggacagccccttggag

SEQ ID NO: 45937 - DNA, 20 bp, Human herpesvirus 1
gagagcaccgaggtcgtgga

SEQ ID NO: 45938 - DNA, 20 bp, Human herpesvirus 1
tgatgccaaaatgcggcact

SEQ ID NO: 45939 - DNA, 20 bp, Human herpesvirus 1
cgtcgacggaagtccggggc

SEQ ID NO: 45940 - DNA, 20 bp, Human herpesvirus 1
cgtcgacgcaagcccggccc

SEQ ID NO: 45941 - DNA, 20 bp, Human herpesvirus 1
ctgcttaggcagtgccgcat

SEQ ID NO: 45942 - DNA, 20 bp, Human herpesvirus 1
ggcagtgccgcattttggca

SEQ ID NO: 45943 - DNA, 20 bp, Human herpesvirus 1
aaaccccggggcccgtcgtt

SEQ ID NO: 45944 - DNA, 20 bp, Human herpesvirus 1
ggggtgctcgttggttggca

SEQ ID NO: 45945 - DNA, 20 bp, Human herpesvirus 1
gttggcactcacggtgcggc

SEQ ID NO: 45946 - DNA, 20 bp, Human herpesvirus 1
gcactcacggtgcggcgaat

SEQ ID NO: 45947 - DNA, 20 bp, Human herpesvirus 1
gccgcaccgtgagtgccaac

SEQ ID NO: 45948 - DNA, 20 bp, Human herpesvirus 1
cctcatggccccttttatac

SEQ ID NO: 45949 - DNA, 20 bp, Human herpesvirus 1
ctcatggccccttttatacc

SEQ ID NO: 45950 - DNA, 20 bp, Human herpesvirus 1
tataccccagccgaggacgc

SEQ ID NO: 45951 - DNA, 20 bp, Human herpesvirus 1
ataccccagccgaggacgcg

SEQ ID NO: 45952 - DNA, 20 bp, Human herpesvirus 1
taccccagccgaggacgcgt

SEQ ID NO: 45953 - DNA, 20 bp, Human herpesvirus 1
gggccacgggatttaccgcg

SEQ ID NO: 45954 - DNA, 20 bp, Human herpesvirus 1
accgcggaagagctggacgc

SEQ ID NO: 45955 - DNA, 20 bp, Human herpesvirus 1
ccgcggaagagctggacgcc

SEQ ID NO: 45956 - DNA, 20 bp, Human herpesvirus 1
ccgccgcggctgatggctcg

SEQ ID NO: 45957 - DNA, 20 bp, Human herpesvirus 1
cgcggtaaatcccgtggccc

SEQ ID NO: 45958 - DNA, 20 bp, Human herpesvirus 1
gacagcagccatccagatta

SEQ ID NO: 45959 - DNA, 20 bp, Human herpesvirus 1
acagcagccatccagattac

SEQ ID NO: 45960 - DNA, 20 bp, Human herpesvirus 1
cccccaacgggtaatcgtga

SEQ ID NO: 45961 - DNA, 20 bp, Human herpesvirus 1
acgattacccgttgggggta

SEQ ID NO: 45962 - DNA, 20 bp, Human herpesvirus 1
cccgttgggggtaatctgga

SEQ ID NO: 45963 - DNA, 20 bp, Human herpesvirus 1
ggagctgccgggagaccgct

SEQ ID NO: 45964 - DNA, 20 bp, Human herpesvirus 1
aggcgcctactcagataggt

SEQ ID NO: 45965 - DNA, 20 bp, Human herpesvirus 1
ttctcggccccccgcggccc

SEQ ID NO: 45966 - DNA, 20 bp, Human herpesvirus 1
tcggccccccgcggccccaa

SEQ ID NO: 45967 - DNA, 20 bp, Human herpesvirus 1
tggggccgcggggggccgag

SEQ ID NO: 45968 - DNA, 20 bp, Human herpesvirus 1
ggggccgcggggggccgaga

SEQ ID NO: 45969 - DNA, 20 bp, Human herpesvirus 1
gggccgcggggggccgagaa

SEQ ID NO: 45970 - DNA, 20 bp, Human herpesvirus 1
ccacgcccgaccacacaccc

SEQ ID NO: 45971 - DNA, 20 bp, Human herpesvirus 1
gcatggggggtgtgtggtcg

SEQ ID NO: 45972 - DNA, 20 bp, Human herpesvirus 1
aatacatgcccgggacccat

SEQ ID NO: 45973 - DNA, 20 bp, Human herpesvirus 1
cgggcctcagaacccacccg

SEQ ID NO: 45974 - DNA, 20 bp, Human herpesvirus 1
gccgtttcgggtgggttctg

SEQ ID NO: 45975 - DNA, 20 bp, Human herpesvirus 1
cgggtgggttctgaggcccg

SEQ ID NO: 45976 - DNA, 20 bp, Human herpesvirus 1
gggtgggttctgaggcccgg

SEQ ID NO: 45977 - DNA, 20 bp, Human herpesvirus 1
tgggaagcctcgtgggggct

SEQ ID NO: 45978 - DNA, 20 bp, Human herpesvirus 1
gggaagcctcgtgggggctg

SEQ ID NO: 45979 - DNA, 20 bp, Human herpesvirus 1
ggaagcctcgtgggggctgt

SEQ ID NO: 45980 - DNA, 20 bp, Human herpesvirus 1
ttgccgccacccatcgggga

SEQ ID NO: 45981 - DNA, 20 bp, Human herpesvirus 1
ccgccacccatcggggacct

SEQ ID NO: 45982 - DNA, 20 bp, Human herpesvirus 1
attgggggccggggccacgg

SEQ ID NO: 45983 - DNA, 20 bp, Human herpesvirus 1
ttgggggccggggccacgga

SEQ ID NO: 45984 - DNA, 20 bp, Human herpesvirus 1
ggggccggggccacggattt

SEQ ID NO: 45985 - DNA, 20 bp, Human herpesvirus 1
cctggttagcccggtgttgt

SEQ ID NO: 45986 - DNA, 20 bp, Human herpesvirus 1
ctggttagcccggtgttgtt

SEQ ID NO: 45987 - DNA, 20 bp, Human herpesvirus 1
gtggacgccggggccttggg

SEQ ID NO: 45988 - DNA, 20 bp, Human herpesvirus 1
tggacgccggggccttgggg

SEQ ID NO: 45989 - DNA, 20 bp, Human herpesvirus 1
gggcccgacggcgtagtgga

SEQ ID NO: 45990 - DNA, 20 bp, Human herpesvirus 1
ctccactacgccgtcgggcc

SEQ ID NO: 45991 - DNA, 20 bp, Human herpesvirus 1
gataccagactgaccgtggg

SEQ ID NO: 45992 - DNA, 20 bp, Human herpesvirus 1
cgcgtatgggtcggtgacgc

SEQ ID NO: 45993 - DNA, 20 bp, Human herpesvirus 1
gtcctggggatggccatagc

SEQ ID NO: 45994 - DNA, 20 bp, Human herpesvirus 1
tcctggggatggccatagcc

SEQ ID NO: 45995 - DNA, 20 bp, Human herpesvirus 1
ggcggctatggccatcccca

SEQ ID NO: 45996 - DNA, 20 bp, Human herpesvirus 1
ggcgcgtcaccgacccatac

SEQ ID NO: 45997 - DNA, 20 bp, Human herpesvirus 1
ttcacggggtccgagagacg

SEQ ID NO: 45998 - DNA, 20 bp, Human herpesvirus 1
acggggtccgagagacggac

SEQ ID NO: 45999 - DNA, 20 bp, Human herpesvirus 1
gcgagccgggtcctttatgt

SEQ ID NO: 46000 - DNA, 20 bp, Human herpesvirus 1
atgtcgcccacggacagggt

SEQ ID NO: 46001 - DNA, 20 bp, Human herpesvirus 1
tgtcgcccacggacagggta

SEQ ID NO: 46002 - DNA, 20 bp, Human herpesvirus 1
atcccacggcctcgccagtt

SEQ ID NO: 46003 - DNA, 20 bp, Human herpesvirus 1
tcccacggcctcgccagttt

SEQ ID NO: 46004 - DNA, 20 bp, Human herpesvirus 1
cggtcgaagcctactactcg

SEQ ID NO: 46005 - DNA, 20 bp, Human herpesvirus 1
ggtcgaagcctactactcgg

SEQ ID NO: 46006 - DNA, 20 bp, Human herpesvirus 1
gccgcctcgtcttcgctttc

SEQ ID NO: 46007 - DNA, 20 bp, Human herpesvirus 1
tgtcgggcggatttggggcg

SEQ ID NO: 46008 - DNA, 20 bp, Human herpesvirus 1
ggggcgctcctgatgtggct

SEQ ID NO: 46009 - DNA, 20 bp, Human herpesvirus 1
gggcgctcctgatgtggctg

SEQ ID NO: 46010 - DNA, 20 bp, Human herpesvirus 1
tagcggagcagccacatcag

SEQ ID NO: 46011 - DNA, 20 bp, Human herpesvirus 1
agcggagcagccacatcagg

SEQ ID NO: 46012 - DNA, 20 bp, Influenza A virus
ggataattagcttgatgtta

SEQ ID NO: 46013 - DNA, 20 bp, Influenza A virus
gcttgatgttacaaattggg

SEQ ID NO: 46014 - DNA, 20 bp, Influenza A virus
atgttacaaattgggaacat

SEQ ID NO: 46015 - DNA, 20 bp, Influenza A virus
caaattgggaacataatctc

SEQ ID NO: 46016 - DNA, 20 bp, Influenza A virus
ggaacataatctcaatatgg

SEQ ID NO: 46017 - DNA, 20 bp, Influenza A virus
gtcggcaagtgcttgccatg

SEQ ID NO: 46018 - DNA, 20 bp, Influenza A virus
ccatgatggcaccagttggt

SEQ ID NO: 46019 - DNA, 20 bp, Influenza A virus
gttgacaattggaatttctg

SEQ ID NO: 46020 - DNA, 20 bp, Influenza A virus
acaattggaatttctggccc

SEQ ID NO: 46021 - DNA, 20 bp, Influenza A virus
gaatttctggcccagacaat

SEQ ID NO: 46022 - DNA, 20 bp, Influenza A virus
aatgcccctaattatcacta

SEQ ID NO: 46023 - DNA, 20 bp, Influenza A virus
tcactatgaggagtgctcct

SEQ ID NO: 46024 - DNA, 20 bp, Influenza A virus
tcctgatgctggcgaaatca

SEQ ID NO: 46025 - DNA, 20 bp, Influenza A virus
gcatggctcaaatcggccat

SEQ ID NO: 46026 - DNA, 20 bp, Influenza A virus
gagccatgccaattatccct

SEQ ID NO: 46027 - DNA, 20 bp, Influenza A virus
ggatcgggagaaccaaaagc

SEQ ID NO: 46028 - DNA, 20 bp, Influenza A virus
gatcgggagaaccaaaagca

SEQ ID NO: 46029 - DNA, 20 bp, Influenza A virus
caggagcggctttgaaatga

SEQ ID NO: 46030 - DNA, 20 bp, Influenza A virus
gaaatgatttgggatccaaa

SEQ ID NO: 46031 - DNA, 20 bp, Influenza A virus
aaatgatttgggatccaaat

SEQ ID NO: 46032 - DNA, 20 bp, Hepatitis B virus
ggacggaaattgcacctgta

SEQ ID NO: 46033 - DNA, 20 bp, Hepatitis B virus
cacctgtattcccatcccat

SEQ ID NO: 46034 - DNA, 20 bp, Hepatitis B virus
ccatcccatcatcctgggct

SEQ ID NO: 46035 - DNA, 20 bp, Hepatitis B virus
cggaaaattcctatgggagt

SEQ ID NO: 46036 - DNA, 20 bp, Hepatitis B virus
ggaaaattcctatgggagtg

SEQ ID NO: 46037 - DNA, 20 bp, Hepatitis B virus
ctctctaaattttatgggtt

SEQ ID NO: 46038 - DNA, 20 bp, Hepatitis B virus
tatgggttatgtcattggat

SEQ ID NO: 46039 - DNA, 20 bp, Hepatitis B virus
atgggttatgtcattggatg

SEQ ID NO: 46040 - DNA, 20 bp, Hepatitis B virus
tgggttatgtcattggatgt

SEQ ID NO: 46041 - DNA, 20 bp, Hepatitis B virus
tgtcattggatgttatgggt

SEQ ID NO: 46042 - DNA, 20 bp, Hepatitis B virus
gcttcacctctgcacgtcgc

SEQ ID NO: 46043 - DNA, 20 bp, Hepatitis B virus
acctctgcacgtcgcatgga

SEQ ID NO: 46044 - DNA, 20 bp, Hepatitis B virus
cccaaggtcttacataagag

SEQ ID NO: 46045 - DNA, 20 bp, Hepatitis B virus
cataagaggactcttggact

SEQ ID NO: 46046 - DNA, 20 bp, Hepatitis B virus
gactctcagcaatgtcaacg

SEQ ID NO: 46047 - DNA, 20 bp, Hepatitis B virus
ttcacctcaccatactgcac

SEQ ID NO: 46048 - DNA, 20 bp, Hepatitis B virus
acctcaccatactgcactca

SEQ ID NO: 46049 - DNA, 20 bp, Hepatitis B virus
tttgctggggggaactaatg

SEQ ID NO: 46050 - DNA, 20 bp, Hepatitis B virus
gctggggggaactaatgact

SEQ ID NO: 46051 - DNA, 20 bp, Hepatitis B virus
ctggggggaactaatgactc

SEQ ID NO: 46052 - DNA, 20 bp, Hepatitis B virus
tgtgggtcaccatattcttg

SEQ ID NO: 46053 - DNA, 20 bp, Hepatitis B virus
gtgggtcaccatattcttgg

SEQ ID NO: 46054 - DNA, 20 bp, Hepatitis B virus
tgggtcaccatattcttggg

SEQ ID NO: 46055 - DNA, 20 bp, Hepatitis B virus
ttgggaacaagatctacagc

SEQ ID NO: 46056 - DNA, 20 bp, Hepatitis B virus
ggaacaagatctacagcatg

SEQ ID NO: 46057 - DNA, 20 bp, Influenza A virus
agaagtacacatcggggaga

SEQ ID NO: 46058 - DNA, 20 bp, Influenza A virus
tcctgtctccccgatgtgta

SEQ ID NO: 46059 - DNA, 20 bp, Influenza A virus
cctgtctccccgatgtgtac

SEQ ID NO: 46060 - DNA, 20 bp, Influenza A virus
ctgtctccccgatgtgtact

SEQ ID NO: 46061 - DNA, 20 bp, Influenza A virus
ttaattatggccatatggtc

SEQ ID NO: 46062 - DNA, 20 bp, Influenza A virus
ggctgtaacatggtggaata

SEQ ID NO: 46063 - DNA, 20 bp, Influenza A virus
gctgtaacatggtggaatag

SEQ ID NO: 46064 - DNA, 20 bp, Influenza A virus
cccaaaagtatacaagactt

SEQ ID NO: 46065 - DNA, 20 bp, Influenza A virus
tcaaaataagtcttgtatac

SEQ ID NO: 46066 - DNA, 20 bp, Influenza A virus
tatacttttgggtaatggac

SEQ ID NO: 46067 - DNA, 20 bp, Influenza A virus
attggagatgtgccacagca

SEQ ID NO: 46068 - DNA, 20 bp, Influenza A virus
ttggagatgtgccacagcac

SEQ ID NO: 46069 - DNA, 20 bp, Influenza A virus
gagatgtgccacagcacaca

SEQ ID NO: 46070 - DNA, 20 bp, Influenza A virus
tcccgccaatttgtgtgctg

SEQ ID NO: 46071 - DNA, 20 bp, Influenza A virus
gtgtgctgtggcacatctcc

SEQ ID NO: 46072 - DNA, 20 bp, Influenza A virus
caggcaatctccaaacattg

SEQ ID NO: 46073 - DNA, 20 bp, Influenza A virus
aagataagagtacatgaggg

SEQ ID NO: 46074 - DNA, 20 bp, Influenza A virus
acaatggtggggaaaagagc

SEQ ID NO: 46075 - DNA, 20 bp, Influenza A virus
ctcttttccccaccattgtg

SEQ ID NO: 46076 - DNA, 20 bp, Influenza A virus
tccccaccattgtgaactcc

SEQ ID NO: 46077 - DNA, 20 bp, Influenza A virus
aaccccatgcatcagctttt

SEQ ID NO: 46078 - DNA, 20 bp, Influenza A virus
taaggcattttcagaaagat

SEQ ID NO: 46079 - DNA, 20 bp, Influenza A virus
aaggcattttcagaaagatg

SEQ ID NO: 46080 - DNA, 20 bp, Influenza A virus
aggcattttcagaaagatgc

SEQ ID NO: 46081 - DNA, 20 bp, Influenza A virus
tcagaaagatgcgaaagtgc

SEQ ID NO: 46082 - DNA, 20 bp, Influenza A virus
gagaccaacgcgggaatgta

SEQ ID NO: 46083 - DNA, 20 bp, Influenza A virus
ttgtctcctgaggaggtcag

SEQ ID NO: 46084 - DNA, 20 bp, Influenza A virus
tctcctgaggaggtcagtga

SEQ ID NO: 46085 - DNA, 20 bp, Influenza A virus
acaataacatattcatcgtc

SEQ ID NO: 46086 - DNA, 20 bp, Influenza A virus
atcgtcgatgatgtgggaga

SEQ ID NO: 46087 - DNA, 20 bp, Influenza A virus
gtcagaactctattccaaca

SEQ ID NO: 46088 - DNA, 20 bp, Influenza A virus
tcagaactctattccaacaa

SEQ ID NO: 46089 - DNA, 20 bp, Influenza A virus
caacaaatgagagacgtact

SEQ ID NO: 46090 - DNA, 20 bp, Influenza A virus
ggacatttgacaccacccag

SEQ ID NO: 46091 - DNA, 20 bp, Influenza A virus
gacaccacccagataataaa

SEQ ID NO: 46092 - DNA, 20 bp, Influenza A virus
aattgaagacccagatgaaa

SEQ ID NO: 46093 - DNA, 20 bp, Influenza A virus
attgaagacccagatgaaag

SEQ ID NO: 46094 - DNA, 20 bp, Influenza A virus
aagacccagatgaaagcaca

SEQ ID NO: 46095 - DNA, 20 bp, Influenza A virus
agagggtttctcattatagg

SEQ ID NO: 46096 - DNA, 20 bp, Influenza A virus
ctcattataggtaaggaaga

SEQ ID NO: 46097 - DNA, 20 bp, Human papillomavirus type 178
ctttgccttgcattttctgt

SEQ ID NO: 46098 - DNA, 20 bp, Human papillomavirus type 178
gccttgcattttctgtcgtc

SEQ ID NO: 46099 - DNA, 20 bp, Human papillomavirus type 178
ccttgcattttctgtcgtcg

SEQ ID NO: 46100 - DNA, 20 bp, Human papillomavirus type 178
cattttctgtcgtcgtgatt

SEQ ID NO: 46101 - DNA, 20 bp, Human papillomavirus type 178
tctgtcgtcgtgatttgtgt

SEQ ID NO: 46102 - DNA, 20 bp, Human papillomavirus type 178
tgtatggggttgcttactaa

SEQ ID NO: 46103 - DNA, 20 bp, Human papillomavirus type 178
gtatggggttgcttactaat

SEQ ID NO: 46104 - DNA, 20 bp, Human papillomavirus type 178
tatggggttgcttactaatg

SEQ ID NO: 46105 - DNA, 20 bp, Human papillomavirus type 178
cttactaatgaggagaagat

SEQ ID NO: 46106 - DNA, 20 bp, Human papillomavirus type 178
ctaatgaggagaagattgat

SEQ ID NO: 46107 - DNA, 20 bp, Human papillomavirus type 178
acagctgttgcgacaactgt

SEQ ID NO: 46108 - DNA, 20 bp, Human papillomavirus type 178
cgacaactgttgccgagtaa

SEQ ID NO: 46109 - DNA, 20 bp, Human papillomavirus type 178
ccgagtaattcgtgtcgttg

SEQ ID NO: 46110 - DNA, 20 bp, Human papillomavirus type 178
gtgtcgttgttgttgctact

SEQ ID NO: 46111 - DNA, 20 bp, Human papillomavirus type 178
ttgttgctactgaaactggc

SEQ ID NO: 46112 - DNA, 20 bp, Human papillomavirus type 178
gatgacagtacagaatcaaa

SEQ ID NO: 46113 - DNA, 20 bp, Human papillomavirus type 178
atgacagtacagaatcaaac

SEQ ID NO: 46114 - DNA, 20 bp, Human papillomavirus type 178
gacgacagtgatgaggtgga

SEQ ID NO: 46115 - DNA, 20 bp, Human papillomavirus type 178
attaaacagagccagggtat

SEQ ID NO: 46116 - DNA, 20 bp, Human papillomavirus type 178
aacagagccagggtattccc

SEQ ID NO: 46117 - DNA, 20 bp, Human papillomavirus type 178
agcaggatgaagctgaaaat

SEQ ID NO: 46118 - DNA, 20 bp, Human papillomavirus type 178
tacgtcgcaggtagagatcg

SEQ ID NO: 46119 - DNA, 20 bp, Human papillomavirus type 178
acgtcgcaggtagagatcgc

SEQ ID NO: 46120 - DNA, 20 bp, Human papillomavirus type 178
cgtcgcaggtagagatcgcc

SEQ ID NO: 46121 - DNA, 20 bp, Human papillomavirus type 178
gataatagtaatgttagtac

SEQ ID NO: 46122 - DNA, 20 bp, Human papillomavirus type 178
ttagacaagaaaatgtgtat

SEQ ID NO: 46123 - DNA, 20 bp, Human papillomavirus type 178
gacaagaaaatgtgtattta

SEQ ID NO: 46124 - DNA, 20 bp, Human papillomavirus type 178
atattatgggagaaaagaag

SEQ ID NO: 46125 - DNA, 20 bp, Human papillomavirus type 178
tattatgggagaaaagaagg

SEQ ID NO: 46126 - DNA, 20 bp, Human papillomavirus type 178
tgggagaaaagaaggcctca

SEQ ID NO: 46127 - DNA, 20 bp, Human papillomavirus type 178
tcccctcactccgggaagaa

SEQ ID NO: 46128 - DNA, 20 bp, Human papillomavirus type 178
ccagtcccaccgaaaacacc

SEQ ID NO: 46129 - DNA, 20 bp, Human papillomavirus type 178
cagtcccaccgaaaacaccg

SEQ ID NO: 46130 - DNA, 20 bp, Human papillomavirus type 178
ttggagtcgtcctgggcttt

SEQ ID NO: 46131 - DNA, 20 bp, Human papillomavirus type 178
tggagtcgtcctgggctttc

SEQ ID NO: 46132 - DNA, 20 bp, Human papillomavirus type 178
ttaaaaattataggtagtgt

SEQ ID NO: 46133 - DNA, 20 bp, Human papillomavirus type 178
aaaattataggtagtgttgt

SEQ ID NO: 46134 - DNA, 20 bp, Human papillomavirus type 178
taggtagtgttgtttatttt

SEQ ID NO: 46135 - DNA, 20 bp, Human papillomavirus type 178
tttattttggaggactgggt

SEQ ID NO: 46136 - DNA, 20 bp, Human papillomavirus type 178
attttggaggactgggtata

SEQ ID NO: 46137 - DNA, 20 bp, Human papillomavirus type 178
atgctggctcagcagaacca

SEQ ID NO: 46138 - DNA, 20 bp, Human papillomavirus type 178
caactatagatcctatatca

SEQ ID NO: 46139 - DNA, 20 bp, Human papillomavirus type 178
cagcagtagataaccaacct

SEQ ID NO: 46140 - DNA, 20 bp, Human papillomavirus type 178
gttatctactgctgtaacgt

SEQ ID NO: 46141 - DNA, 20 bp, Human papillomavirus type 178
tctactgctgtaacgtctga

SEQ ID NO: 46142 - DNA, 20 bp, Human papillomavirus type 178
gcagtttgatcaagacgtgc

SEQ ID NO: 46143 - DNA, 20 bp, Human papillomavirus type 178
cagtttgatcaagacgtgca

SEQ ID NO: 46144 - DNA, 20 bp, Human papillomavirus type 178
gatcaagacgtgcagaatgt

SEQ ID NO: 46145 - DNA, 20 bp, Human papillomavirus type 178
atcaagacgtgcagaatgta

SEQ ID NO: 46146 - DNA, 20 bp, Human papillomavirus type 178
tgcagatgttatcacagtac

SEQ ID NO: 46147 - DNA, 20 bp, Human papillomavirus type 178
gggacaataggccaacattc

SEQ ID NO: 46148 - DNA, 20 bp, Human papillomavirus type 178
aggcgaaactgcaattgtag

SEQ ID NO: 46149 - DNA, 20 bp, Human papillomavirus type 178
tagatgcagtggcagagagc

SEQ ID NO: 46150 - DNA, 20 bp, Human papillomavirus type 178
gtagatatccctaatagtag

SEQ ID NO: 46151 - DNA, 20 bp, Human papillomavirus type 178
tagatatccctaatagtagt

SEQ ID NO: 46152 - DNA, 20 bp, Human papillomavirus type 178
tcagcacggacgaatacgtg

SEQ ID NO: 46153 - DNA, 20 bp, Human papillomavirus type 178
ttctatgctggtacagaacg

SEQ ID NO: 46154 - DNA, 20 bp, Human papillomavirus type 178
tctatgctggtacagaacgc

SEQ ID NO: 46155 - DNA, 20 bp, Human papillomavirus type 178
ctatgctggtacagaacgct

SEQ ID NO: 46156 - DNA, 20 bp, Human papillomavirus type 178
tatgctggtacagaacgctt

SEQ ID NO: 46157 - DNA, 20 bp, Human papillomavirus type 178
ggggtagccacaacaggcaa

SEQ ID NO: 46158 - DNA, 20 bp, Human papillomavirus type 178
tttaacaaatataatgatac

SEQ ID NO: 46159 - DNA, 20 bp, Human papillomavirus type 178
aacaaatataatgatactga

SEQ ID NO: 46160 - DNA, 20 bp, Human papillomavirus type 178
acaaatataatgatactgaa

SEQ ID NO: 46161 - DNA, 20 bp, Human papillomavirus type 178
tgcctattatcatctgtttg

SEQ ID NO: 46162 - DNA, 20 bp, Human papillomavirus type 178
tgttatacaagatggggata

SEQ ID NO: 46163 - DNA, 20 bp, Human papillomavirus type 178
tacaagatggggatatgtgt

SEQ ID NO: 46164 - DNA, 20 bp, Human papillomavirus type 178
gctttggtgcttgcaatttc

SEQ ID NO: 46165 - DNA, 20 bp, Human papillomavirus type 178
ggtgcttgcaatttcagaac

SEQ ID NO: 46166 - DNA, 20 bp, Human papillomavirus type 178
gtgcttgcaatttcagaaca

SEQ ID NO: 46167 - DNA, 20 bp, Human papillomavirus type 178
caaagattataccttttggc

SEQ ID NO: 46168 - DNA, 20 bp, Human papillomavirus type 178
taccttttggcaaatagata

SEQ ID NO: 46169 - DNA, 20 bp, Human papillomavirus type 178
tggcaaatagatatgactga

SEQ ID NO: 46170 - DNA, 20 bp, Human papillomavirus type 178
ggcaaatagatatgactgaa

SEQ ID NO: 46171 - DNA, 20 bp, Human papillomavirus type 178
gcaaatagatatgactgaac

SEQ ID NO: 46172 - DNA, 20 bp, Human papillomavirus type 178
caaaactgtgaatggtctct

SEQ ID NO: 46173 - DNA, 20 bp, Human papillomavirus type 178
gtctgaataaattgctgatg

SEQ ID NO: 46174 - DNA, 20 bp, Human papillomavirus type 178
tctgaataaattgctgatgc

SEQ ID NO: 46175 - DNA, 20 bp, Human papillomavirus type 178
ctgatgcgcaataatctggt

SEQ ID NO: 46176 - DNA, 20 bp, Human papillomavirus type 178
caattttactgactcatttg

SEQ ID NO: 46177 - DNA, 20 bp, Human papillomavirus type 178
ctggtaagtttttggcgcca

SEQ ID NO: 46178 - DNA, 20 bp, Human papillomavirus type 178
tggtaagtttttggcgccaa

SEQ ID NO: 46179 - DNA, 20 bp, Human papillomavirus type 178
ttggcgccaaagggcaaaaa

SEQ ID NO: 46180 - DNA, 20 bp, Human papillomavirus type 178
tggcgccaaagggcaaaaaa

SEQ ID NO: 46181 - DNA, 20 bp, Human papillomavirus type 178
ggcgccaaagggcaaaaaag

SEQ ID NO: 46182 - DNA, 20 bp, Human papillomavirus type 48
gaagagcttgttttgcctgc

SEQ ID NO: 46183 - DNA, 20 bp, Human papillomavirus type 48
ttttgcctgctaacttaatt

SEQ ID NO: 46184 - DNA, 20 bp, Human papillomavirus type 48
tgcctgctaacttaatttct

SEQ ID NO: 46185 - DNA, 20 bp, Human papillomavirus type 48
gcctgctaacttaatttctg

SEQ ID NO: 46186 - DNA, 20 bp, Human papillomavirus type 48
cctgctaacttaatttctga

SEQ ID NO: 46187 - DNA, 20 bp, Human papillomavirus type 48
tcggcagtgcatataacgcc

SEQ ID NO: 46188 - DNA, 20 bp, Human papillomavirus type 48
aatgatagtggagttgttga

SEQ ID NO: 46189 - DNA, 20 bp, Human papillomavirus type 48
atgatagtggagttgttgaa

SEQ ID NO: 46190 - DNA, 20 bp, Human papillomavirus type 48
ttgaagatgaagctgaaagt

SEQ ID NO: 46191 - DNA, 20 bp, Human papillomavirus type 48
aagatgaagctgaaagtaat

SEQ ID NO: 46192 - DNA, 20 bp, Human papillomavirus type 48
gggtccgactctgcaccaac

SEQ ID NO: 46193 - DNA, 20 bp, Human papillomavirus type 48
ggaagtgggatcaagatcta

SEQ ID NO: 46194 - DNA, 20 bp, Human papillomavirus type 48
caagcgttgtagatcttgat

SEQ ID NO: 46195 - DNA, 20 bp, Human papillomavirus type 48
tagatcttgatcccacttcc

SEQ ID NO: 46196 - DNA, 20 bp, Human papillomavirus type 48
atcccacttccgaaggagtt

SEQ ID NO: 46197 - DNA, 20 bp, Human papillomavirus type 48
gaaatttgggaataggatct

SEQ ID NO: 46198 - DNA, 20 bp, Human papillomavirus type 48
gggaataggatctggaaaag

SEQ ID NO: 46199 - DNA, 20 bp, Human papillomavirus type 48
ggaataggatctggaaaagg

SEQ ID NO: 46200 - DNA, 20 bp, Human papillomavirus type 48
ggatatagaccattaggatc

SEQ ID NO: 46201 - DNA, 20 bp, Human papillomavirus type 48
gatatagaccattaggatcc

SEQ ID NO: 46202 - DNA, 20 bp, Human papillomavirus type 48
caccagatgcaggtccaggt

SEQ ID NO: 46203 - DNA, 20 bp, Human papillomavirus type 48
aactattcacctttagagat

SEQ ID NO: 46204 - DNA, 20 bp, Human papillomavirus type 48
acctttagagatccagcaac

SEQ ID NO: 46205 - DNA, 20 bp, Human papillomavirus type 48
agagatccagcaactgatgt

SEQ ID NO: 46206 - DNA, 20 bp, Human papillomavirus type 48
gagatccagcaactgatgta

SEQ ID NO: 46207 - DNA, 20 bp, Human papillomavirus type 48
tttgcaggagagacaattgg

SEQ ID NO: 46208 - DNA, 20 bp, Human papillomavirus type 48
gcaggagagacaattgggga

SEQ ID NO: 46209 - DNA, 20 bp, Human papillomavirus type 48
caggagagacaattggggac

SEQ ID NO: 46210 - DNA, 20 bp, Human papillomavirus type 48
gggacaacatatttgaagag

SEQ ID NO: 46211 - DNA, 20 bp, Human papillomavirus type 48
gaagagatacccttgcagaa

SEQ ID NO: 46212 - DNA, 20 bp, Human papillomavirus type 48
gatccagatattagtataca

SEQ ID NO: 46213 - DNA, 20 bp, Human papillomavirus type 48
atccagatattagtatacag

SEQ ID NO: 46214 - DNA, 20 bp, Human papillomavirus type 48
gtatacagttccagcgtgat

SEQ ID NO: 46215 - DNA, 20 bp, Human papillomavirus type 48
cagcgtgatgtaaatagcct

SEQ ID NO: 46216 - DNA, 20 bp, Human papillomavirus type 48
tgctgacattgcttatttaa

SEQ ID NO: 46217 - DNA, 20 bp, Human papillomavirus type 48
cagtttctggactttagata

SEQ ID NO: 46218 - DNA, 20 bp, Human papillomavirus type 48
ctggactttagatatgacag

SEQ ID NO: 46219 - DNA, 20 bp, Human papillomavirus type 48
tggactttagatatgacaga

SEQ ID NO: 46220 - DNA, 20 bp, Human papillomavirus type 48
agatatgacagagcgcttct

SEQ ID NO: 46221 - DNA, 20 bp, Human papillomavirus type 48
gatatgacagagcgcttctc

SEQ ID NO: 46222 - DNA, 20 bp, Human papillomavirus type 48
atacgcctccattgggtggg

SEQ ID NO: 46223 - DNA, 20 bp, Human papillomavirus type 48
tacgcctccattgggtgggt

SEQ ID NO: 46224 - DNA, 20 bp, Human papillomavirus type 48
ggtgggttctgacctataaa

SEQ ID NO: 46225 - DNA, 20 bp, Human papillomavirus type 48
tgacctataaactcctgggt

SEQ ID NO: 46226 - DNA, 20 bp, Human papillomavirus type 48
ggtcagcagacgctgaggag

SEQ ID NO: 46227 - DNA, 20 bp, Human immunodeficiency virus 2
gcagaattatactcatgggc

SEQ ID NO: 46228 - DNA, 20 bp, Human immunodeficiency virus 2
tactcatgggccaggagtaa

SEQ ID NO: 46229 - DNA, 20 bp, Human immunodeficiency virus 2
ggtaccttactcctggccca

SEQ ID NO: 46230 - DNA, 20 bp, Human immunodeficiency virus 2
ctcctggcccatgagtataa

SEQ ID NO: 46231 - DNA, 20 bp, Human immunodeficiency virus 2
tgccaatctggtattatccc

SEQ ID NO: 46232 - DNA, 20 bp, Human immunodeficiency virus 2
ccagaaggggctgtaaccaa

SEQ ID NO: 46233 - DNA, 20 bp, Human immunodeficiency virus 2
cagaaggggctgtaaccaag

SEQ ID NO: 46234 - DNA, 20 bp, Human immunodeficiency virus 2
ctgtataaatgtacccgctt

SEQ ID NO: 46235 - DNA, 20 bp, Human immunodeficiency virus 2
ttgcattgtattcagtcgct

SEQ ID NO: 46236 - DNA, 20 bp, Human immunodeficiency virus 2
cattgtattcagtcgctctg

SEQ ID NO: 46237 - DNA, 20 bp, Human immunodeficiency virus 2
gggaatccaaggcaggaaaa

SEQ ID NO: 46238 - DNA, 20 bp, Human immunodeficiency virus 2
ggaatccaaggcaggaaaat

SEQ ID NO: 46239 - DNA, 20 bp, Human immunodeficiency virus 2
gcgcccgaacagggacttga

SEQ ID NO: 46240 - DNA, 20 bp, Human immunodeficiency virus 2
aagaggactgagaagccctg

SEQ ID NO: 46241 - DNA, 20 bp, Human immunodeficiency virus 2
ctgccttcactcagccgagt

SEQ ID NO: 46242 - DNA, 20 bp, Human immunodeficiency virus 2
agagggaaaaaagcagacga

SEQ ID NO: 46243 - DNA, 20 bp, Human immunodeficiency virus 2
gaaaaagttaggttacggcc

SEQ ID NO: 46244 - DNA, 20 bp, Human immunodeficiency virus 2
ggttacggcccggcggaaag

SEQ ID NO: 46245 - DNA, 20 bp, Human immunodeficiency virus 2
cggcccggcggaaagaaaaa

SEQ ID NO: 46246 - DNA, 20 bp, Human immunodeficiency virus 2
aaacatattgtgtgggcagc

SEQ ID NO: 46247 - DNA, 20 bp, Human immunodeficiency virus 2
tacccatgcatttagagttc

SEQ ID NO: 46248 - DNA, 20 bp, Human immunodeficiency virus 2
acccatgcatttagagttcg

SEQ ID NO: 46249 - DNA, 20 bp, Human immunodeficiency virus 2
cccatgcatttagagttcgg

SEQ ID NO: 46250 - DNA, 20 bp, Human immunodeficiency virus 2
agagttcgggggctcagtgg

SEQ ID NO: 46251 - DNA, 20 bp, Human immunodeficiency virus 2
gagttcgggggctcagtggc

SEQ ID NO: 46252 - DNA, 20 bp, Human immunodeficiency virus 2
gttgggttgtactttctgac

SEQ ID NO: 46253 - DNA, 20 bp, Human immunodeficiency virus 2
ggttgtactttctgacacac

SEQ ID NO: 46254 - DNA, 20 bp, Human immunodeficiency virus 2
tactttctgacacacttttg

SEQ ID NO: 46255 - DNA, 20 bp, Human immunodeficiency virus 2
ctgacacacttttgcagccc

SEQ ID NO: 46256 - DNA, 20 bp, Human immunodeficiency virus 2
tgacacacttttgcagccct

SEQ ID NO: 46257 - DNA, 20 bp, Human immunodeficiency virus 2
gcagcagcccaacaaagaaa

SEQ ID NO: 46258 - DNA, 20 bp, Human immunodeficiency virus 2
cagcagcccaacaaagaaag

SEQ ID NO: 46259 - DNA, 20 bp, Human immunodeficiency virus 2
ggtattggaactgtggaaag

SEQ ID NO: 46260 - DNA, 20 bp, Human immunodeficiency virus 2
gaactgtggaaaggagggac

SEQ ID NO: 46261 - DNA, 20 bp, Human immunodeficiency virus 2
ccacacttccagcagccctg

SEQ ID NO: 46262 - DNA, 20 bp, Human immunodeficiency virus 2
ggcagaaatattctgacagc

SEQ ID NO: 46263 - DNA, 20 bp, Human immunodeficiency virus 2
gcagaaatattctgacagcc

SEQ ID NO: 46264 - DNA, 20 bp, Human immunodeficiency virus 2
tgacagccttaggcatgtca

SEQ ID NO: 46265 - DNA, 20 bp, Human immunodeficiency virus 2
ggcatgtcattaaatttacc

SEQ ID NO: 46266 - DNA, 20 bp, Human immunodeficiency virus 2
aatttaccagttgccaagat

SEQ ID NO: 46267 - DNA, 20 bp, Human immunodeficiency virus 2
agctaggaattccacacccg

SEQ ID NO: 46268 - DNA, 20 bp, Human immunodeficiency virus 2
cacacccggcaggactagcc

SEQ ID NO: 46269 - DNA, 20 bp, Human immunodeficiency virus 2
gatgtaggggatgcctattt

SEQ ID NO: 46270 - DNA, 20 bp, Human immunodeficiency virus 2
ttccataccactacatgaag

SEQ ID NO: 46271 - DNA, 20 bp, Human immunodeficiency virus 2
tccataccactacatgaaga

SEQ ID NO: 46272 - DNA, 20 bp, Human immunodeficiency virus 2
taaatggcctagggttttct

SEQ ID NO: 46273 - DNA, 20 bp, Human immunodeficiency virus 2
tctactccagatgagaagtt

SEQ ID NO: 46274 - DNA, 20 bp, Human immunodeficiency virus 2
ctactccagatgagaagttc

SEQ ID NO: 46275 - DNA, 20 bp, Human immunodeficiency virus 2
tactccagatgagaagttcc

SEQ ID NO: 46276 - DNA, 20 bp, Human immunodeficiency virus 2
caaaaagaccctccatttca

SEQ ID NO: 46277 - DNA, 20 bp, Human immunodeficiency virus 2
tcttgagccaggaacaagaa

SEQ ID NO: 46278 - DNA, 20 bp, Human immunodeficiency virus 2
agccaggaacaagaaggata

SEQ ID NO: 46279 - DNA, 20 bp, Human immunodeficiency virus 2
ttaccaagaagaaaaagaat

SEQ ID NO: 46280 - DNA, 20 bp, Human immunodeficiency virus 2
ccaagaagaaaaagaattag

SEQ ID NO: 46281 - DNA, 20 bp, Human immunodeficiency virus 2
gaggcaacaatccaaaaaag

SEQ ID NO: 46282 - DNA, 20 bp, Human immunodeficiency virus 2
acatttaacctagtaggaga

SEQ ID NO: 46283 - DNA, 20 bp, Human immunodeficiency virus 2
aacctagtaggagatcctat

SEQ ID NO: 46284 - DNA, 20 bp, Human immunodeficiency virus 2
acctagtaggagatcctata

SEQ ID NO: 46285 - DNA, 20 bp, Human immunodeficiency virus 2
tacacagatggatcatgcaa

SEQ ID NO: 46286 - DNA, 20 bp, Human immunodeficiency virus 2
tgactgtctattgcatgatc

SEQ ID NO: 46287 - DNA, 20 bp, Human immunodeficiency virus 2
agtaagtcaaggcatcagac

SEQ ID NO: 46288 - DNA, 20 bp, Human immunodeficiency virus 2
gtaagtcaaggcatcagaca

SEQ ID NO: 46289 - DNA, 20 bp, Human immunodeficiency virus 2
ttcctggaaaagatagagcc

SEQ ID NO: 46290 - DNA, 20 bp, Human immunodeficiency virus 2
ctggaaaagatagagcccgc

SEQ ID NO: 46291 - DNA, 20 bp, Human immunodeficiency virus 2
ttcatgttcctcttgagcgg

SEQ ID NO: 46292 - DNA, 20 bp, Human immunodeficiency virus 2
ctattaaaactggccagtag

SEQ ID NO: 46293 - DNA, 20 bp, Human immunodeficiency virus 2
aaactggccagtaggtggcc

SEQ ID NO: 46294 - DNA, 20 bp, Human immunodeficiency virus 2
cacacagacaatggccccaa

SEQ ID NO: 46295 - DNA, 20 bp, Human immunodeficiency virus 2
acttcacaggaagtgaagat

SEQ ID NO: 46296 - DNA, 20 bp, Human immunodeficiency virus 2
acaggaagtgaagatggtgg

SEQ ID NO: 46297 - DNA, 20 bp, Human immunodeficiency virus 2
ccacagaacaagaaatacaa

SEQ ID NO: 46298 - DNA, 20 bp, Human immunodeficiency virus 2
ctccaaagaaaaaattcaaa

SEQ ID NO: 46299 - DNA, 20 bp, Human immunodeficiency virus 2
aaattttaaaaatttccagg

SEQ ID NO: 46300 - DNA, 20 bp, Human immunodeficiency virus 2
taaaaatttccaggtctatt

SEQ ID NO: 46301 - DNA, 20 bp, Human immunodeficiency virus 2
aaaaatttccaggtctatta

SEQ ID NO: 46302 - DNA, 20 bp, Human immunodeficiency virus 2
acctggtatacagaaaagtt

SEQ ID NO: 46303 - DNA, 20 bp, Human immunodeficiency virus 2
tggacagatgttaccccaga

SEQ ID NO: 46304 - DNA, 20 bp, Human immunodeficiency virus 2
ccccagactgtgcagacatc

SEQ ID NO: 46305 - DNA, 20 bp, Human immunodeficiency virus 2
ggatgtctgcacagtctggg

SEQ ID NO: 46306 - DNA, 20 bp, Human immunodeficiency virus 2
tctgtataccaggttaatct

SEQ ID NO: 46307 - DNA, 20 bp, Human immunodeficiency virus 2
tccaggtgtggcaaaggtcc

SEQ ID NO: 46308 - DNA, 20 bp, Human immunodeficiency virus 2
ccaggtgtggcaaaggtcct

SEQ ID NO: 46309 - DNA, 20 bp, Human immunodeficiency virus 2
caggtgtggcaaaggtcctg

SEQ ID NO: 46310 - DNA, 20 bp, Human immunodeficiency virus 2
gcatgatgaacaagggatgt

SEQ ID NO: 46311 - DNA, 20 bp, Human immunodeficiency virus 2
ctgacatcccttgttcatca

SEQ ID NO: 46312 - DNA, 20 bp, Human immunodeficiency virus 2
tgatccccgcttgctaattg

SEQ ID NO: 46313 - DNA, 20 bp, Human immunodeficiency virus 2
gatccccgcttgctaattgc

SEQ ID NO: 46314 - DNA, 20 bp, Human immunodeficiency virus 2
atccccgcttgctaattgct

SEQ ID NO: 46315 - DNA, 20 bp, Human immunodeficiency virus 2
ctaattgctcttggctacta

SEQ ID NO: 46316 - DNA, 20 bp, Human immunodeficiency virus 2
ctcttggctactatatccat

SEQ ID NO: 46317 - DNA, 20 bp, Human immunodeficiency virus 2
gccttctgcaccagacaagt

SEQ ID NO: 46318 - DNA, 20 bp, Human immunodeficiency virus 2
tgcaccagacaagtgagtat

SEQ ID NO: 46319 - DNA, 20 bp, Human immunodeficiency virus 2
gttgtcattttactaacaag

SEQ ID NO: 46320 - DNA, 20 bp, Human immunodeficiency virus 2
ttagtaaaatgacaacaaac

SEQ ID NO: 46321 - DNA, 20 bp, Human immunodeficiency virus 2
gtaaaatgacaacaaacagc

SEQ ID NO: 46322 - DNA, 20 bp, Human immunodeficiency virus 2
gagacatcaataaaaccatg

SEQ ID NO: 46323 - DNA, 20 bp, Human immunodeficiency virus 2
agacatcaataaaaccatgt

SEQ ID NO: 46324 - DNA, 20 bp, Human immunodeficiency virus 2
tagcagggttcaagggaata

SEQ ID NO: 46325 - DNA, 20 bp, Human immunodeficiency virus 2
aagggaataccacgaccccg

SEQ ID NO: 46326 - DNA, 20 bp, Human immunodeficiency virus 2
ggggtcgtggtattcccttg

SEQ ID NO: 46327 - DNA, 20 bp, Human immunodeficiency virus 2
gtgacaacacaacagctggc

SEQ ID NO: 46328 - DNA, 20 bp, Human immunodeficiency virus 2
tgacaacacaacagctggca

SEQ ID NO: 46329 - DNA, 20 bp, Human immunodeficiency virus 2
catgagacattgcaacacat

SEQ ID NO: 46330 - DNA, 20 bp, Human immunodeficiency virus 2
caacacatcaatcatcaaag

SEQ ID NO: 46331 - DNA, 20 bp, Human immunodeficiency virus 2
ggatgctatgaggtttagat

SEQ ID NO: 46332 - DNA, 20 bp, Human immunodeficiency virus 2
taccaataacacttatgtca

SEQ ID NO: 46333 - DNA, 20 bp, Human immunodeficiency virus 2
accaataacacttatgtcag

SEQ ID NO: 46334 - DNA, 20 bp, Human immunodeficiency virus 2
ccaataacacttatgtcagg

SEQ ID NO: 46335 - DNA, 20 bp, Human immunodeficiency virus 2
tgtcaggattagtgtttcac

SEQ ID NO: 46336 - DNA, 20 bp, Human immunodeficiency virus 2
gtgtttcactctcagccaat

SEQ ID NO: 46337 - DNA, 20 bp, Human immunodeficiency virus 2
ccatataaagcagataatta

SEQ ID NO: 46338 - DNA, 20 bp, Human immunodeficiency virus 2
atacctggcataaagtaggg

SEQ ID NO: 46339 - DNA, 20 bp, Human immunodeficiency virus 2
gcctcctagggaaggggagt

SEQ ID NO: 46340 - DNA, 20 bp, Human immunodeficiency virus 2
cctcctagggaaggggagtt

SEQ ID NO: 46341 - DNA, 20 bp, Human immunodeficiency virus 2
gcctgtgaatcaacagtaac

SEQ ID NO: 46342 - DNA, 20 bp, Human immunodeficiency virus 2
atggggatgtgcgtttagac

SEQ ID NO: 46343 - DNA, 20 bp, Human immunodeficiency virus 2
agacaggtctgccacactac

SEQ ID NO: 46344 - DNA, 20 bp, Human immunodeficiency virus 2
gacaggtctgccacactact

SEQ ID NO: 46345 - DNA, 20 bp, Human immunodeficiency virus 2
atcgcctgactggaaaaata

SEQ ID NO: 46346 - DNA, 20 bp, Human immunodeficiency virus 2
tcgcctgactggaaaaatat

SEQ ID NO: 46347 - DNA, 20 bp, Human immunodeficiency virus 2
aggcggcccaactgcaatat

SEQ ID NO: 46348 - DNA, 20 bp, Human immunodeficiency virus 2
ttggatccactcgcacccat

SEQ ID NO: 46349 - DNA, 20 bp, Human immunodeficiency virus 2
gatccactcgcacccatatt

SEQ ID NO: 46350 - DNA, 20 bp, Human immunodeficiency virus 2
cagttgggccgccttaagtc

SEQ ID NO: 46351 - DNA, 20 bp, Human immunodeficiency virus 2
ggccgccttaagtctcagcc

SEQ ID NO: 46352 - DNA, 20 bp, Human immunodeficiency virus 2
gtataggcagcaaaatatgg

SEQ ID NO: 46353 - DNA, 20 bp, Human immunodeficiency virus 2
tataggcagcaaaatatgga

SEQ ID NO: 46354 - DNA, 20 bp, Human immunodeficiency virus 2
tgatgatgatgacctaatag

SEQ ID NO: 46355 - DNA, 20 bp, Human immunodeficiency virus 2
ctgttacaccaagagtacca

SEQ ID NO: 46356 - DNA, 20 bp, Human immunodeficiency virus 2
caccaagagtaccacggaga

SEQ ID NO: 46357 - DNA, 20 bp, Human immunodeficiency virus 2
gtgtggcagtttgactccat

SEQ ID NO: 46358 - DNA, 20 bp, Human immunodeficiency virus 2
gactccatgctggcctataa

SEQ ID NO: 46359 - DNA, 20 bp, Human immunodeficiency virus 2
actccatgctggcctataac

SEQ ID NO: 46360 - DNA, 20 bp, Human immunodeficiency virus 2
actctgtacccagaagagtt

SEQ ID NO: 46361 - DNA, 20 bp, Human immunodeficiency virus 2
gggcacaagtcaggattgcc

SEQ ID NO: 46362 - DNA, 20 bp, Human immunodeficiency virus 2
tctccagcactagcaggtag

SEQ ID NO: 46363 - DNA, 20 bp, Human immunodeficiency virus 2
cctgctggactctcaccagt

SEQ ID NO: 46364 - DNA, 20 bp, Human immunodeficiency virus 2
gccggtactgggcagacggc

SEQ ID NO: 46365 - DNA, 20 bp, Human immunodeficiency virus 2
cttgcttaaagacctcttca

SEQ ID NO: 46366 - DNA, 20 bp, Human immunodeficiency virus 2
cttaaagacctcttcaataa

SEQ ID NO: 46367 - DNA, 20 bp, Influenza B virus
aaactgccactcaaggggaa

SEQ ID NO: 46368 - DNA, 20 bp, Influenza B virus
acttccccttgagtggcagt

SEQ ID NO: 46369 - DNA, 20 bp, Influenza B virus
cccttgagtggcagttttaa

SEQ ID NO: 46370 - DNA, 20 bp, Influenza B virus
agtggcagttttaaccacat

SEQ ID NO: 46371 - DNA, 20 bp, Influenza B virus
taaccacatgaggtgagttt

SEQ ID NO: 46372 - DNA, 20 bp, Influenza B virus
cctataatgcacgacagaac

SEQ ID NO: 46373 - DNA, 20 bp, Influenza B virus
ctataatgcacgacagaaca

SEQ ID NO: 46374 - DNA, 20 bp, Influenza B virus
ttgttctgtcgtgcattata

SEQ ID NO: 46375 - DNA, 20 bp, Influenza B virus
tgttctgtcgtgcattatag

SEQ ID NO: 46376 - DNA, 20 bp, Influenza B virus
gttctgtcgtgcattatagg

SEQ ID NO: 46377 - DNA, 20 bp, Influenza B virus
aacacaatggcttgggttat

SEQ ID NO: 46378 - DNA, 20 bp, Influenza B virus
ggttatcccaaaagacaaca

SEQ ID NO: 46379 - DNA, 20 bp, Influenza B virus
tcccaaaagacaacaacaag

SEQ ID NO: 46380 - DNA, 20 bp, Influenza B virus
gttcagaaggggaagaccaa

SEQ ID NO: 46381 - DNA, 20 bp, Influenza B virus
ttcagaaggggaagaccaaa

SEQ ID NO: 46382 - DNA, 20 bp, Influenza B virus
ttgttgattacatggtacaa

SEQ ID NO: 46383 - DNA, 20 bp, Influenza B virus
ttgattacatggtacaaaaa

SEQ ID NO: 46384 - DNA, 20 bp, Influenza B virus
attacatggtacaaaaacct

SEQ ID NO: 46385 - DNA, 20 bp, Influenza B virus
catggtacaaaaacctggaa

SEQ ID NO: 46386 - DNA, 20 bp, Influenza B virus
tttatcaaagaggcatttta

SEQ ID NO: 46387 - DNA, 20 bp, Influenza B virus
aagctggccaatggaaccaa

SEQ ID NO: 46388 - DNA, 20 bp, Influenza B virus
aaggaaagaggtttcttcgg

SEQ ID NO: 46389 - DNA, 20 bp, Influenza B virus
cttcggagctattgctggtt

SEQ ID NO: 46390 - DNA, 20 bp, Influenza B virus
ttcggagctattgctggttt

SEQ ID NO: 46391 - DNA, 20 bp, Influenza B virus
ggagctattgctggtttctt

SEQ ID NO: 46392 - DNA, 20 bp, Influenza B virus
acgacgaaatactcgagcta

SEQ ID NO: 46393 - DNA, 20 bp, Influenza B virus
cagtcttgctttccaacgaa

SEQ ID NO: 46394 - DNA, 20 bp, Influenza B virus
gttggaaagcaagactgcaa

SEQ ID NO: 46395 - DNA, 20 bp, Influenza B virus
gaaagcaagactgcaagctc

SEQ ID NO: 46396 - DNA, 20 bp, Influenza B virus
gtgagcttattgtatcagct

SEQ ID NO: 46397 - DNA, 20 bp, Influenza B virus
cctagacaggatagctgctg

SEQ ID NO: 46398 - DNA, 20 bp, Influenza B virus
aatgcaggagatttttctct

SEQ ID NO: 46399 - DNA, 20 bp, Influenza B virus
atgcaggagatttttctctt

SEQ ID NO: 46400 - DNA, 20 bp, Influenza B virus
ttctcttcccacttttgatt

SEQ ID NO: 46401 - DNA, 20 bp, Influenza B virus
tctcttcccacttttgattc

SEQ ID NO: 46402 - DNA, 20 bp, Influenza A virus
agctatacaagaagctgaaa

SEQ ID NO: 46403 - DNA, 20 bp, Influenza A virus
catggggctaaggaggtcgc

SEQ ID NO: 46404 - DNA, 20 bp, Influenza A virus
agtagctgagtgcgacctcc

SEQ ID NO: 46405 - DNA, 20 bp, Influenza A virus
gccccatggaatgttatttc

SEQ ID NO: 46406 - DNA, 20 bp, Influenza A virus
tttctcttttcagcttcttg

SEQ ID NO: 46407 - DNA, 20 bp, Influenza A virus
ctagtcaggctaggcagatg

SEQ ID NO: 46408 - DNA, 20 bp, Influenza A virus
cgctgcctgctcactcgatc

SEQ ID NO: 46409 - DNA, 20 bp, Influenza A virus
ttgttgccgcaagtatcatt

SEQ ID NO: 46410 - DNA, 20 bp, Influenza A virus
ttgccgcaagtatcattggg

SEQ ID NO: 46411 - DNA, 20 bp, Influenza A virus
ccgcaagtatcattgggata

SEQ ID NO: 46412 - DNA, 20 bp, Influenza A virus
ggatactgcacttgatattg

SEQ ID NO: 46413 - DNA, 20 bp, Influenza A virus
atattgtggattcttgatcg

SEQ ID NO: 46414 - DNA, 20 bp, Human papillomavirus type 161
cagcctcgttaccagctatc

SEQ ID NO: 46415 - DNA, 20 bp, Human papillomavirus type 161
ccagctatcagcctttttga

SEQ ID NO: 46416 - DNA, 20 bp, Human papillomavirus type 161
ttgaagaattattgcgcgga

SEQ ID NO: 46417 - DNA, 20 bp, Human papillomavirus type 161
tgaagaattattgcgcggag

SEQ ID NO: 46418 - DNA, 20 bp, Human papillomavirus type 161
gaagaattattgcgcggagg

SEQ ID NO: 46419 - DNA, 20 bp, Human papillomavirus type 161
cctggcattgtataacaagc

SEQ ID NO: 46420 - DNA, 20 bp, Human papillomavirus type 161
tataacaagcaagtaactga

SEQ ID NO: 46421 - DNA, 20 bp, Human papillomavirus type 161
agccttacatgtgctaaaac

SEQ ID NO: 46422 - DNA, 20 bp, Human papillomavirus type 161
gccttacatgtgctaaaacg

SEQ ID NO: 46423 - DNA, 20 bp, Human papillomavirus type 161
catgtgctaaaacgaaagta

SEQ ID NO: 46424 - DNA, 20 bp, Human papillomavirus type 161
ttttagaaagtttgcagtgc

SEQ ID NO: 46425 - DNA, 20 bp, Human papillomavirus type 161
tttagaaagtttgcagtgca

SEQ ID NO: 46426 - DNA, 20 bp, Human papillomavirus type 161
ttagaaagtttgcagtgcaa

SEQ ID NO: 46427 - DNA, 20 bp, Human papillomavirus type 161
tagaaagtttgcagtgcaat

SEQ ID NO: 46428 - DNA, 20 bp, Human papillomavirus type 161
agaaagtttgcagtgcaatt

SEQ ID NO: 46429 - DNA, 20 bp, Human papillomavirus type 161
caatggaaccttttatgagg

SEQ ID NO: 46430 - DNA, 20 bp, Human papillomavirus type 161
tatgaggaggttacaggaga

SEQ ID NO: 46431 - DNA, 20 bp, Human papillomavirus type 161
atgaggaggttacaggagaa

SEQ ID NO: 46432 - DNA, 20 bp, Human papillomavirus type 161
tgaggaggttacaggagaaa

SEQ ID NO: 46433 - DNA, 20 bp, Human papillomavirus type 161
caggagaaagagtatacttt

SEQ ID NO: 46434 - DNA, 20 bp, Human papillomavirus type 161
agctgaggatttgtataaac

SEQ ID NO: 46435 - DNA, 20 bp, Human papillomavirus type 161
gtataaacaatgctttactg

SEQ ID NO: 46436 - DNA, 20 bp, Human papillomavirus type 161
tataaacaatgctttactgg

SEQ ID NO: 46437 - DNA, 20 bp, Human papillomavirus type 161
actggtgattgtccccctga

SEQ ID NO: 46438 - DNA, 20 bp, Human papillomavirus type 161
ctggtgattgtccccctgat

SEQ ID NO: 46439 - DNA, 20 bp, Human papillomavirus type 161
gacctgcagtacctgtggag

SEQ ID NO: 46440 - DNA, 20 bp, Human papillomavirus type 161
gtcctgtagaaataatacct

SEQ ID NO: 46441 - DNA, 20 bp, Human papillomavirus type 161
tagatttaacaaatgtacaa

SEQ ID NO: 46442 - DNA, 20 bp, Human papillomavirus type 161
aacaaatgtacaaattcctg

SEQ ID NO: 46443 - DNA, 20 bp, Human papillomavirus type 161
gtacatttgttaaatctata

SEQ ID NO: 46444 - DNA, 20 bp, Human papillomavirus type 161
agccaataccaccccctaaa

SEQ ID NO: 46445 - DNA, 20 bp, Human papillomavirus type 161
tgctttagatgtaaataatg

SEQ ID NO: 46446 - DNA, 20 bp, Human papillomavirus type 161
gctttagatgtaaataatga

SEQ ID NO: 46447 - DNA, 20 bp, Human papillomavirus type 161
ctttagatgtaaataatgaa

SEQ ID NO: 46448 - DNA, 20 bp, Human papillomavirus type 161
agatgtaaataatgaaccac

SEQ ID NO: 46449 - DNA, 20 bp, Human papillomavirus type 161
aacgtttagctggcaatgcc

SEQ ID NO: 46450 - DNA, 20 bp, Human papillomavirus type 161
agctggcaatgccaggagat

SEQ ID NO: 46451 - DNA, 20 bp, Human papillomavirus type 161
gctggcaatgccaggagatt

SEQ ID NO: 46452 - DNA, 20 bp, Human papillomavirus type 161
tacaatagactgtttgaaca

SEQ ID NO: 46453 - DNA, 20 bp, Human papillomavirus type 161
gaacaggttcctacacgaaa

SEQ ID NO: 46454 - DNA, 20 bp, Human papillomavirus type 161
cataagagtgagccgtgaag

SEQ ID NO: 46455 - DNA, 20 bp, Human papillomavirus type 161
ataagagtgagccgtgaagg

SEQ ID NO: 46456 - DNA, 20 bp, Human papillomavirus type 161
cagttgggtcgccctgttca

SEQ ID NO: 46457 - DNA, 20 bp, Human papillomavirus type 161
ggtcgccctgttcattttta

SEQ ID NO: 46458 - DNA, 20 bp, Human papillomavirus type 161
tggtagttatagatgcacga

SEQ ID NO: 46459 - DNA, 20 bp, Human papillomavirus type 161
acgtaaacgaaaacgcaaac

SEQ ID NO: 46460 - DNA, 20 bp, Human papillomavirus type 161
cgtaaacgaaaacgcaaacg

SEQ ID NO: 46461 - DNA, 20 bp, Human papillomavirus type 161
taattattttgcagatgact

SEQ ID NO: 46462 - DNA, 20 bp, Human papillomavirus type 161
aattattttgcagatgactg

SEQ ID NO: 46463 - DNA, 20 bp, Human papillomavirus type 161
attattttgcagatgactgt

SEQ ID NO: 46464 - DNA, 20 bp, Human papillomavirus type 161
cagcacatcaatttagagtg

SEQ ID NO: 46465 - DNA, 20 bp, Human papillomavirus type 161
agcacatcaatttagagtgt

SEQ ID NO: 46466 - DNA, 20 bp, Human papillomavirus type 161
agagtgtttagattactgtg

SEQ ID NO: 46467 - DNA, 20 bp, Human papillomavirus type 161
gagtgtttagattactgtgt

SEQ ID NO: 46468 - DNA, 20 bp, Human papillomavirus type 161
agattactgtgtccagatcc

SEQ ID NO: 46469 - DNA, 20 bp, Human papillomavirus type 161
catttgatcctaagcaaaat

SEQ ID NO: 46470 - DNA, 20 bp, Human papillomavirus type 161
gatcctaagcaaaatcaggt

SEQ ID NO: 46471 - DNA, 20 bp, Human papillomavirus type 161
atcctaagcaaaatcaggtg

SEQ ID NO: 46472 - DNA, 20 bp, Human papillomavirus type 161
atagtaggttgcactcctcc

SEQ ID NO: 46473 - DNA, 20 bp, Human papillomavirus type 161
tagtaggttgcactcctcca

SEQ ID NO: 46474 - DNA, 20 bp, Human papillomavirus type 161
gacattttaaatgatatcac

SEQ ID NO: 46475 - DNA, 20 bp, Human papillomavirus type 161
taaatgatatcaccaaatgg

SEQ ID NO: 46476 - DNA, 20 bp, Human papillomavirus type 161
aaatgatatcaccaaatggc

SEQ ID NO: 46477 - DNA, 20 bp, Human papillomavirus type 161
aatgatatcaccaaatggcc

SEQ ID NO: 46478 - DNA, 20 bp, Human papillomavirus type 161
tattaaaatgtcaaaggata

SEQ ID NO: 46479 - DNA, 20 bp, Human papillomavirus type 161
cacacatcaatgttatgaat

SEQ ID NO: 46480 - DNA, 20 bp, Human papillomavirus type 161
tgaatccaacagtgttagat

SEQ ID NO: 46481 - DNA, 20 bp, Human papillomavirus type 161
gatgattgggatttagcatt

SEQ ID NO: 46482 - DNA, 20 bp, Human papillomavirus type 161
ggatttagcatttgtacccc

SEQ ID NO: 46483 - DNA, 20 bp, Human papillomavirus type 161
agcatttgtacccccaccac

SEQ ID NO: 46484 - DNA, 20 bp, Human papillomavirus type 161
taggtagaaaacgtatcaga

SEQ ID NO: 46485 - DNA, 20 bp, Human papillomavirus type 161
aggtagaaaacgtatcagaa

SEQ ID NO: 46486 - DNA, 20 bp, Human papillomavirus type 161
ggtagaaaacgtatcagaac

SEQ ID NO: 46487 - DNA, 20 bp, Human papillomavirus type 161
catctccgaaagtatccaga

SEQ ID NO: 46488 - DNA, 20 bp, Human papillomavirus type 161
cagtatttatgtatggaaca

SEQ ID NO: 46489 - DNA, 20 bp, Human papillomavirus type 154
ggaaggaaaatgtttgccat

SEQ ID NO: 46490 - DNA, 20 bp, Human papillomavirus type 154
gaaggaaaatgtttgccatg

SEQ ID NO: 46491 - DNA, 20 bp, Human papillomavirus type 154
gccatgcctgttgcgaaagc

SEQ ID NO: 46492 - DNA, 20 bp, Human papillomavirus type 154
ccatgcctgttgcgaaagct

SEQ ID NO: 46493 - DNA, 20 bp, Human papillomavirus type 154
cgaaagctgtttgtctttaa

SEQ ID NO: 46494 - DNA, 20 bp, Human papillomavirus type 154
tcaccttaccaggttgacac

SEQ ID NO: 46495 - DNA, 20 bp, Human papillomavirus type 154
ccaggttgacactatttgta

SEQ ID NO: 46496 - DNA, 20 bp, Human papillomavirus type 154
acactatttgtaattcctgt

SEQ ID NO: 46497 - DNA, 20 bp, Human papillomavirus type 154
gtaattcctgtaacaaacgc

SEQ ID NO: 46498 - DNA, 20 bp, Human papillomavirus type 154
taattcctgtaacaaacgca

SEQ ID NO: 46499 - DNA, 20 bp, Human papillomavirus type 154
caggacagtggactaggaga

SEQ ID NO: 46500 - DNA, 20 bp, Human papillomavirus type 154
aggacagtggactaggagac

SEQ ID NO: 46501 - DNA, 20 bp, Human papillomavirus type 154
ttttaaccaggtagagactt

SEQ ID NO: 46502 - DNA, 20 bp, Human papillomavirus type 154
taaccaggtagagactttat

SEQ ID NO: 46503 - DNA, 20 bp, Human papillomavirus type 154
aaccaggtagagactttatc

SEQ ID NO: 46504 - DNA, 20 bp, Human papillomavirus type 154
cctgattggattgctaaact

SEQ ID NO: 46505 - DNA, 20 bp, Human papillomavirus type 154
gattgctaaactaacacaat

SEQ ID NO: 46506 - DNA, 20 bp, Human papillomavirus type 154
ctaaactaacacaattaaat

SEQ ID NO: 46507 - DNA, 20 bp, Human papillomavirus type 154
aatcatcaaatggcttctca

SEQ ID NO: 46508 - DNA, 20 bp, Human papillomavirus type 154
tcaagcggaatcatttgatt

SEQ ID NO: 46509 - DNA, 20 bp, Human papillomavirus type 154
agatgcactacaagagcaat

SEQ ID NO: 46510 - DNA, 20 bp, Human papillomavirus type 154
gatgcactacaagagcaatt

SEQ ID NO: 46511 - DNA, 20 bp, Human papillomavirus type 154
atgactctctatgaattggg

SEQ ID NO: 46512 - DNA, 20 bp, Human papillomavirus type 154
ggacccaccgatttatcctc

SEQ ID NO: 46513 - DNA, 20 bp, Human papillomavirus type 154
atcctctcaaataaagcatt

SEQ ID NO: 46514 - DNA, 20 bp, Human papillomavirus type 154
acaaccgcagacgacaagcc

SEQ ID NO: 46515 - DNA, 20 bp, Human papillomavirus type 154
caaccgcagacgacaagccc

SEQ ID NO: 46516 - DNA, 20 bp, Human papillomavirus type 154
ttgatggtgagtacgtggta

SEQ ID NO: 46517 - DNA, 20 bp, Human papillomavirus type 154
atggtgagtacgtggtagtg

SEQ ID NO: 46518 - DNA, 20 bp, Human papillomavirus type 154
tcgtctgcggttgtaaagat

SEQ ID NO: 46519 - DNA, 20 bp, Human papillomavirus type 154
tgtgcaagacatttacagat

SEQ ID NO: 46520 - DNA, 20 bp, Human papillomavirus type 154
acagatcttgtgtgcaaggg

SEQ ID NO: 46521 - DNA, 20 bp, Human papillomavirus type 154
cagatcttgtgtgcaagggg

SEQ ID NO: 46522 - DNA, 20 bp, Human papillomavirus type 154
tgtgcaagggggggactgtc

SEQ ID NO: 46523 - DNA, 20 bp, Human papillomavirus type 154
aaggaacaacatgggcagat

SEQ ID NO: 46524 - DNA, 20 bp, Human papillomavirus type 154
ttggtcctcaagaagtacta

SEQ ID NO: 46525 - DNA, 20 bp, Human papillomavirus type 154
gtcctcaagaagtactacca

SEQ ID NO: 46526 - DNA, 20 bp, Human papillomavirus type 154
tagttcctttagaagaagga

SEQ ID NO: 46527 - DNA, 20 bp, Human papillomavirus type 154
ctttagaagaaggaattcca

SEQ ID NO: 46528 - DNA, 20 bp, Human papillomavirus type 154
agaagaaggaattccagatg

SEQ ID NO: 46529 - DNA, 20 bp, Human papillomavirus type 154
atctaatcgtgccatctcaa

SEQ ID NO: 46530 - DNA, 20 bp, Human papillomavirus type 154
tctaatcgtgccatctcaag

SEQ ID NO: 46531 - DNA, 20 bp, Human papillomavirus type 154
atcatagatttgttcaacag

SEQ ID NO: 46532 - DNA, 20 bp, Human papillomavirus type 154
tcatagatttgttcaacagg

SEQ ID NO: 46533 - DNA, 20 bp, Human papillomavirus type 154
gttcaacaggttcctactcg

SEQ ID NO: 46534 - DNA, 20 bp, Human papillomavirus type 154
tacaattaacacatttgtta

SEQ ID NO: 46535 - DNA, 20 bp, Human papillomavirus type 154
acaattaacacatttgttaa

SEQ ID NO: 46536 - DNA, 20 bp, Human papillomavirus type 154
caattaacacatttgttaac

SEQ ID NO: 46537 - DNA, 20 bp, Human papillomavirus type 154
acacatttgttaacattcct

SEQ ID NO: 46538 - DNA, 20 bp, Human papillomavirus type 154
gttaacattcctgacactag

SEQ ID NO: 46539 - DNA, 20 bp, Human papillomavirus type 154
cagcaaatcaatatagagtt

SEQ ID NO: 46540 - DNA, 20 bp, Human papillomavirus type 154
agcaaatcaatatagagtta

SEQ ID NO: 46541 - DNA, 20 bp, Human papillomavirus type 154
tgagattattattaccagat

SEQ ID NO: 46542 - DNA, 20 bp, Human papillomavirus type 154
ttattaccagatcctaacca

SEQ ID NO: 46543 - DNA, 20 bp, Human papillomavirus type 154
ttaccagatcctaaccagtt

SEQ ID NO: 46544 - DNA, 20 bp, Human papillomavirus type 154
tattcaaatgactaaagagg

SEQ ID NO: 46545 - DNA, 20 bp, Human papillomavirus type 154
attcaaatgactaaagaggt

SEQ ID NO: 46546 - DNA, 20 bp, Human papillomavirus type 154
ttcaaatgactaaagaggtg

SEQ ID NO: 46547 - DNA, 20 bp, Human papillomavirus type 154
aaatgactaaagaggtgtat

SEQ ID NO: 46548 - DNA, 20 bp, Human papillomavirus type 154
tttttttatggacggcggga

SEQ ID NO: 46549 - DNA, 20 bp, Human papillomavirus type 154
gctcatattaatgcaatgga

SEQ ID NO: 46550 - DNA, 20 bp, Human papillomavirus type 154
atgcaatggacccttcaata

SEQ ID NO: 46551 - DNA, 20 bp, Human papillomavirus type 154
aatattagaaaactggcagc

SEQ ID NO: 46552 - DNA, 20 bp, Human papillomavirus type 154
gaaaactggcagctggcatt

SEQ ID NO: 46553 - DNA, 20 bp, Human papillomavirus type 154
attccagctcctcctcaagg

SEQ ID NO: 46554 - DNA, 20 bp, Human papillomavirus type 154
ctcgagaggtcatatctgct

SEQ ID NO: 46555 - DNA, 20 bp, Human papillomavirus type 154
gatacccgaccgatttcggt

SEQ ID NO: 46556 - DNA, 20 bp, Human papillomavirus type 154
atacccgaccgatttcggta

SEQ ID NO: 46557 - DNA, 20 bp, Human papillomavirus type 154
cggtaagtacaatacttata

SEQ ID NO: 46558 - DNA, 20 bp, Human papillomavirus type 154
ggtaagtacaatacttatat

SEQ ID NO: 46559 - DNA, 20 bp, Influenza A virus
agaagtacacatcaggaaga

SEQ ID NO: 46560 - DNA, 20 bp, Influenza A virus
gaatgaaatggatgatggcg

SEQ ID NO: 46561 - DNA, 20 bp, Influenza A virus
catcgccatcatccatttca

SEQ ID NO: 46562 - DNA, 20 bp, Influenza A virus
atcgccatcatccatttcat

SEQ ID NO: 46563 - DNA, 20 bp, Influenza A virus
cattctaagagcgggattct

SEQ ID NO: 46564 - DNA, 20 bp, Influenza A virus
tccaaaggtgtataaaacct

SEQ ID NO: 46565 - DNA, 20 bp, Influenza A virus
tcaaagtaggttttatacac

SEQ ID NO: 46566 - DNA, 20 bp, Influenza A virus
caaagtaggttttatacacc

SEQ ID NO: 46567 - DNA, 20 bp, Influenza A virus
aaagtaggttttatacacct

SEQ ID NO: 46568 - DNA, 20 bp, Influenza A virus
tatacacctttggataatgg

SEQ ID NO: 46569 - DNA, 20 bp, Influenza A virus
gagccaggatattgacatca

SEQ ID NO: 46570 - DNA, 20 bp, Influenza A virus
acatcagaatcacagctgac

SEQ ID NO: 46571 - DNA, 20 bp, Influenza A virus
taatattgctcctttaatgg

SEQ ID NO: 46572 - DNA, 20 bp, Influenza A virus
ctcctttaatggtggcatat

SEQ ID NO: 46573 - DNA, 20 bp, Influenza A virus
aatggtggcatatatgttgg

SEQ ID NO: 46574 - DNA, 20 bp, Influenza A virus
accaaagtttaatcattgct

SEQ ID NO: 46575 - DNA, 20 bp, Influenza A virus
aatcattgctgctaggaaca

SEQ ID NO: 46576 - DNA, 20 bp, Influenza A virus
atcattgctgctaggaacat

SEQ ID NO: 46577 - DNA, 20 bp, Influenza A virus
ctgctaggaacattgtcagg

SEQ ID NO: 46578 - DNA, 20 bp, Influenza A virus
tcaggagagcaacagtatca

SEQ ID NO: 46579 - DNA, 20 bp, Influenza A virus
caggcaacctccaaacattg

SEQ ID NO: 46580 - DNA, 20 bp, Influenza A virus
aagataaaagtacatgaagg

SEQ ID NO: 46581 - DNA, 20 bp, Influenza A virus
acaatggttggacgaagagc

SEQ ID NO: 46582 - DNA, 20 bp, Influenza A virus
gacgaagagcaacagccatt

SEQ ID NO: 46583 - DNA, 20 bp, Influenza A virus
taagaaaagcaaccagaagg

SEQ ID NO: 46584 - DNA, 20 bp, Influenza A virus
gtaaacagagcaaatcaacg

SEQ ID NO: 46585 - DNA, 20 bp, Influenza A virus
caaaaggatgcaaaggtgct

SEQ ID NO: 46586 - DNA, 20 bp, Influenza A virus
aaaaggatgcaaaggtgctg

SEQ ID NO: 46587 - DNA, 20 bp, Influenza A virus
cccagttttgaaacagcacc

SEQ ID NO: 46588 - DNA, 20 bp, Influenza A virus
tgaaacagcacctttgcatc

SEQ ID NO: 46589 - DNA, 20 bp, Influenza A virus
gtgaaacacagggaatggaa

SEQ ID NO: 46590 - DNA, 20 bp, Influenza A virus
acgataacttattcatcgtc

SEQ ID NO: 46591 - DNA, 20 bp, Influenza A virus
ttcatcgtctatgatgtggg

SEQ ID NO: 46592 - DNA, 20 bp, Influenza A virus
tcgtcaacttttccattccc

SEQ ID NO: 46593 - DNA, 20 bp, Influenza A virus
tccattccctgtgtttcact

SEQ ID NO: 46594 - DNA, 20 bp, Influenza A virus
gtgagaacgctattccagca

SEQ ID NO: 46595 - DNA, 20 bp, Influenza A virus
tgagaacgctattccagcag

SEQ ID NO: 46596 - DNA, 20 bp, Influenza A virus
cagcagatgcgtgatgtttt

SEQ ID NO: 46597 - DNA, 20 bp, Influenza A virus
tgggaacgttcgacactgtt

SEQ ID NO: 46598 - DNA, 20 bp, Influenza A virus
gggaacgttcgacactgttc

SEQ ID NO: 46599 - DNA, 20 bp, Influenza A virus
cagaggacccagatgaagga

SEQ ID NO: 46600 - DNA, 20 bp, Influenza A virus
agaggatttctaatcctcgg

SEQ ID NO: 46601 - DNA, 20 bp, Influenza A virus
ctaatcctcggcaaagaaga

SEQ ID NO: 46602 - DNA, 20 bp, Influenza A virus
taatcctcggcaaagaagac

SEQ ID NO: 46603 - DNA, 20 bp, Influenza A virus
tgtcttctttgccgaggatt

SEQ ID NO: 46604 - DNA, 20 bp, Influenza A virus
actgaaagaggagtggaagt

SEQ ID NO: 46605 - DNA, 20 bp, Influenza A virus
cagttgcattgacgacttcc

SEQ ID NO: 46606 - DNA, 20 bp, Influenza A virus
agttgcattgacgacttcca

SEQ ID NO: 46607 - DNA, 20 bp, Influenza A virus
cattgacgacttccactcct

SEQ ID NO: 46608 - DNA, 20 bp, Influenza A virus
acgacttccactcctctttc

SEQ ID NO: 46609 - DNA, 20 bp, Influenza A virus
tcctgggaaattcgtgaatg

SEQ ID NO: 46610 - DNA, 20 bp, Influenza A virus
gtgaatgaagaagctctgag

SEQ ID NO: 46611 - DNA, 20 bp, Influenza A virus
tcagagaatcaggcggaatt

SEQ ID NO: 46612 - DNA, 20 bp, Influenza A virus
acaaggaagcaatgggattc

SEQ ID NO: 46613 - DNA, 20 bp, Influenza A virus
cttccttgtcaattccgcct

SEQ ID NO: 46614 - DNA, 20 bp, Influenza A virus
ggagttctaattatcaacaa

SEQ ID NO: 46615 - DNA, 20 bp, Influenza A virus
taattatcaacaatcttttg

SEQ ID NO: 46616 - DNA, 20 bp, Influenza A virus
tcaacaatcttttgtaccga

SEQ ID NO: 46617 - DNA, 20 bp, Influenza A virus
tgtaccgagtccaggagcga

SEQ ID NO: 46618 - DNA, 20 bp, Influenza A virus
gtaccgagtccaggagcgag

SEQ ID NO: 46619 - DNA, 20 bp, Influenza A virus
atgccaattgtgaaggggac

SEQ ID NO: 46620 - DNA, 20 bp, Influenza A virus
tgaaggggactgctatcata

SEQ ID NO: 46621 - DNA, 20 bp, Influenza A virus
ccatttcagaacatagatag

SEQ ID NO: 46622 - DNA, 20 bp, Influenza A virus
cagaacatagatagcagggc

SEQ ID NO: 46623 - DNA, 20 bp, Influenza A virus
agaacatagatagcagggca

SEQ ID NO: 46624 - DNA, 20 bp, Influenza A virus
cattgaaaatggatgggaag

SEQ ID NO: 46625 - DNA, 20 bp, Influenza A virus
attgaaaatggatgggaagg

SEQ ID NO: 46626 - DNA, 20 bp, Influenza A virus
aaaatggatgggaaggccta

SEQ ID NO: 46627 - DNA, 20 bp, Influenza A virus
atggttggtatggtttcaga

SEQ ID NO: 46628 - DNA, 20 bp, Influenza A virus
gtatggtttcagacaccaga

SEQ ID NO: 46629 - DNA, 20 bp, Influenza A virus
atctggctgattcagaaatg

SEQ ID NO: 46630 - DNA, 20 bp, Influenza A virus
agaaatggacaaactgtacg

SEQ ID NO: 46631 - DNA, 20 bp, Influenza A virus
ttcagcattctctctcagct

SEQ ID NO: 46632 - DNA, 20 bp, Influenza A virus
agcattctctctcagctgtc

SEQ ID NO: 46633 - DNA, 20 bp, Influenza A virus
tctctcagctgtcttttcac

SEQ ID NO: 46634 - DNA, 20 bp, Human papillomavirus type 32
ttaaggcagaatggcaagta

SEQ ID NO: 46635 - DNA, 20 bp, Human papillomavirus type 32
aggcagaatggcaagtactt

SEQ ID NO: 46636 - DNA, 20 bp, Human papillomavirus type 32
tgcctcatcacagccaagta

SEQ ID NO: 46637 - DNA, 20 bp, Human papillomavirus type 32
taccaattgtgcaaagattt

SEQ ID NO: 46638 - DNA, 20 bp, Human papillomavirus type 32
tgcaaagattttgggctgac

SEQ ID NO: 46639 - DNA, 20 bp, Human papillomavirus type 32
gaagaacaaataattcgctg

SEQ ID NO: 46640 - DNA, 20 bp, Human papillomavirus type 32
gctgtgctatatgtcaaaag

SEQ ID NO: 46641 - DNA, 20 bp, Human papillomavirus type 32
atcgccaagtgagaaagatc

SEQ ID NO: 46642 - DNA, 20 bp, Human papillomavirus type 32
tcgccaagtgagaaagatca

SEQ ID NO: 46643 - DNA, 20 bp, Human papillomavirus type 32
taaatatgatgatctttctc

SEQ ID NO: 46644 - DNA, 20 bp, Human papillomavirus type 32
cagaatagtgtgtggttgta

SEQ ID NO: 46645 - DNA, 20 bp, Human papillomavirus type 32
tacacagtgtggacggtcag

SEQ ID NO: 46646 - DNA, 20 bp, Human papillomavirus type 32
aacttgttgtcagtagtaca

SEQ ID NO: 46647 - DNA, 20 bp, Human papillomavirus type 32
ttgtcagtagtacaggcgcg

SEQ ID NO: 46648 - DNA, 20 bp, Human papillomavirus type 32
tcagtagtacaggcgcggac

SEQ ID NO: 46649 - DNA, 20 bp, Human papillomavirus type 32
cttaagtgtaagaacttgca

SEQ ID NO: 46650 - DNA, 20 bp, Human papillomavirus type 32
agtgtaagaacttgcaagca

SEQ ID NO: 46651 - DNA, 20 bp, Human papillomavirus type 32
caagcaacattgttaggtaa

SEQ ID NO: 46652 - DNA, 20 bp, Human papillomavirus type 32
ttaggtaagtttaaagagct

SEQ ID NO: 46653 - DNA, 20 bp, Human papillomavirus type 32
aaacttacctaacaatgttg

SEQ ID NO: 46654 - DNA, 20 bp, Human papillomavirus type 32
ttaatgctaattagatttaa

SEQ ID NO: 46655 - DNA, 20 bp, Human papillomavirus type 32
atgctaattagatttaaatg

SEQ ID NO: 46656 - DNA, 20 bp, Human papillomavirus type 32
gatttaaatgtggcaagaat

SEQ ID NO: 46657 - DNA, 20 bp, Human papillomavirus type 32
aaatgtggcaagaatcgcac

SEQ ID NO: 46658 - DNA, 20 bp, Human papillomavirus type 32
aatgtggcaagaatcgcacc

SEQ ID NO: 46659 - DNA, 20 bp, Human papillomavirus type 32
catatgaatatgcccaacgt

SEQ ID NO: 46660 - DNA, 20 bp, Human papillomavirus type 32
ttaaaaagcaactgtcaggc

SEQ ID NO: 46661 - DNA, 20 bp, Human papillomavirus type 32
taaaaagcaactgtcaggca

SEQ ID NO: 46662 - DNA, 20 bp, Human papillomavirus type 32
aaaaagcaactgtcaggcaa

SEQ ID NO: 46663 - DNA, 20 bp, Human papillomavirus type 32
aaaagcaactgtcaggcaaa

SEQ ID NO: 46664 - DNA, 20 bp, Human papillomavirus type 32
agatgcgtgccaggaacagt

SEQ ID NO: 46665 - DNA, 20 bp, Human papillomavirus type 32
gatgcgtgccaggaacagtt

SEQ ID NO: 46666 - DNA, 20 bp, Human papillomavirus type 32
ttagaactgtatgaggaaga

SEQ ID NO: 46667 - DNA, 20 bp, Human papillomavirus type 32
gaactgtatgaggaagatag

SEQ ID NO: 46668 - DNA, 20 bp, Human papillomavirus type 32
agaaaaacatgtgcagcact

SEQ ID NO: 46669 - DNA, 20 bp, Human papillomavirus type 32
tgaaatgtggcatgcggagc

SEQ ID NO: 46670 - DNA, 20 bp, Human papillomavirus type 32
aaaaaaacagggacgcactg

SEQ ID NO: 46671 - DNA, 20 bp, Human papillomavirus type 32
aaaaaacagggacgcactgt

SEQ ID NO: 46672 - DNA, 20 bp, Human papillomavirus type 32
tattcgatggaaatcctgag

SEQ ID NO: 46673 - DNA, 20 bp, Human papillomavirus type 32
gatggaaatcctgagaatgc

SEQ ID NO: 46674 - DNA, 20 bp, Human papillomavirus type 32
tacaaagaccccaccccgac

SEQ ID NO: 46675 - DNA, 20 bp, Human papillomavirus type 32
gcagccaccaacaaagcacc

SEQ ID NO: 46676 - DNA, 20 bp, Human papillomavirus type 32
cagccaccaacaaagcacct

SEQ ID NO: 46677 - DNA, 20 bp, Human papillomavirus type 32
gttggtggctgcaaagactg

SEQ ID NO: 46678 - DNA, 20 bp, Human papillomavirus type 32
ttggtggctgcaaagactgt

SEQ ID NO: 46679 - DNA, 20 bp, Human papillomavirus type 32
ttgtttatagttgttgctgc

SEQ ID NO: 46680 - DNA, 20 bp, Human papillomavirus type 32
tttatagttgttgctgcgtg

SEQ ID NO: 46681 - DNA, 20 bp, Human papillomavirus type 32
atagttgttgctgcgtgtgt

SEQ ID NO: 46682 - DNA, 20 bp, Human papillomavirus type 32
tagttgttgctgcgtgtgtg

SEQ ID NO: 46683 - DNA, 20 bp, Human papillomavirus type 32
ttgctgcgtgtgtgttgtgt

SEQ ID NO: 46684 - DNA, 20 bp, Human papillomavirus type 32
tactttagaaaatggcgatg

SEQ ID NO: 46685 - DNA, 20 bp, Human papillomavirus type 32
agaaaatggcgatgtgtggc

SEQ ID NO: 46686 - DNA, 20 bp, Human papillomavirus type 32
gaaaatggcgatgtgtggct

SEQ ID NO: 46687 - DNA, 20 bp, Human papillomavirus type 32
ttagccacagtgtttatttg

SEQ ID NO: 46688 - DNA, 20 bp, Human papillomavirus type 32
tagccacagtgtttatttgt

SEQ ID NO: 46689 - DNA, 20 bp, Human papillomavirus type 32
aatattacgtcctctgcaag

SEQ ID NO: 46690 - DNA, 20 bp, Human papillomavirus type 32
atattacgtcctctgcaagt

SEQ ID NO: 46691 - DNA, 20 bp, Human papillomavirus type 32
cgtcctctgcaagtggcccg

SEQ ID NO: 46692 - DNA, 20 bp, Human papillomavirus type 32
gacatttctcctcccaccaa

SEQ ID NO: 46693 - DNA, 20 bp, Human papillomavirus type 32
ctcctcccaccaatactata

SEQ ID NO: 46694 - DNA, 20 bp, Human papillomavirus type 32
tttccatgatattagcccaa

SEQ ID NO: 46695 - DNA, 20 bp, Human papillomavirus type 32
ttccatgatattagcccaat

SEQ ID NO: 46696 - DNA, 20 bp, Human papillomavirus type 32
tccatgatattagcccaatc

SEQ ID NO: 46697 - DNA, 20 bp, Human papillomavirus type 32
ccatgatattagcccaatca

SEQ ID NO: 46698 - DNA, 20 bp, Human papillomavirus type 32
catgatattagcccaatcac

SEQ ID NO: 46699 - DNA, 20 bp, Human papillomavirus type 32
atctgcctcctcctcctgtt

SEQ ID NO: 46700 - DNA, 20 bp, Human papillomavirus type 32
tctgcctcctcctcctgttt

SEQ ID NO: 46701 - DNA, 20 bp, Human papillomavirus type 32
ccaaggtggtcagcacagat

SEQ ID NO: 46702 - DNA, 20 bp, Human papillomavirus type 32
caaggtggtcagcacagatg

SEQ ID NO: 46703 - DNA, 20 bp, Human papillomavirus type 32
gtacgttgcacatattcatc

SEQ ID NO: 46704 - DNA, 20 bp, Human papillomavirus type 32
ggaattacaaaacagtgtta

SEQ ID NO: 46705 - DNA, 20 bp, Human papillomavirus type 32
gaattacaaaacagtgttat

SEQ ID NO: 46706 - DNA, 20 bp, Human papillomavirus type 32
caaaacagtgttattcagga

SEQ ID NO: 46707 - DNA, 20 bp, Human papillomavirus type 32
ttcaggatggtgatatggca

SEQ ID NO: 46708 - DNA, 20 bp, Human papillomavirus type 32
aggatggtgatatggcagat

SEQ ID NO: 46709 - DNA, 20 bp, Human papillomavirus type 32
tgtcatatatccacaccatg

SEQ ID NO: 46710 - DNA, 20 bp, Human papillomavirus type 32
gaatgttggtgtagctccac

SEQ ID NO: 46711 - DNA, 20 bp, Human papillomavirus type 32
gtgtagctccaccgccctct

SEQ ID NO: 46712 - DNA, 20 bp, Human papillomavirus type 32
agaagatagttatagatttg

SEQ ID NO: 46713 - DNA, 20 bp, Human papillomavirus type 32
gaagatagttatagatttgt

SEQ ID NO: 46714 - DNA, 20 bp, Human papillomavirus type 32
ccgttggataatgtccatta

SEQ ID NO: 46715 - DNA, 20 bp, Human papillomavirus type 32
gataatgtccattaaattta

SEQ ID NO: 46716 - DNA, 20 bp, Human papillomavirus type 32
aatttagcaagcacatgcag

SEQ ID NO: 46717 - DNA, 20 bp, Human papillomavirus type 32
agcaagcacatgcagttttt

SEQ ID NO: 46718 - DNA, 20 bp, Human papillomavirus type 32
gcaagcacatgcagttttta

SEQ ID NO: 46719 - DNA, 20 bp, Human papillomavirus type 136
atcatcaaatggcggcacag

SEQ ID NO: 46720 - DNA, 20 bp, Human papillomavirus type 136
caattaagtaaaatggttca

SEQ ID NO: 46721 - DNA, 20 bp, Human papillomavirus type 136
aattaagtaaaatggttcaa

SEQ ID NO: 46722 - DNA, 20 bp, Human papillomavirus type 136
agtaaaatggttcaatgggc

SEQ ID NO: 46723 - DNA, 20 bp, Human papillomavirus type 136
aatgggcgtatgataacaaa

SEQ ID NO: 46724 - DNA, 20 bp, Human papillomavirus type 136
tactttcggcaagaaatgaa

SEQ ID NO: 46725 - DNA, 20 bp, Human papillomavirus type 136
cggcaagaaatgaaaaatat

SEQ ID NO: 46726 - DNA, 20 bp, Human papillomavirus type 136
ggcaagaaatgaaaaatatg

SEQ ID NO: 46727 - DNA, 20 bp, Human papillomavirus type 136
tcaaatgttgtagggaatgt

SEQ ID NO: 46728 - DNA, 20 bp, Human papillomavirus type 136
caaatgttgtagggaatgtg

SEQ ID NO: 46729 - DNA, 20 bp, Human papillomavirus type 136
aacacccagactgaagagac

SEQ ID NO: 46730 - DNA, 20 bp, Human papillomavirus type 136
ctcaagaagcggcaggacct

SEQ ID NO: 46731 - DNA, 20 bp, Human papillomavirus type 136
aaccacgacatcacctaaaa

SEQ ID NO: 46732 - DNA, 20 bp, Human papillomavirus type 136
taggtgatgtcgtggttgaa

SEQ ID NO: 46733 - DNA, 20 bp, Human papillomavirus type 136
aggtgatgtcgtggttgaac

SEQ ID NO: 46734 - DNA, 20 bp, Human papillomavirus type 136
ggcaaagccatcgatcagta

SEQ ID NO: 46735 - DNA, 20 bp, Human papillomavirus type 136
caagagttgagcgacttaaa

SEQ ID NO: 46736 - DNA, 20 bp, Human papillomavirus type 136
agcgacttaaagcagaggct

SEQ ID NO: 46737 - DNA, 20 bp, Human papillomavirus type 136
aagcagaggctcgggatccg

SEQ ID NO: 46738 - DNA, 20 bp, Human papillomavirus type 136
gtccttataaaaggttgtgc

SEQ ID NO: 46739 - DNA, 20 bp, Human papillomavirus type 136
accccattgaagttacaact

SEQ ID NO: 46740 - DNA, 20 bp, Human papillomavirus type 136
aagttacaactgcaattgat

SEQ ID NO: 46741 - DNA, 20 bp, Human papillomavirus type 136
caactgcaattgatccagtt

SEQ ID NO: 46742 - DNA, 20 bp, Human papillomavirus type 136
atccagtttcagaagtagtt

SEQ ID NO: 46743 - DNA, 20 bp, Human papillomavirus type 136
cagaagtagttggtgtaggt

SEQ ID NO: 46744 - DNA, 20 bp, Human papillomavirus type 136
agagattattaactccactt

SEQ ID NO: 46745 - DNA, 20 bp, Human papillomavirus type 136
gagattattaactccacttg

SEQ ID NO: 46746 - DNA, 20 bp, Human papillomavirus type 136
ttaactccacttgtaaatgg

SEQ ID NO: 46747 - DNA, 20 bp, Human papillomavirus type 136
actccacttgtaaatggcct

SEQ ID NO: 46748 - DNA, 20 bp, Human papillomavirus type 136
taaatggcctgattttactc

SEQ ID NO: 46749 - DNA, 20 bp, Human papillomavirus type 136
gccccttcgacgtattatcc

SEQ ID NO: 46750 - DNA, 20 bp, Human papillomavirus type 136
gacgtattatccgacgccca

SEQ ID NO: 46751 - DNA, 20 bp, Human papillomavirus type 136
tccgacgcccagtggttcgt

SEQ ID NO: 46752 - DNA, 20 bp, Human papillomavirus type 136
gttagttagcagcgaatctc

SEQ ID NO: 46753 - DNA, 20 bp, Human papillomavirus type 136
gttagcagcgaatctcaaat

SEQ ID NO: 46754 - DNA, 20 bp, Human papillomavirus type 136
tgtaaagttcctctggaagc

SEQ ID NO: 46755 - DNA, 20 bp, Human papillomavirus type 136
ctctggaagctgatgtgcta

SEQ ID NO: 46756 - DNA, 20 bp, Human papillomavirus type 136
atgcaatggactctcgcatc

SEQ ID NO: 46757 - DNA, 20 bp, Human papillomavirus type 136
gatgactgggagttagcatt

SEQ ID NO: 46758 - DNA, 20 bp, Human papillomavirus type 136
cattaatgtgggctagcaca

SEQ ID NO: 46759 - DNA, 20 bp, Human papillomavirus type 136
atcagacaccattaggcaaa

SEQ ID NO: 46760 - DNA, 20 bp, Human papillomavirus type 136
ggcaaaaaattcttatatca

SEQ ID NO: 46761 - DNA, 20 bp, Human papillomavirus type 136
ttatatcagatgggattact

SEQ ID NO: 46762 - DNA, 20 bp, Human papillomavirus type 136
tatcagatgggattacttaa

SEQ ID NO: 46763 - DNA, 20 bp, Human papillomavirus type 136
cttaattcccgtaagcgacc

SEQ ID NO: 46764 - DNA, 20 bp, Human papillomavirus type 136
cttgatgtgtccactaataa

SEQ ID NO: 46765 - DNA, 20 bp, Human papillomavirus type 136
atgtgtccactaataaacaa

SEQ ID NO: 46766 - DNA, 20 bp, Human papillomavirus type 136
ctgactcattatattggtag

SEQ ID NO: 46767 - DNA, 20 bp, Human papillomavirus type 136
tattggtagtttaccctcct

SEQ ID NO: 46768 - DNA, 20 bp, Human papillomavirus type 136
gtagtttaccctcctattat

SEQ ID NO: 46769 - DNA, 20 bp, Human papillomavirus type 136
gtatagttttggcgcgttct

SEQ ID NO: 46770 - DNA, 20 bp, Human papillomavirus type 136
tggcgcgttctgcaaatcca

SEQ ID NO: 46771 - DNA, 20 bp, Human papillomavirus type 136
ggcgcgttctgcaaatccaa

SEQ ID NO: 46772 - DNA, 20 bp, Human papillomavirus type 136
gcgcgttctgcaaatccaac

SEQ ID NO: 46773 - DNA, 20 bp, Human papillomavirus type 136
tgcaaatccaaccgttaacg

SEQ ID NO: 46774 - DNA, 20 bp, Influenza A virus
cgacttccatggcttctgct

SEQ ID NO: 46775 - DNA, 20 bp, Influenza A virus
catggcttctgctgcctgct

SEQ ID NO: 46776 - DNA, 20 bp, Influenza A virus
tgctgcctgctcacttgatc

SEQ ID NO: 46777 - DNA, 20 bp, Influenza A virus
atccagccatctgctccatg

SEQ ID NO: 46778 - DNA, 20 bp, Influenza A virus
gccgtagtgctggctagtac

SEQ ID NO: 46779 - DNA, 20 bp, Influenza A virus
ttgcagcaagtatcattggg

SEQ ID NO: 46780 - DNA, 20 bp, Influenza A virus
cagcaagtatcattgggata

SEQ ID NO: 46781 - DNA, 20 bp, Influenza A virus
ggatattgcacttgatattg

SEQ ID NO: 46782 - DNA, 20 bp, Influenza A virus
cacttgatattgtggattct

SEQ ID NO: 46783 - DNA, 20 bp, Influenza A virus
atattgtggattcttgatcg

SEQ ID NO: 46784 - DNA, 20 bp, Human parainfluenza virus 3
ctggtgtccttattatcaat

SEQ ID NO: 46785 - DNA, 20 bp, Human parainfluenza virus 3
ttatcaatggcttatgccaa

SEQ ID NO: 46786 - DNA, 20 bp, Human parainfluenza virus 3
tcaatggcttatgccaatcc

SEQ ID NO: 46787 - DNA, 20 bp, Human parainfluenza virus 3
tgccaatccagagctctacc

SEQ ID NO: 46788 - DNA, 20 bp, Human parainfluenza virus 3
acatctgcattacttccatt

SEQ ID NO: 46789 - DNA, 20 bp, Human parainfluenza virus 3
gggtatccatcatgtttagg

SEQ ID NO: 46790 - DNA, 20 bp, Human parainfluenza virus 3
ggtatccatcatgtttagga

SEQ ID NO: 46791 - DNA, 20 bp, Human parainfluenza virus 3
aggagctcttataatacaga

SEQ ID NO: 46792 - DNA, 20 bp, Human parainfluenza virus 3
ggagctcttataatacagat

SEQ ID NO: 46793 - DNA, 20 bp, Human parainfluenza virus 3
taatacagatctggatagtt

SEQ ID NO: 46794 - DNA, 20 bp, Human parainfluenza virus 3
tacaaaatagagccatgcaa

SEQ ID NO: 46795 - DNA, 20 bp, Human parainfluenza virus 3
atatgttccagctaggacaa

SEQ ID NO: 46796 - DNA, 20 bp, Human parainfluenza virus 3
cagctaggacaagcagtagc

SEQ ID NO: 46797 - DNA, 20 bp, Human parainfluenza virus 3
agctcatctgagcttcagca

SEQ ID NO: 46798 - DNA, 20 bp, Human parainfluenza virus 3
agcatcacgtgctactgctt

SEQ ID NO: 46799 - DNA, 20 bp, Human parainfluenza virus 3
atggaaagcgatgctaaaaa

SEQ ID NO: 46800 - DNA, 20 bp, Human parainfluenza virus 3
ttgggaagaggaatcaagag

SEQ ID NO: 46801 - DNA, 20 bp, Human parainfluenza virus 3
ggaagaggaatcaagagata

SEQ ID NO: 46802 - DNA, 20 bp, Human parainfluenza virus 3
aattcatacttagcaccgac

SEQ ID NO: 46803 - DNA, 20 bp, Human parainfluenza virus 3
aatgatattgagggccgagg

SEQ ID NO: 46804 - DNA, 20 bp, Human parainfluenza virus 3
tgggttccatttttagaatt

SEQ ID NO: 46805 - DNA, 20 bp, Human parainfluenza virus 3
catttttagaatttgtgatg

SEQ ID NO: 46806 - DNA, 20 bp, Human parainfluenza virus 3
ttagaatttgtgatgcttct

SEQ ID NO: 46807 - DNA, 20 bp, Human parainfluenza virus 3
tagaatttgtgatgcttctg

SEQ ID NO: 46808 - DNA, 20 bp, Human parainfluenza virus 3
agaatttgtgatgcttctgg

SEQ ID NO: 46809 - DNA, 20 bp, Human parainfluenza virus 3
ataacaacacagatcgaacc

SEQ ID NO: 46810 - DNA, 20 bp, Human parainfluenza virus 3
ggttcgatctgtgttgttat

SEQ ID NO: 46811 - DNA, 20 bp, Human parainfluenza virus 3
gatctgtgttgttatcaatg

SEQ ID NO: 46812 - DNA, 20 bp, Human parainfluenza virus 3
ttatcaatggtgagattcca

SEQ ID NO: 46813 - DNA, 20 bp, Human parainfluenza virus 3
tcaatggtgagattccatga

SEQ ID NO: 46814 - DNA, 20 bp, Human parainfluenza virus 3
gacccacttatggagacaca

SEQ ID NO: 46815 - DNA, 20 bp, Human parainfluenza virus 3
acccacttatggagacacaa

SEQ ID NO: 46816 - DNA, 20 bp, Human parainfluenza virus 3
tggagacacaagggattgac

SEQ ID NO: 46817 - DNA, 20 bp, Human parainfluenza virus 3
acaagaatatacctgatcta

SEQ ID NO: 46818 - DNA, 20 bp, Human parainfluenza virus 3
aatcagagatattaagttca

SEQ ID NO: 46819 - DNA, 20 bp, Human parainfluenza virus 3
tttgaaaatggtcatataga

SEQ ID NO: 46820 - DNA, 20 bp, Human parainfluenza virus 3
gaaaatggtcatatagaacc

SEQ ID NO: 46821 - DNA, 20 bp, Human parainfluenza virus 3
aaaatggtcatatagaacca

SEQ ID NO: 46822 - DNA, 20 bp, Human parainfluenza virus 3
ccactcaaagtcaatgaaca

SEQ ID NO: 46823 - DNA, 20 bp, Human parainfluenza virus 3
gagttgccaaaatcggaaat

SEQ ID NO: 46824 - DNA, 20 bp, Human parainfluenza virus 3
gatgccaacaaagttgctct

SEQ ID NO: 46825 - DNA, 20 bp, Human parainfluenza virus 3
ctcttgctcctcaatgtctt

SEQ ID NO: 46826 - DNA, 20 bp, Human parainfluenza virus 3
ctcctcaatgtcttccacta

SEQ ID NO: 46827 - DNA, 20 bp, Human parainfluenza virus 3
cactagataggagcataaaa

SEQ ID NO: 46828 - DNA, 20 bp, Human parainfluenza virus 3
tatgctcctatctagtggaa

SEQ ID NO: 46829 - DNA, 20 bp, Human parainfluenza virus 3
caaccttctttacctggcga

SEQ ID NO: 46830 - DNA, 20 bp, Human parainfluenza virus 3
tttacctggcgaattcagat

SEQ ID NO: 46831 - DNA, 20 bp, Human parainfluenza virus 3
acctggcgaattcagatact

SEQ ID NO: 46832 - DNA, 20 bp, Human parainfluenza virus 3
cctggcgaattcagatacta

SEQ ID NO: 46833 - DNA, 20 bp, Human parainfluenza virus 3
agatactatcctaatattat

SEQ ID NO: 46834 - DNA, 20 bp, Human parainfluenza virus 3
ttggatagactgatcatccc

SEQ ID NO: 46835 - DNA, 20 bp, Human parainfluenza virus 3
gatagactgatcatccctct

SEQ ID NO: 46836 - DNA, 20 bp, Human parainfluenza virus 3
agattacagaaagatgtgat

SEQ ID NO: 46837 - DNA, 20 bp, Human parainfluenza virus 3
cagaaagatgtgatagtaac

SEQ ID NO: 46838 - DNA, 20 bp, Human parainfluenza virus 3
tgttctgggattagtgtttt

SEQ ID NO: 46839 - DNA, 20 bp, Human parainfluenza virus 3
attaactaggctgctgaaca

SEQ ID NO: 46840 - DNA, 20 bp, Human parainfluenza virus 3
ttaactaggctgctgaacac

SEQ ID NO: 46841 - DNA, 20 bp, Human parainfluenza virus 3
actaggctgctgaacactca

SEQ ID NO: 46842 - DNA, 20 bp, Human parainfluenza virus 3
catatcatataatatccaca

SEQ ID NO: 46843 - DNA, 20 bp, Human parainfluenza virus 3
ctcttcccagccatatcatg

SEQ ID NO: 46844 - DNA, 20 bp, Human parainfluenza virus 3
tacatgcaacggaatcggca

SEQ ID NO: 46845 - DNA, 20 bp, Human parainfluenza virus 3
taacacataaagaatgtagt

SEQ ID NO: 46846 - DNA, 20 bp, Human parainfluenza virus 3
cttctttgtttgtattgaac

SEQ ID NO: 46847 - DNA, 20 bp, Human parainfluenza virus 3
tttgtttgtattgaacagca

SEQ ID NO: 46848 - DNA, 20 bp, Human parainfluenza virus 3
gtttgtattgaacagcattc

SEQ ID NO: 46849 - DNA, 20 bp, Human parainfluenza virus 3
agaaagaacccaatagacaa

SEQ ID NO: 46850 - DNA, 20 bp, Human parainfluenza virus 3
gagatggaatactggaagca

SEQ ID NO: 46851 - DNA, 20 bp, Human parainfluenza virus 3
ccagcatcctttccgtgatt

SEQ ID NO: 46852 - DNA, 20 bp, Human parainfluenza virus 3
ccgtgattggtatgcttcca

SEQ ID NO: 46853 - DNA, 20 bp, Human parainfluenza virus 3
cgtgattggtatgcttccag

SEQ ID NO: 46854 - DNA, 20 bp, Human parainfluenza virus 3
aaatccagatgatttttgga

SEQ ID NO: 46855 - DNA, 20 bp, Human parainfluenza virus 3
aatccagatgatttttggag

SEQ ID NO: 46856 - DNA, 20 bp, Human parainfluenza virus 3
ttggaggtgcacgtctggtc

SEQ ID NO: 46857 - DNA, 20 bp, Human parainfluenza virus 3
tggaggtgcacgtctggtct

SEQ ID NO: 46858 - DNA, 20 bp, Human parainfluenza virus 3
ggaggtgcacgtctggtctt

SEQ ID NO: 46859 - DNA, 20 bp, Human parainfluenza virus 3
gaccagggatatattacaaa

SEQ ID NO: 46860 - DNA, 20 bp, Human parainfluenza virus 3
caaaggcaaaataatatttc

SEQ ID NO: 46861 - DNA, 20 bp, Human parainfluenza virus 3
ctcgggtatggaggtcttga

SEQ ID NO: 46862 - DNA, 20 bp, Human parainfluenza virus 3
tcgggtatggaggtcttgaa

SEQ ID NO: 46863 - DNA, 20 bp, Human parainfluenza virus 3
aacatccaataaatgagaat

SEQ ID NO: 46864 - DNA, 20 bp, Human parainfluenza virus 3
ctcaacagcaactgaaagag

SEQ ID NO: 46865 - DNA, 20 bp, Human parainfluenza virus 3
ctgatggccagctcgtttac

SEQ ID NO: 46866 - DNA, 20 bp, Human parainfluenza virus 3
tgatggccagctcgtttact

SEQ ID NO: 46867 - DNA, 20 bp, Human parainfluenza virus 3
actctttcagttgctgttga

SEQ ID NO: 46868 - DNA, 20 bp, Human parainfluenza virus 3
ctctttcagttgctgttgag

SEQ ID NO: 46869 - DNA, 20 bp, Human parainfluenza virus 3
atcataaatgcttacggttc

SEQ ID NO: 46870 - DNA, 20 bp, Human parainfluenza virus 3
cggttcaaactctgcgatat

SEQ ID NO: 46871 - DNA, 20 bp, Human parainfluenza virus 3
aaactctgcgatatcatatg

SEQ ID NO: 46872 - DNA, 20 bp, Human parainfluenza virus 3
attattaccagagcttcata

SEQ ID NO: 46873 - DNA, 20 bp, Human parainfluenza virus 3
ttaccagagcttcataggaa

SEQ ID NO: 46874 - DNA, 20 bp, Human parainfluenza virus 3
ttcctcaagctctgaaagca

SEQ ID NO: 46875 - DNA, 20 bp, Human parainfluenza virus 3
ctcaagctctgaaagcatta

SEQ ID NO: 46876 - DNA, 20 bp, Human parainfluenza virus 3
tctagatgtgtcttttggtc

SEQ ID NO: 46877 - DNA, 20 bp, Human parainfluenza virus 3
tggtcagagacagtaataga

SEQ ID NO: 46878 - DNA, 20 bp, Human parainfluenza virus 3
ggtcagagacagtaatagac

SEQ ID NO: 46879 - DNA, 20 bp, Human parainfluenza virus 3
taagaattcaaattggatgc

SEQ ID NO: 46880 - DNA, 20 bp, Human parainfluenza virus 3
aagaattcaaattggatgca

SEQ ID NO: 46881 - DNA, 20 bp, Human parainfluenza virus 3
agaattcaaattggatgcaa

SEQ ID NO: 46882 - DNA, 20 bp, Human parainfluenza virus 3
aaattggatgcaatatgcct

SEQ ID NO: 46883 - DNA, 20 bp, Human parainfluenza virus 3
gatgcaatatgcctctttaa

SEQ ID NO: 46884 - DNA, 20 bp, Human parainfluenza virus 3
ccatagcattgcgacaaaag

SEQ ID NO: 46885 - DNA, 20 bp, Human parainfluenza virus 3
cgacaaaagatgtggattca

SEQ ID NO: 46886 - DNA, 20 bp, Human parainfluenza virus 3
atttatcaggaggaaggatg

SEQ ID NO: 46887 - DNA, 20 bp, Human parainfluenza virus 3
atcaggaggaaggatgataa

SEQ ID NO: 46888 - DNA, 20 bp, Human parainfluenza virus 3
tcaggaggaaggatgataag

SEQ ID NO: 46889 - DNA, 20 bp, Human parainfluenza virus 3
gatggaagcctcacagatag

SEQ ID NO: 46890 - DNA, 20 bp, Human parainfluenza virus 3
tacactagatagtctcaaaa

SEQ ID NO: 46891 - DNA, 20 bp, Human parainfluenza virus 3
acactagatagtctcaaaat

SEQ ID NO: 46892 - DNA, 20 bp, Human parainfluenza virus 3
cactagatagtctcaaaatt

SEQ ID NO: 46893 - DNA, 20 bp, Human parainfluenza virus 3
taacaccggtagctacatca

SEQ ID NO: 46894 - DNA, 20 bp, Human coronavirus 229E
ttgctatggccggcatcttt

SEQ ID NO: 46895 - DNA, 20 bp, Human coronavirus 229E
tgctatggccggcatctttg

SEQ ID NO: 46896 - DNA, 20 bp, Human coronavirus 229E
gctatggccggcatctttga

SEQ ID NO: 46897 - DNA, 20 bp, Human coronavirus 229E
ctatggccggcatctttgat

SEQ ID NO: 46898 - DNA, 20 bp, Human coronavirus 229E
gatgctggagtcgtagtgta

SEQ ID NO: 46899 - DNA, 20 bp, Human coronavirus 229E
tactattgcgcaagccgtcc

SEQ ID NO: 46900 - DNA, 20 bp, Human coronavirus 229E
cgcaagccgtccgccgttat

SEQ ID NO: 46901 - DNA, 20 bp, Human coronavirus 229E
tagcgaggccgctagcaatg

SEQ ID NO: 46902 - DNA, 20 bp, Human coronavirus 229E
tagggcatgccgatttgttt

SEQ ID NO: 46903 - DNA, 20 bp, Human coronavirus 229E
agggcatgccgatttgtttc

SEQ ID NO: 46904 - DNA, 20 bp, Human coronavirus 229E
cggtgagaacgaagaaatta

SEQ ID NO: 46905 - DNA, 20 bp, Human coronavirus 229E
ggtgagaacgaagaaattat

SEQ ID NO: 46906 - DNA, 20 bp, Human coronavirus 229E
tcatcaatggtcatacttac

SEQ ID NO: 46907 - DNA, 20 bp, Human coronavirus 229E
cgtttgtgcttggcttacta

SEQ ID NO: 46908 - DNA, 20 bp, Human coronavirus 229E
gtgcttggcttactaagcgt

SEQ ID NO: 46909 - DNA, 20 bp, Human coronavirus 229E
caacatcctagaggccttta

SEQ ID NO: 46910 - DNA, 20 bp, Human coronavirus 229E
actaaacctgtgtttattag

SEQ ID NO: 46911 - DNA, 20 bp, Human coronavirus 229E
ctaaacctgtgtttattagt

SEQ ID NO: 46912 - DNA, 20 bp, Human coronavirus 229E
attagtgcattagttcaatg

SEQ ID NO: 46913 - DNA, 20 bp, Human coronavirus 229E
ttagtgcattagttcaatgt

SEQ ID NO: 46914 - DNA, 20 bp, Human coronavirus 229E
ctttgttgcttcttccactt

SEQ ID NO: 46915 - DNA, 20 bp, Human coronavirus 229E
gttgcttcttccacttttgt

SEQ ID NO: 46916 - DNA, 20 bp, Human coronavirus 229E
ttgcttcttccacttttgta

SEQ ID NO: 46917 - DNA, 20 bp, Human coronavirus 229E
cttcttccacttttgtagaa

SEQ ID NO: 46918 - DNA, 20 bp, Human coronavirus 229E
ttccacttttgtagaagagg

SEQ ID NO: 46919 - DNA, 20 bp, Human coronavirus 229E
gacgtgtttgtcacagctat

SEQ ID NO: 46920 - DNA, 20 bp, Human coronavirus 229E
acgtgtttgtcacagctatt

SEQ ID NO: 46921 - DNA, 20 bp, Human coronavirus 229E
gtcacagctattcaaactgt

SEQ ID NO: 46922 - DNA, 20 bp, Human coronavirus 229E
tcacagctattcaaactgtc

SEQ ID NO: 46923 - DNA, 20 bp, Human coronavirus 229E
aaactgtctttgactgtgct

SEQ ID NO: 46924 - DNA, 20 bp, Human coronavirus 229E
ttgttggttccactgaagaa

SEQ ID NO: 46925 - DNA, 20 bp, Human coronavirus 229E
ttggttccactgaagaagtt

SEQ ID NO: 46926 - DNA, 20 bp, Human coronavirus 229E
gttccactgaagaagttaaa

SEQ ID NO: 46927 - DNA, 20 bp, Human coronavirus 229E
cactgaagaagttaaatctt

SEQ ID NO: 46928 - DNA, 20 bp, Human coronavirus 229E
aatcttcacgtgttgaacgt

SEQ ID NO: 46929 - DNA, 20 bp, Human coronavirus 229E
acaaatgggatgatttttgc

SEQ ID NO: 46930 - DNA, 20 bp, Human coronavirus 229E
ttgcagacaatatagtaacg

SEQ ID NO: 46931 - DNA, 20 bp, Human coronavirus 229E
tgcagacaatatagtaacga

SEQ ID NO: 46932 - DNA, 20 bp, Human coronavirus 229E
gcagacaatatagtaacgag

SEQ ID NO: 46933 - DNA, 20 bp, Human coronavirus 229E
cagacaatatagtaacgagt

SEQ ID NO: 46934 - DNA, 20 bp, Human coronavirus 229E
taaacgttggcttggcattt

SEQ ID NO: 46935 - DNA, 20 bp, Human coronavirus 229E
aaacgttggcttggcatttt

SEQ ID NO: 46936 - DNA, 20 bp, Human coronavirus 229E
aacgttggcttggcattttg

SEQ ID NO: 46937 - DNA, 20 bp, Human coronavirus 229E
gcttggcattttgctagagg

SEQ ID NO: 46938 - DNA, 20 bp, Human coronavirus 229E
gcattttgctagaggcctat

SEQ ID NO: 46939 - DNA, 20 bp, Human coronavirus 229E
cgagagtgcttacatgccaa

SEQ ID NO: 46940 - DNA, 20 bp, Human coronavirus 229E
gagagtgcttacatgccaat

SEQ ID NO: 46941 - DNA, 20 bp, Human coronavirus 229E
catgccaattgcagacccta

SEQ ID NO: 46942 - DNA, 20 bp, Human coronavirus 229E
cagaccctacacattttgac

SEQ ID NO: 46943 - DNA, 20 bp, Human coronavirus 229E
tgacattgaagaagttgaac

SEQ ID NO: 46944 - DNA, 20 bp, Human coronavirus 229E
tagatgtttgtgaaaaggca

SEQ ID NO: 46945 - DNA, 20 bp, Human coronavirus 229E
gtgaaaaggcaattggcaag

SEQ ID NO: 46946 - DNA, 20 bp, Human coronavirus 229E
tgaaaaggcaattggcaaga

SEQ ID NO: 46947 - DNA, 20 bp, Human coronavirus 229E
gcaagaaaattaaacatgaa

SEQ ID NO: 46948 - DNA, 20 bp, Human coronavirus 229E
aacatgaaggtgactgggat

SEQ ID NO: 46949 - DNA, 20 bp, Human coronavirus 229E
actcagttatgttacaaata

SEQ ID NO: 46950 - DNA, 20 bp, Human coronavirus 229E
tgttacaaatacaattaact

SEQ ID NO: 46951 - DNA, 20 bp, Human coronavirus 229E
caaatacaattaactggtat

SEQ ID NO: 46952 - DNA, 20 bp, Human coronavirus 229E
actggtatacttgatggtga

SEQ ID NO: 46953 - DNA, 20 bp, Human coronavirus 229E
atggtgactatgctatgcag

SEQ ID NO: 46954 - DNA, 20 bp, Human coronavirus 229E
aagaatcgggagctgttttg

SEQ ID NO: 46955 - DNA, 20 bp, Human coronavirus 229E
tgttttgtacgcccactaag

SEQ ID NO: 46956 - DNA, 20 bp, Human coronavirus 229E
gttttgtacgcccactaaga

SEQ ID NO: 46957 - DNA, 20 bp, Human coronavirus 229E
ttttgtacgcccactaagaa

SEQ ID NO: 46958 - DNA, 20 bp, Human coronavirus 229E
tgtacgcccactaagaaggc

SEQ ID NO: 46959 - DNA, 20 bp, Human coronavirus 229E
aaaatacagttgatacaaca

SEQ ID NO: 46960 - DNA, 20 bp, Human coronavirus 229E
atacaacacctaaggaagaa

SEQ ID NO: 46961 - DNA, 20 bp, Human coronavirus 229E
gttgttaaagagaagttgaa

SEQ ID NO: 46962 - DNA, 20 bp, Human coronavirus 229E
ttgttaaagagaagttgaac

SEQ ID NO: 46963 - DNA, 20 bp, Human coronavirus 229E
ttaaagagaagttgaacgcc

SEQ ID NO: 46964 - DNA, 20 bp, Human coronavirus 229E
agtgaatgttcaaaaagttg

SEQ ID NO: 46965 - DNA, 20 bp, Human coronavirus 229E
gtgaatgttcaaaaagttga

SEQ ID NO: 46966 - DNA, 20 bp, Human coronavirus 229E
aaaaagttgagcaacctaaa

SEQ ID NO: 46967 - DNA, 20 bp, Human coronavirus 229E
agcaacctaaaatagaacca

SEQ ID NO: 46968 - DNA, 20 bp, Human coronavirus 229E
aagttgcacccaagccttac

SEQ ID NO: 46969 - DNA, 20 bp, Human coronavirus 229E
tgccatccgaaaaggacaaa

SEQ ID NO: 46970 - DNA, 20 bp, Human coronavirus 229E
agataataatgttcaacgat

SEQ ID NO: 46971 - DNA, 20 bp, Human coronavirus 229E
gataataatgttcaacgatg

SEQ ID NO: 46972 - DNA, 20 bp, Human coronavirus 229E
aacgatgcacacgtaagttg

SEQ ID NO: 46973 - DNA, 20 bp, Human coronavirus 229E
aatagacttatgtgtgatat

SEQ ID NO: 46974 - DNA, 20 bp, Human coronavirus 229E
acacatctgaattgcttact

SEQ ID NO: 46975 - DNA, 20 bp, Human coronavirus 229E
cttactaaagcaatagatgt

SEQ ID NO: 46976 - DNA, 20 bp, Human coronavirus 229E
ctaaagcaatagatgttgat

SEQ ID NO: 46977 - DNA, 20 bp, Human coronavirus 229E
attgggtcgaattttatggc

SEQ ID NO: 46978 - DNA, 20 bp, Human coronavirus 229E
ggtcgaattttatggcttta

SEQ ID NO: 46979 - DNA, 20 bp, Human coronavirus 229E
gttattgtgtccatggtatt

SEQ ID NO: 46980 - DNA, 20 bp, Human coronavirus 229E
ttgtgtccatggtattaagt

SEQ ID NO: 46981 - DNA, 20 bp, Human coronavirus 229E
tgtccatggtattaagtact

SEQ ID NO: 46982 - DNA, 20 bp, Human coronavirus 229E
agtactattcacgtgttaga

SEQ ID NO: 46983 - DNA, 20 bp, Human coronavirus 229E
acgtgttagaagtgttagag

SEQ ID NO: 46984 - DNA, 20 bp, Human coronavirus 229E
ttttaaaacgtagtcttaaa

SEQ ID NO: 46985 - DNA, 20 bp, Human coronavirus 229E
taaaacgtagtcttaaatat

SEQ ID NO: 46986 - DNA, 20 bp, Human coronavirus 229E
aaaacgtagtcttaaatata

SEQ ID NO: 46987 - DNA, 20 bp, Human coronavirus 229E
aaacgtagtcttaaatataa

SEQ ID NO: 46988 - DNA, 20 bp, Human coronavirus 229E
aatataacttaaaagcgtca

SEQ ID NO: 46989 - DNA, 20 bp, Human coronavirus 229E
attgggctgcaagatgtgtc

SEQ ID NO: 46990 - DNA, 20 bp, Human coronavirus 229E
ggctgcaagatgtgtctttt

SEQ ID NO: 46991 - DNA, 20 bp, Human coronavirus 229E
ttggttaccaagagttaagt

SEQ ID NO: 46992 - DNA, 20 bp, Human coronavirus 229E
tggttaccaagagttaagtc

SEQ ID NO: 46993 - DNA, 20 bp, Human coronavirus 229E
ggttaccaagagttaagtca

SEQ ID NO: 46994 - DNA, 20 bp, Human coronavirus 229E
tattgcgtgttctaagagtg

SEQ ID NO: 46995 - DNA, 20 bp, Human coronavirus 229E
cgtgttctaagagtgctaga

SEQ ID NO: 46996 - DNA, 20 bp, Human coronavirus 229E
taagagtgctagacttaaga

SEQ ID NO: 46997 - DNA, 20 bp, Human coronavirus 229E
agagattccctgttaacaca

SEQ ID NO: 46998 - DNA, 20 bp, Human coronavirus 229E
cctgttaacacaattgtcaa

SEQ ID NO: 46999 - DNA, 20 bp, Human coronavirus 229E
aggcctgtctattagtgatc

SEQ ID NO: 47000 - DNA, 20 bp, Human coronavirus 229E
ggcctgtctattagtgatca

SEQ ID NO: 47001 - DNA, 20 bp, Human coronavirus 229E
gtgatcatgaatttactagt

SEQ ID NO: 47002 - DNA, 20 bp, Human coronavirus 229E
actagtgctatttctaatgc

SEQ ID NO: 47003 - DNA, 20 bp, Human coronavirus 229E
ctagtgctatttctaatgca

SEQ ID NO: 47004 - DNA, 20 bp, Human coronavirus 229E
gactttcttgttgacaatta

SEQ ID NO: 47005 - DNA, 20 bp, Human coronavirus 229E
actttcttgttgacaattaa

SEQ ID NO: 47006 - DNA, 20 bp, Human coronavirus 229E
cttgttgacaattaatgaaa

SEQ ID NO: 47007 - DNA, 20 bp, Human coronavirus 229E
ttgttgacaattaatgaaaa

SEQ ID NO: 47008 - DNA, 20 bp, Human coronavirus 229E
ttgacaattaatgaaaacca

SEQ ID NO: 47009 - DNA, 20 bp, Human coronavirus 229E
tagttggagtttctgaaatt

SEQ ID NO: 47010 - DNA, 20 bp, Human coronavirus 229E
gagtttctgaaattgttaat

SEQ ID NO: 47011 - DNA, 20 bp, Human coronavirus 229E
ctgaaattgttaatactgtc

SEQ ID NO: 47012 - DNA, 20 bp, Human coronavirus 229E
tgaaattgttaatactgtcg

SEQ ID NO: 47013 - DNA, 20 bp, Human coronavirus 229E
ttaatactgtcgctggcatt

SEQ ID NO: 47014 - DNA, 20 bp, Human coronavirus 229E
ccaccaaatactgccgcgta

SEQ ID NO: 47015 - DNA, 20 bp, Human coronavirus 229E
aatccaatgcaggtgtgtgt

SEQ ID NO: 47016 - DNA, 20 bp, Human coronavirus 229E
tggctttgacaagtggtttg

SEQ ID NO: 47017 - DNA, 20 bp, Human coronavirus 229E
ggctttgacaagtggtttgt

SEQ ID NO: 47018 - DNA, 20 bp, Human coronavirus 229E
gctttgacaagtggtttgtt

SEQ ID NO: 47019 - DNA, 20 bp, Human coronavirus 229E
cgctatgcatggatttggtg

SEQ ID NO: 47020 - DNA, 20 bp, Human coronavirus 229E
ggtgtgctgcatatttaatt

SEQ ID NO: 47021 - DNA, 20 bp, Human coronavirus 229E
gtgtgctgcatatttaattg

SEQ ID NO: 47022 - DNA, 20 bp, Human coronavirus 229E
aattgcgtatatttcttttg

SEQ ID NO: 47023 - DNA, 20 bp, Human coronavirus 229E
attgcgtatatttcttttgc

SEQ ID NO: 47024 - DNA, 20 bp, Human coronavirus 229E
tacacacctccgactgtcag

SEQ ID NO: 47025 - DNA, 20 bp, Human coronavirus 229E
tggttctacattacaggctg

SEQ ID NO: 47026 - DNA, 20 bp, Human coronavirus 229E
tacattacaggctggtttgc

SEQ ID NO: 47027 - DNA, 20 bp, Human coronavirus 229E
caggctggtttgcgcaaaat

SEQ ID NO: 47028 - DNA, 20 bp, Human coronavirus 229E
gcgcaaaatggcacaaccat

SEQ ID NO: 47029 - DNA, 20 bp, Human coronavirus 229E
aggtttcacagactaacatg

SEQ ID NO: 47030 - DNA, 20 bp, Human coronavirus 229E
cacagactaacatgcacaca

SEQ ID NO: 47031 - DNA, 20 bp, Human coronavirus 229E
acagactaacatgcacacac

SEQ ID NO: 47032 - DNA, 20 bp, Human coronavirus 229E
ttttagaacactaaaatctg

SEQ ID NO: 47033 - DNA, 20 bp, Human coronavirus 229E
tagaacactaaaatctggtg

SEQ ID NO: 47034 - DNA, 20 bp, Human coronavirus 229E
aagttgaatctgcaaaccag

SEQ ID NO: 47035 - DNA, 20 bp, Human coronavirus 229E
aatctgcaaaccagatgtta

SEQ ID NO: 47036 - DNA, 20 bp, Human coronavirus 229E
acagttaatgtggttgcatt

SEQ ID NO: 47037 - DNA, 20 bp, Human coronavirus 229E
atgtggttgcatttctttat

SEQ ID NO: 47038 - DNA, 20 bp, Human coronavirus 229E
catttctttatgctgctata

SEQ ID NO: 47039 - DNA, 20 bp, Human coronavirus 229E
tttgtcatgttctgggctga

SEQ ID NO: 47040 - DNA, 20 bp, Human coronavirus 229E
gtcatgttctgggctgaatt

SEQ ID NO: 47041 - DNA, 20 bp, Human coronavirus 229E
tcatgttctgggctgaatta

SEQ ID NO: 47042 - DNA, 20 bp, Human coronavirus 229E
tgggctgaattatttgttta

SEQ ID NO: 47043 - DNA, 20 bp, Human coronavirus 229E
tttgtttataccaccactat

SEQ ID NO: 47044 - DNA, 20 bp, Human coronavirus 229E
catacttggcgctttgctaa

SEQ ID NO: 47045 - DNA, 20 bp, Human coronavirus 229E
gcgctttgctaaagagcgtt

SEQ ID NO: 47046 - DNA, 20 bp, Human coronavirus 229E
gctaaagagcgttgtacaca

SEQ ID NO: 47047 - DNA, 20 bp, Human coronavirus 229E
ctaaagagcgttgtacacat

SEQ ID NO: 47048 - DNA, 20 bp, Human coronavirus 229E
tacacattggtgcacttatt

SEQ ID NO: 47049 - DNA, 20 bp, Human coronavirus 229E
tactggattaacaggttctg

SEQ ID NO: 47050 - DNA, 20 bp, Human coronavirus 229E
acaggttctgtaagtgcaca

SEQ ID NO: 47051 - DNA, 20 bp, Human coronavirus 229E
tgtaagtgcacattaggtgt

SEQ ID NO: 47052 - DNA, 20 bp, Human coronavirus 229E
ggtgtttatgatttctgtgt

SEQ ID NO: 47053 - DNA, 20 bp, Human coronavirus 229E
atgatttctgtgttagtcca

SEQ ID NO: 47054 - DNA, 20 bp, Human coronavirus 229E
tgtctaacatgaacatagct

SEQ ID NO: 47055 - DNA, 20 bp, Human coronavirus 229E
gtctaacatgaacatagctt

SEQ ID NO: 47056 - DNA, 20 bp, Human coronavirus 229E
tctaacatgaacatagcttc

SEQ ID NO: 47057 - DNA, 20 bp, Human coronavirus 229E
taattcaaaggagtgggcat

SEQ ID NO: 47058 - DNA, 20 bp, Human coronavirus 229E
aaaggagtgggcatattgtg

SEQ ID NO: 47059 - DNA, 20 bp, Human coronavirus 229E
caaaagctgagtttgacagg

SEQ ID NO: 47060 - DNA, 20 bp, Human coronavirus 229E
gacagggaatcatctgttca

SEQ ID NO: 47061 - DNA, 20 bp, Human coronavirus 229E
acagggaatcatctgttcaa

SEQ ID NO: 47062 - DNA, 20 bp, Human coronavirus 229E
aaaagaaaattaacagaatg

SEQ ID NO: 47063 - DNA, 20 bp, Human coronavirus 229E
acagaatggctgaacaagct

SEQ ID NO: 47064 - DNA, 20 bp, Human coronavirus 229E
tttggacattacaggaagtt

SEQ ID NO: 47065 - DNA, 20 bp, Human coronavirus 229E
ggacattacaggaagttaag

SEQ ID NO: 47066 - DNA, 20 bp, Human coronavirus 229E
gacattacaggaagttaagg

SEQ ID NO: 47067 - DNA, 20 bp, Human coronavirus 229E
caggaagttaaggataatga

SEQ ID NO: 47068 - DNA, 20 bp, Human coronavirus 229E
aggataatgatggtaagaat

SEQ ID NO: 47069 - DNA, 20 bp, Human coronavirus 229E
aatgggaacatgactctggt

SEQ ID NO: 47070 - DNA, 20 bp, Human coronavirus 229E
cagttgaattggaaccacct

SEQ ID NO: 47071 - DNA, 20 bp, Human coronavirus 229E
aattggaaccaccttgcaga

SEQ ID NO: 47072 - DNA, 20 bp, Human coronavirus 229E
gaaccaccttgcagatttgt

SEQ ID NO: 47073 - DNA, 20 bp, Human coronavirus 229E
cagatttgttatagacacac

SEQ ID NO: 47074 - DNA, 20 bp, Human coronavirus 229E
atgctgttaaacaaggcgca

SEQ ID NO: 47075 - DNA, 20 bp, Human coronavirus 229E
aacaaggcgcaaaacctgtt

SEQ ID NO: 47076 - DNA, 20 bp, Human coronavirus 229E
gcaattgtgtaaagatgttg

SEQ ID NO: 47077 - DNA, 20 bp, Human coronavirus 229E
tgtaaagatgttgactaatg

SEQ ID NO: 47078 - DNA, 20 bp, Human coronavirus 229E
actaatggttctggtagcgg

SEQ ID NO: 47079 - DNA, 20 bp, Human coronavirus 229E
tgataacagttatttaaacg

SEQ ID NO: 47080 - DNA, 20 bp, Human coronavirus 229E
gataacagttatttaaacga

SEQ ID NO: 47081 - DNA, 20 bp, Human coronavirus 229E
ataacagttatttaaacgag

SEQ ID NO: 47082 - DNA, 20 bp, Human coronavirus 229E
tttaaacgagtccggggctc

SEQ ID NO: 47083 - DNA, 20 bp, Human coronavirus 229E
aaacgagtccggggctctag

SEQ ID NO: 47084 - DNA, 20 bp, Human coronavirus 229E
ctaaatacaccatgatggat

SEQ ID NO: 47085 - DNA, 20 bp, Human coronavirus 229E
gtgcttcgctctgcgtaact

SEQ ID NO: 47086 - DNA, 20 bp, Human coronavirus 229E
tgcttcgctctgcgtaactt

SEQ ID NO: 47087 - DNA, 20 bp, Human coronavirus 229E
gctctgcgtaactttgatga

SEQ ID NO: 47088 - DNA, 20 bp, Human coronavirus 229E
gatgaaaaagactgtgaagt

SEQ ID NO: 47089 - DNA, 20 bp, Human coronavirus 229E
ggtgactttgtattgtgtcc

SEQ ID NO: 47090 - DNA, 20 bp, Human coronavirus 229E
gtattgtgtcctcctggaat

SEQ ID NO: 47091 - DNA, 20 bp, Human coronavirus 229E
tattgtgtcctcctggaatg

SEQ ID NO: 47092 - DNA, 20 bp, Human coronavirus 229E
tgtcctcctggaatgggaat

SEQ ID NO: 47093 - DNA, 20 bp, Human coronavirus 229E
ttatatgatgcctgttatgg

SEQ ID NO: 47094 - DNA, 20 bp, Human coronavirus 229E
caaacacggcttttggacct

SEQ ID NO: 47095 - DNA, 20 bp, Human coronavirus 229E
tggacctctatgcagaaaag

SEQ ID NO: 47096 - DNA, 20 bp, Human coronavirus 229E
ggacctctatgcagaaaagt

SEQ ID NO: 47097 - DNA, 20 bp, Human coronavirus 229E
gacctctatgcagaaaagtg

SEQ ID NO: 47098 - DNA, 20 bp, Human coronavirus 229E
attgatggtgtacccgtagt

SEQ ID NO: 47099 - DNA, 20 bp, Human coronavirus 229E
taataaggagttttatgact

SEQ ID NO: 47100 - DNA, 20 bp, Human coronavirus 229E
aataaggagttttatgactt

SEQ ID NO: 47101 - DNA, 20 bp, Human coronavirus 229E
ataaggagttttatgacttc

SEQ ID NO: 47102 - DNA, 20 bp, Human coronavirus 229E
tatgacttcttacgttctca

SEQ ID NO: 47103 - DNA, 20 bp, Human coronavirus 229E
atgacttcttacgttctcag

SEQ ID NO: 47104 - DNA, 20 bp, Human coronavirus 229E
attagctactatgactacaa

SEQ ID NO: 47105 - DNA, 20 bp, Human coronavirus 229E
ttagctactatgactacaag

SEQ ID NO: 47106 - DNA, 20 bp, Human coronavirus 229E
gctactatgactacaagaca

SEQ ID NO: 47107 - DNA, 20 bp, Human coronavirus 229E
catcagaaatgtctgaaatc

SEQ ID NO: 47108 - DNA, 20 bp, Human coronavirus 229E
atcagaaatgtctgaaatcc

SEQ ID NO: 47109 - DNA, 20 bp, Human coronavirus 229E
tttctgatgatagtgttgtg

SEQ ID NO: 47110 - DNA, 20 bp, Human coronavirus 229E
ctgatgatagtgttgtgtgc

SEQ ID NO: 47111 - DNA, 20 bp, Human coronavirus 229E
tgatgatagtgttgtgtgct

SEQ ID NO: 47112 - DNA, 20 bp, Human coronavirus 229E
tgtgctataataaaacttat

SEQ ID NO: 47113 - DNA, 20 bp, Human coronavirus 229E
tgctggacttggttacattg

SEQ ID NO: 47114 - DNA, 20 bp, Human coronavirus 229E
ttttggaacgctatgtttct

SEQ ID NO: 47115 - DNA, 20 bp, Human coronavirus 229E
tggaacgctatgtttctctg

SEQ ID NO: 47116 - DNA, 20 bp, Human coronavirus 229E
ggaacgctatgtttctctgg

SEQ ID NO: 47117 - DNA, 20 bp, Human coronavirus 229E
gaacgctatgtttctctggc

SEQ ID NO: 47118 - DNA, 20 bp, Human coronavirus 229E
ctctggctatagatgcctac

SEQ ID NO: 47119 - DNA, 20 bp, Human coronavirus 229E
attcccactgtgttcagctg

SEQ ID NO: 47120 - DNA, 20 bp, Human coronavirus 229E
ccactgtgttcagctggtaa

SEQ ID NO: 47121 - DNA, 20 bp, Human coronavirus 229E
agctggtaatgtctttggtt

SEQ ID NO: 47122 - DNA, 20 bp, Human coronavirus 229E
ggtttgtacaaaagttctgc

SEQ ID NO: 47123 - DNA, 20 bp, Human coronavirus 229E
gtttgtacaaaagttctgct

SEQ ID NO: 47124 - DNA, 20 bp, Human coronavirus 229E
caagttggtgagtttgtgtt

SEQ ID NO: 47125 - DNA, 20 bp, Human coronavirus 229E
aagttggtgagtttgtgttt

SEQ ID NO: 47126 - DNA, 20 bp, Human coronavirus 229E
gtgagtttgtgtttgagaaa

SEQ ID NO: 47127 - DNA, 20 bp, Human coronavirus 229E
gtgtttgagaaagtagatta

SEQ ID NO: 47128 - DNA, 20 bp, Human coronavirus 229E
tgtttgagaaagtagattac

SEQ ID NO: 47129 - DNA, 20 bp, Human coronavirus 229E
ttctattggtattggtgtgt

SEQ ID NO: 47130 - DNA, 20 bp, Human coronavirus 229E
tattggtattggtgtgtatt

SEQ ID NO: 47131 - DNA, 20 bp, Human coronavirus 229E
gtattggtgtgtattaccct

SEQ ID NO: 47132 - DNA, 20 bp, Human coronavirus 229E
gtgtgtattaccctggagcg

SEQ ID NO: 47133 - DNA, 20 bp, Human coronavirus 229E
ccctggagcgaggatcgtgt

SEQ ID NO: 47134 - DNA, 20 bp, Human coronavirus 229E
tctgtgattaaccagcgtat

SEQ ID NO: 47135 - DNA, 20 bp, Human coronavirus 229E
accagcgtatatcatataaa

SEQ ID NO: 47136 - DNA, 20 bp, Human coronavirus 229E
tatatgttggtgatcctcaa

SEQ ID NO: 47137 - DNA, 20 bp, Human coronavirus 229E
gtgatcctcaacagcttcca

SEQ ID NO: 47138 - DNA, 20 bp, Human coronavirus 229E
cagctcctagagttcttatc

SEQ ID NO: 47139 - DNA, 20 bp, Human coronavirus 229E
atctcaccttacaatagtca

SEQ ID NO: 47140 - DNA, 20 bp, Human coronavirus 229E
tctcaccttacaatagtcaa

SEQ ID NO: 47141 - DNA, 20 bp, Human coronavirus 229E
caatagtcaaaattatgtag

SEQ ID NO: 47142 - DNA, 20 bp, Human coronavirus 229E
tgtagctgccaggcttttag

SEQ ID NO: 47143 - DNA, 20 bp, Human coronavirus 229E
taggcttacaaactcagaca

SEQ ID NO: 47144 - DNA, 20 bp, Human coronavirus 229E
atttaccaccaagtcatgcc

SEQ ID NO: 47145 - DNA, 20 bp, Human coronavirus 229E
accaccaagtcatgccacta

SEQ ID NO: 47146 - DNA, 20 bp, Human coronavirus 229E
ccaccaagtcatgccactac

SEQ ID NO: 47147 - DNA, 20 bp, Human coronavirus 229E
tttgtcattgtctgatagat

SEQ ID NO: 47148 - DNA, 20 bp, Human coronavirus 229E
gtcattgtctgatagattta

SEQ ID NO: 47149 - DNA, 20 bp, Human coronavirus 229E
ggaatggatgtggaaggtgc

SEQ ID NO: 47150 - DNA, 20 bp, Human coronavirus 229E
gcactaatgtacctctacaa

SEQ ID NO: 47151 - DNA, 20 bp, Human coronavirus 229E
gtttttccaatggtgttgat

SEQ ID NO: 47152 - DNA, 20 bp, Human coronavirus 229E
ttccaatggtgttgattttg

SEQ ID NO: 47153 - DNA, 20 bp, Human coronavirus 229E
tccaatggtgttgattttgt

SEQ ID NO: 47154 - DNA, 20 bp, Human coronavirus 229E
agagttgaccactatgcgtt

SEQ ID NO: 47155 - DNA, 20 bp, Human coronavirus 229E
gagttgaccactatgcgtta

SEQ ID NO: 47156 - DNA, 20 bp, Human coronavirus 229E
accactatgcgttattttgt

SEQ ID NO: 47157 - DNA, 20 bp, Human coronavirus 229E
ttttgttaagattggagctg

SEQ ID NO: 47158 - DNA, 20 bp, Human coronavirus 229E
tgttaagattggagctgtta

SEQ ID NO: 47159 - DNA, 20 bp, Human coronavirus 229E
gtcaattacctaccctatga

SEQ ID NO: 47160 - DNA, 20 bp, Human coronavirus 229E
cctaccctatgatagctaat

SEQ ID NO: 47161 - DNA, 20 bp, Human coronavirus 229E
tgcgtgctgctattaaattg

SEQ ID NO: 47162 - DNA, 20 bp, Human coronavirus 229E
aatagcagcacgcataatat

SEQ ID NO: 47163 - DNA, 20 bp, Human coronavirus 229E
atagcagcacgcataatatg

SEQ ID NO: 47164 - DNA, 20 bp, Human coronavirus 229E
gacacacgtacacgatctac

SEQ ID NO: 47165 - DNA, 20 bp, Human coronavirus 229E
acacacgtacacgatctaca

SEQ ID NO: 47166 - DNA, 20 bp, Human coronavirus 229E
aaccttgaaggtgtaaatgg

SEQ ID NO: 47167 - DNA, 20 bp, Human coronavirus 229E
aaggtgtaaatggtgggtca

SEQ ID NO: 47168 - DNA, 20 bp, Human coronavirus 229E
tatgtcaataatcatgcatt

SEQ ID NO: 47169 - DNA, 20 bp, Human coronavirus 229E
taatatttgggttcctacca

SEQ ID NO: 47170 - DNA, 20 bp, Human coronavirus 229E
aatatttgggttcctaccac

SEQ ID NO: 47171 - DNA, 20 bp, Human coronavirus 229E
atatttgggttcctaccacg

SEQ ID NO: 47172 - DNA, 20 bp, Human coronavirus 229E
gggttcctaccacgtttgat

SEQ ID NO: 47173 - DNA, 20 bp, Human coronavirus 229E
ggttcctaccacgtttgatt

SEQ ID NO: 47174 - DNA, 20 bp, Human coronavirus 229E
gtcttgtgggattatgaagc

SEQ ID NO: 47175 - DNA, 20 bp, Human coronavirus 229E
tcttgtgggattatgaagct

SEQ ID NO: 47176 - DNA, 20 bp, Human coronavirus 229E
tgggattatgaagctgagcg

SEQ ID NO: 47177 - DNA, 20 bp, Human coronavirus 229E
tgaagctgagcgtcccttga

SEQ ID NO: 47178 - DNA, 20 bp, Human coronavirus 229E
acaagctttactaagtctgt

SEQ ID NO: 47179 - DNA, 20 bp, Human coronavirus 229E
atcattatgatggtttttat

SEQ ID NO: 47180 - DNA, 20 bp, Human coronavirus 229E
tgatggtttttatacccaag

SEQ ID NO: 47181 - DNA, 20 bp, Human coronavirus 229E
ttatacccaaggtcgtaatt

SEQ ID NO: 47182 - DNA, 20 bp, Human coronavirus 229E
tatacccaaggtcgtaattt

SEQ ID NO: 47183 - DNA, 20 bp, Human coronavirus 229E
atacccaaggtcgtaattta

SEQ ID NO: 47184 - DNA, 20 bp, Human coronavirus 229E
tacttacatggatttgttgt

SEQ ID NO: 47185 - DNA, 20 bp, Human coronavirus 229E
catggatttgttgttggatg

SEQ ID NO: 47186 - DNA, 20 bp, Human coronavirus 229E
gttgttggatgattttgttt

SEQ ID NO: 47187 - DNA, 20 bp, Human coronavirus 229E
ttgttggatgattttgtttc

SEQ ID NO: 47188 - DNA, 20 bp, Human coronavirus 229E
ttggatgattttgtttctgt

SEQ ID NO: 47189 - DNA, 20 bp, Human coronavirus 229E
tgtgttcctcataatatgag

SEQ ID NO: 47190 - DNA, 20 bp, Human coronavirus 229E
ctcataatatgagagtgtta

SEQ ID NO: 47191 - DNA, 20 bp, Human coronavirus 229E
cacttgggtgctggctctga

SEQ ID NO: 47192 - DNA, 20 bp, Human coronavirus 229E
ggtgctggctctgattatgg

SEQ ID NO: 47193 - DNA, 20 bp, Human coronavirus 229E
tggtgttgcaccaggaactg

SEQ ID NO: 47194 - DNA, 20 bp, Human coronavirus 229E
gtgatttcgcacaaggacct

SEQ ID NO: 47195 - DNA, 20 bp, Human coronavirus 229E
cgcacaaggaccttttatag

SEQ ID NO: 47196 - DNA, 20 bp, Human coronavirus 229E
gcacaaggaccttttataga

SEQ ID NO: 47197 - DNA, 20 bp, Human coronavirus 229E
tatagatggtaacataatac

SEQ ID NO: 47198 - DNA, 20 bp, Human coronavirus 229E
atagatggtaacataataca

SEQ ID NO: 47199 - DNA, 20 bp, Human coronavirus 229E
tcaaactacaaatgggctga

SEQ ID NO: 47200 - DNA, 20 bp, Human coronavirus 229E
ctctgtttgcaacggctgtg

SEQ ID NO: 47201 - DNA, 20 bp, Human coronavirus 229E
gcaacggctgtgttggttat

SEQ ID NO: 47202 - DNA, 20 bp, Human coronavirus 229E
caacggctgtgttggttatt

SEQ ID NO: 47203 - DNA, 20 bp, Human coronavirus 229E
gttattcagaaaatgtattt

SEQ ID NO: 47204 - DNA, 20 bp, Human coronavirus 229E
gtacagttttgggcaatttt

SEQ ID NO: 47205 - DNA, 20 bp, Human coronavirus 229E
tgggcaatttttattgcttt

SEQ ID NO: 47206 - DNA, 20 bp, Human coronavirus 229E
gggcaatttttattgctttg

SEQ ID NO: 47207 - DNA, 20 bp, Human coronavirus 229E
ggcaatttttattgctttgt

SEQ ID NO: 47208 - DNA, 20 bp, Human coronavirus 229E
ttattgctttgtaaatacta

SEQ ID NO: 47209 - DNA, 20 bp, Human coronavirus 229E
aatccgttgagctacctgtg

SEQ ID NO: 47210 - DNA, 20 bp, Human coronavirus 229E
agctacctgtgtctattgtg

SEQ ID NO: 47211 - DNA, 20 bp, Human coronavirus 229E
tgtcgctacctgtttatcat

SEQ ID NO: 47212 - DNA, 20 bp, Human coronavirus 229E
atcataaacatacgtttatt

SEQ ID NO: 47213 - DNA, 20 bp, Human coronavirus 229E
tcataaacatacgtttattg

SEQ ID NO: 47214 - DNA, 20 bp, Human coronavirus 229E
ttcgcgttagcaatgacacc

SEQ ID NO: 47215 - DNA, 20 bp, Human coronavirus 229E
gcgttagcaatgacaccttt

SEQ ID NO: 47216 - DNA, 20 bp, Human coronavirus 229E
gcaatgacacctttcttaat

SEQ ID NO: 47217 - DNA, 20 bp, Human coronavirus 229E
cttaatggaattacgtacac

SEQ ID NO: 47218 - DNA, 20 bp, Human coronavirus 229E
ttaatggaattacgtacaca

SEQ ID NO: 47219 - DNA, 20 bp, Human coronavirus 229E
gtgcagatggttctataatt

SEQ ID NO: 47220 - DNA, 20 bp, Human coronavirus 229E
tgcagatggttctataattg

SEQ ID NO: 47221 - DNA, 20 bp, Human coronavirus 229E
tataattgctgttcaaccac

SEQ ID NO: 47222 - DNA, 20 bp, Human coronavirus 229E
ctgttcaaccacgtaatgtt

SEQ ID NO: 47223 - DNA, 20 bp, Human coronavirus 229E
aaccacgtaatgtttcatat

SEQ ID NO: 47224 - DNA, 20 bp, Human coronavirus 229E
tgacaagaaagcgtttacac

SEQ ID NO: 47225 - DNA, 20 bp, Human coronavirus 229E
gacaagaaagcgtttacact

SEQ ID NO: 47226 - DNA, 20 bp, Human coronavirus 229E
acaagaaagcgtttacactt

SEQ ID NO: 47227 - DNA, 20 bp, Human coronavirus 229E
acacttgctaatgttagtag

SEQ ID NO: 47228 - DNA, 20 bp, Human coronavirus 229E
cacttgctaatgttagtagt

SEQ ID NO: 47229 - DNA, 20 bp, Human coronavirus 229E
aggaggtctaacatcagccg

SEQ ID NO: 47230 - DNA, 20 bp, Human coronavirus 229E
ggaggtctaacatcagccgt

SEQ ID NO: 47231 - DNA, 20 bp, Human coronavirus 229E
caataccattttcattagca

SEQ ID NO: 47232 - DNA, 20 bp, Human coronavirus 229E
aataccattttcattagcaa

SEQ ID NO: 47233 - DNA, 20 bp, Human coronavirus 229E
tcattagcaattcaggcacg

SEQ ID NO: 47234 - DNA, 20 bp, Human coronavirus 229E
aggctgatcaacaagtagat

SEQ ID NO: 47235 - DNA, 20 bp, Human coronavirus 229E
ctggtagattggctgctttg

SEQ ID NO: 47236 - DNA, 20 bp, Human coronavirus 229E
gctgctttgaatgtattcgt

SEQ ID NO: 47237 - DNA, 20 bp, Human coronavirus 229E
gaatgtattcgtttctcata

SEQ ID NO: 47238 - DNA, 20 bp, Human coronavirus 229E
aatgtattcgtttctcatac

SEQ ID NO: 47239 - DNA, 20 bp, Human coronavirus 229E
tgtgttgcgacaacctaatc

SEQ ID NO: 47240 - DNA, 20 bp, Human coronavirus 229E
cgacaacctaatcttgctct

SEQ ID NO: 47241 - DNA, 20 bp, Human coronavirus 229E
ctctttacaaagaaggcaat

SEQ ID NO: 47242 - DNA, 20 bp, Human coronavirus 229E
acaaagaaggcaattattat

SEQ ID NO: 47243 - DNA, 20 bp, Human coronavirus 229E
caaagaaggcaattattata

SEQ ID NO: 47244 - DNA, 20 bp, Human coronavirus 229E
cagacctagttgtcgaacag

SEQ ID NO: 47245 - DNA, 20 bp, Human coronavirus 229E
tcgaacagtacaaccagact

SEQ ID NO: 47246 - DNA, 20 bp, Human coronavirus 229E
tgaatttgaccagtgaaatt

SEQ ID NO: 47247 - DNA, 20 bp, Human coronavirus 229E
gaatttgaccagtgaaatta

SEQ ID NO: 47248 - DNA, 20 bp, Human coronavirus 229E
aatttgaccagtgaaattag

SEQ ID NO: 47249 - DNA, 20 bp, Human coronavirus 229E
catcttctattagaggttgt

SEQ ID NO: 47250 - DNA, 20 bp, Human coronavirus 229E
tattagaggttgttgtgaat

SEQ ID NO: 47251 - DNA, 20 bp, Human coronavirus 229E
gaggttgttgtgaatcaact

SEQ ID NO: 47252 - DNA, 20 bp, Human coronavirus 229E
ttgtgaatcaactaaacttc

SEQ ID NO: 47253 - DNA, 20 bp, Human coronavirus 229E
tgaatcaactaaacttcctt

SEQ ID NO: 47254 - DNA, 20 bp, Human coronavirus 229E
ctgtattggtctcaagcata

SEQ ID NO: 47255 - DNA, 20 bp, Human coronavirus 229E
gtctcaagcatatatttacg

SEQ ID NO: 47256 - DNA, 20 bp, Human coronavirus 229E
acgcaactttgattgctgta

SEQ ID NO: 47257 - DNA, 20 bp, Human coronavirus 229E
cgcaactttgattgctgtaa

SEQ ID NO: 47258 - DNA, 20 bp, Human coronavirus 229E
gattgctgtaattttgcttg

SEQ ID NO: 47259 - DNA, 20 bp, Human coronavirus 229E
ggttgttaatgtactactct

SEQ ID NO: 47260 - DNA, 20 bp, Human coronavirus 229E
gttgttaatgtactactctg

SEQ ID NO: 47261 - DNA, 20 bp, Human coronavirus 229E
ttaatgtactactctggtgt

SEQ ID NO: 47262 - DNA, 20 bp, Human coronavirus 229E
atgtactactctggtgtgtg

SEQ ID NO: 47263 - DNA, 20 bp, Human coronavirus 229E
tagtgatactactagtgtgt

SEQ ID NO: 47264 - DNA, 20 bp, Human coronavirus 229E
tttggccactcgtacttgct

SEQ ID NO: 47265 - DNA, 20 bp, Human coronavirus 229E
ggccactcgtacttgctttg

SEQ ID NO: 47266 - DNA, 20 bp, Human coronavirus 229E
gccactcgtacttgctttgt

SEQ ID NO: 47267 - DNA, 20 bp, Human coronavirus 229E
ctttgtcaatctttgacacc

SEQ ID NO: 47268 - DNA, 20 bp, Human coronavirus 229E
gtcaatctttgacacctggg

SEQ ID NO: 47269 - DNA, 20 bp, Human coronavirus 229E
acaaaatagcacaggctggg

SEQ ID NO: 47270 - DNA, 20 bp, Human coronavirus 229E
tctacgtacgagtaaaacac

SEQ ID NO: 47271 - DNA, 20 bp, Human coronavirus 229E
ctacgtacgagtaaaacacg

SEQ ID NO: 47272 - DNA, 20 bp, Human coronavirus 229E
tacgtacgagtaaaacacgg

SEQ ID NO: 47273 - DNA, 20 bp, Human coronavirus 229E
ttctgcagtgagctctccca

SEQ ID NO: 47274 - DNA, 20 bp, Human coronavirus 229E
taggctattggaatgttcaa

SEQ ID NO: 47275 - DNA, 20 bp, Human coronavirus 229E
gaatgttcaaaaacgtttca

SEQ ID NO: 47276 - DNA, 20 bp, Human coronavirus 229E
aaaaacgtttcagaactaga

SEQ ID NO: 47277 - DNA, 20 bp, Human coronavirus 229E
cagaactagaaagggcaaac

SEQ ID NO: 47278 - DNA, 20 bp, Human coronavirus 229E
agaactagaaagggcaaacg

SEQ ID NO: 47279 - DNA, 20 bp, Human coronavirus 229E
ctgcggctcttaaatcttta

SEQ ID NO: 47280 - DNA, 20 bp, Human coronavirus 229E
aatctttaggttttgacaag

SEQ ID NO: 47281 - DNA, 20 bp, Human coronavirus 229E
aggttttgacaagcctcagg

SEQ ID NO: 47282 - DNA, 20 bp, Human coronavirus 229E
ggttttgacaagcctcagga

SEQ ID NO: 47283 - DNA, 20 bp, Human coronavirus 229E
tgacaagcctcaggaaaaag

SEQ ID NO: 47284 - DNA, 20 bp, Human coronavirus 229E
tggccccagagaccttgacc

SEQ ID NO: 47285 - DNA, 20 bp, Human coronavirus 229E
ggccccagagaccttgacca

SEQ ID NO: 47286 - DNA, 20 bp, Human coronavirus 229E
gccccagagaccttgaccac

SEQ ID NO: 47287 - DNA, 20 bp, Human coronavirus 229E
accacaactttggaagtgca

SEQ ID NO: 47288 - DNA, 20 bp, Human coronavirus 229E
ggaagtgcaggtgttgtggc

SEQ ID NO: 47289 - DNA, 20 bp, Human coronavirus 229E
ttaaccctagtgcactagaa

SEQ ID NO: 47290 - DNA, 20 bp, Human coronavirus 229E
accctagtgcactagaattc

SEQ ID NO: 47291 - DNA, 20 bp, Human coronavirus 229E
aacccatctcaaacttcacc

SEQ ID NO: 47292 - DNA, 20 bp, Human coronavirus 229E
acctgcaactgctgaaccag

SEQ ID NO: 47293 - DNA, 20 bp, Human coronavirus 229E
ctattgaaactgacataatt

SEQ ID NO: 47294 - DNA, 20 bp, Human coronavirus 229E
ctttggcttgacaaggatct

SEQ ID NO: 47295 - DNA, 20 bp, Human coronavirus 229E
ggcttgacaaggatctagtc

SEQ ID NO: 47296 - DNA, 20 bp, Human coronavirus 229E
gcttgacaaggatctagtct

SEQ ID NO: 47297 - DNA, 20 bp, Human coronavirus 229E
acaaggatctagtcttatac

SEQ ID NO: 47298 - DNA, 20 bp, Human coronavirus 229E
tacacaatggtaagccagtg

SEQ ID NO: 47299 - DNA, 20 bp, Human papillomavirus type 108
attgtgactcattgcatgtc

SEQ ID NO: 47300 - DNA, 20 bp, Human papillomavirus type 108
ttgtgactcattgcatgtcc

SEQ ID NO: 47301 - DNA, 20 bp, Human papillomavirus type 108
tgactcattgcatgtccatt

SEQ ID NO: 47302 - DNA, 20 bp, Human papillomavirus type 108
catgtccatttgccacacct

SEQ ID NO: 47303 - DNA, 20 bp, Human papillomavirus type 108
gccacacctggcttttagta

SEQ ID NO: 47304 - DNA, 20 bp, Human papillomavirus type 108
gaagcattatttgaagaaag

SEQ ID NO: 47305 - DNA, 20 bp, Human papillomavirus type 108
tttgaagaaagcgatgggac

SEQ ID NO: 47306 - DNA, 20 bp, Human papillomavirus type 108
gaagaaagcgatgggacaga

SEQ ID NO: 47307 - DNA, 20 bp, Human papillomavirus type 108
aagaaagcgatgggacagat

SEQ ID NO: 47308 - DNA, 20 bp, Human papillomavirus type 108
ctgatttaattaataacatt

SEQ ID NO: 47309 - DNA, 20 bp, Human papillomavirus type 108
ggacatgaagctgaagattc

SEQ ID NO: 47310 - DNA, 20 bp, Human papillomavirus type 108
taatgaaagggtggaaaagg

SEQ ID NO: 47311 - DNA, 20 bp, Human papillomavirus type 108
tgcgttgcactcacagactg

SEQ ID NO: 47312 - DNA, 20 bp, Human papillomavirus type 108
gcgttgcactcacagactgc

SEQ ID NO: 47313 - DNA, 20 bp, Human papillomavirus type 108
cgttgcactcacagactgct

SEQ ID NO: 47314 - DNA, 20 bp, Human papillomavirus type 108
cagtagcattatttttctat

SEQ ID NO: 47315 - DNA, 20 bp, Human papillomavirus type 108
tttttctatagacatagctt

SEQ ID NO: 47316 - DNA, 20 bp, Human papillomavirus type 108
ttctatagacatagcttatc

SEQ ID NO: 47317 - DNA, 20 bp, Human papillomavirus type 108
tctatagacatagcttatca

SEQ ID NO: 47318 - DNA, 20 bp, Human papillomavirus type 108
ctatagacatagcttatcaa

SEQ ID NO: 47319 - DNA, 20 bp, Human papillomavirus type 108
cccatcaacagtttccccac

SEQ ID NO: 47320 - DNA, 20 bp, Human papillomavirus type 108
ccccacacttttttatccat

SEQ ID NO: 47321 - DNA, 20 bp, Human papillomavirus type 108
cccacacttttttatccatt

SEQ ID NO: 47322 - DNA, 20 bp, Human papillomavirus type 108
tttatccattgtcctataga

SEQ ID NO: 47323 - DNA, 20 bp, Human papillomavirus type 108
ttatccattgtcctatagac

SEQ ID NO: 47324 - DNA, 20 bp, Human papillomavirus type 108
aaaaaaggtggtgcacaagt

SEQ ID NO: 47325 - DNA, 20 bp, Human papillomavirus type 108
aaaaaggtggtgcacaagtg

SEQ ID NO: 47326 - DNA, 20 bp, Human papillomavirus type 108
ccactttgtatatggcatgg

SEQ ID NO: 47327 - DNA, 20 bp, Human papillomavirus type 108
cactttgtatatggcatggc

SEQ ID NO: 47328 - DNA, 20 bp, Human papillomavirus type 108
gtatatggcatggctttatt

SEQ ID NO: 47329 - DNA, 20 bp, Human papillomavirus type 108
tgacacttctgcatcagtgg

SEQ ID NO: 47330 - DNA, 20 bp, Human papillomavirus type 108
tgcatcagtgggatcaagac

SEQ ID NO: 47331 - DNA, 20 bp, Human papillomavirus type 108
caaggttacaagctgaggct

SEQ ID NO: 47332 - DNA, 20 bp, Human papillomavirus type 108
caagctgaggctagggatcc

SEQ ID NO: 47333 - DNA, 20 bp, Human papillomavirus type 108
ctattaatatggggggatcc

SEQ ID NO: 47334 - DNA, 20 bp, Human papillomavirus type 108
gctgataaaattttaaaatg

SEQ ID NO: 47335 - DNA, 20 bp, Human papillomavirus type 108
taaaatggattgccagtgtg

SEQ ID NO: 47336 - DNA, 20 bp, Human papillomavirus type 108
aaaatggattgccagtgtgg

SEQ ID NO: 47337 - DNA, 20 bp, Human papillomavirus type 108
aaatggattgccagtgtggt

SEQ ID NO: 47338 - DNA, 20 bp, Human papillomavirus type 108
ccagtgtggtgtactttggg

SEQ ID NO: 47339 - DNA, 20 bp, Human papillomavirus type 108
atcccattggcccccctgac

SEQ ID NO: 47340 - DNA, 20 bp, Human papillomavirus type 108
gcccccctgacattgttcct

SEQ ID NO: 47341 - DNA, 20 bp, Human papillomavirus type 108
ttcctgtagatgtggtaacc

SEQ ID NO: 47342 - DNA, 20 bp, Human papillomavirus type 108
ctgtagatgtggtaaccccc

SEQ ID NO: 47343 - DNA, 20 bp, Human papillomavirus type 108
cattgttcccctggaggtac

SEQ ID NO: 47344 - DNA, 20 bp, Human papillomavirus type 108
aatagtagtagacatgccac

SEQ ID NO: 47345 - DNA, 20 bp, Human papillomavirus type 108
ctgtgtatggtcatcctaca

SEQ ID NO: 47346 - DNA, 20 bp, Human papillomavirus type 108
tgtgtatggtcatcctacag

SEQ ID NO: 47347 - DNA, 20 bp, Human papillomavirus type 108
ttattggtgcagctgccacc

SEQ ID NO: 47348 - DNA, 20 bp, Human papillomavirus type 108
ttggtgcagctgccaccgat

SEQ ID NO: 47349 - DNA, 20 bp, Human papillomavirus type 108
gaactagaaatgtaaacttc

SEQ ID NO: 47350 - DNA, 20 bp, Human papillomavirus type 108
ttaaaccgcccacgtcaggc

SEQ ID NO: 47351 - DNA, 20 bp, Human papillomavirus type 108
aaccgcccacgtcaggcggt

SEQ ID NO: 47352 - DNA, 20 bp, Human papillomavirus type 108
caatttgaaaatcccgcctt

SEQ ID NO: 47353 - DNA, 20 bp, Human papillomavirus type 108
aatttgaaaatcccgccttt

SEQ ID NO: 47354 - DNA, 20 bp, Human papillomavirus type 108
acctcgtcccgcctacgctt

SEQ ID NO: 47355 - DNA, 20 bp, Human papillomavirus type 108
cctcgtcccgcctacgcttt

SEQ ID NO: 47356 - DNA, 20 bp, Human papillomavirus type 108
gcaggccttcagggtgtttc

SEQ ID NO: 47357 - DNA, 20 bp, Human papillomavirus type 108
caggccttcagggtgtttct

SEQ ID NO: 47358 - DNA, 20 bp, Human papillomavirus type 108
agggtgtttctatatctcct

SEQ ID NO: 47359 - DNA, 20 bp, Human papillomavirus type 108
tttaattgtttttcagatgt

SEQ ID NO: 47360 - DNA, 20 bp, Human papillomavirus type 108
aattgtttttcagatgtcac

SEQ ID NO: 47361 - DNA, 20 bp, Human papillomavirus type 108
attgtttttcagatgtcact

SEQ ID NO: 47362 - DNA, 20 bp, Human papillomavirus type 108
tttttcagatgtcactgtgg

SEQ ID NO: 47363 - DNA, 20 bp, Human papillomavirus type 108
ttcagatgtcactgtggtta

SEQ ID NO: 47364 - DNA, 20 bp, Human papillomavirus type 108
agggttttgcttccagatcc

SEQ ID NO: 47365 - DNA, 20 bp, Human papillomavirus type 108
gggttttgcttccagatcct

SEQ ID NO: 47366 - DNA, 20 bp, Human papillomavirus type 108
tgcttccagatcctaacaag

SEQ ID NO: 47367 - DNA, 20 bp, Human papillomavirus type 108
gcttccagatcctaacaagc

SEQ ID NO: 47368 - DNA, 20 bp, Human papillomavirus type 108
cttccagatcctaacaagct

SEQ ID NO: 47369 - DNA, 20 bp, Human papillomavirus type 108
atgcccgtcacttttttaca

SEQ ID NO: 47370 - DNA, 20 bp, Human papillomavirus type 108
tgcccgtcacttttttacac

SEQ ID NO: 47371 - DNA, 20 bp, Human papillomavirus type 108
tttacacgggatggcactat

SEQ ID NO: 47372 - DNA, 20 bp, Human papillomavirus type 108
ttacacgggatggcactatt

SEQ ID NO: 47373 - DNA, 20 bp, Human papillomavirus type 108
tacacgggatggcactattg

SEQ ID NO: 47374 - DNA, 20 bp, Human papillomavirus type 108
ttgatgattggcagttaggc

SEQ ID NO: 47375 - DNA, 20 bp, Human papillomavirus type 108
atgattggcagttaggcttt

SEQ ID NO: 47376 - DNA, 20 bp, Human papillomavirus type 108
gcagttaggctttgtacccc

SEQ ID NO: 47377 - DNA, 20 bp, Human papillomavirus type 108
ggctttgtaccccctcctgc

SEQ ID NO: 47378 - DNA, 20 bp, Human papillomavirus type 108
gtaccccctcctgcaccatc

SEQ ID NO: 47379 - DNA, 20 bp, Human gammaherpesvirus 4
ctgcgactcctgggcgccac

SEQ ID NO: 47380 - DNA, 20 bp, Human gammaherpesvirus 4
gcgtggagatgggcaggcag

SEQ ID NO: 47381 - DNA, 20 bp, Human gammaherpesvirus 4
ggcttcgaggtgcatagaag

SEQ ID NO: 47382 - DNA, 20 bp, Human gammaherpesvirus 4
gcttcgaggtgcatagaagc

SEQ ID NO: 47383 - DNA, 20 bp, Human gammaherpesvirus 4
gaggtgcatagaagccggcc

SEQ ID NO: 47384 - DNA, 20 bp, Human gammaherpesvirus 4
cgagttgccctggctctcgc

SEQ ID NO: 47385 - DNA, 20 bp, Human gammaherpesvirus 4
ccctggctctcgctggagtc

SEQ ID NO: 47386 - DNA, 20 bp, Human gammaherpesvirus 4
cttcccacggtggggtgtga

SEQ ID NO: 47387 - DNA, 20 bp, Human gammaherpesvirus 4
ccacggtggggtgtgacagg

SEQ ID NO: 47388 - DNA, 20 bp, Human gammaherpesvirus 4
tgaggcatgactccagcgag

SEQ ID NO: 47389 - DNA, 20 bp, Human gammaherpesvirus 4
gatccggaagacgtcttgct

SEQ ID NO: 47390 - DNA, 20 bp, Human gammaherpesvirus 4
cggatccaagattggggcac

SEQ ID NO: 47391 - DNA, 20 bp, Human gammaherpesvirus 4
gggcacatgctgcgttcagc

SEQ ID NO: 47392 - DNA, 20 bp, Human gammaherpesvirus 4
agcagcgcctcagccattgc

SEQ ID NO: 47393 - DNA, 20 bp, Human gammaherpesvirus 4
gcagagcaccccggcctggt

SEQ ID NO: 47394 - DNA, 20 bp, Human gammaherpesvirus 4
cagagcaccccggcctggtg

SEQ ID NO: 47395 - DNA, 20 bp, Human gammaherpesvirus 4
gaggtgcagcacggcccaga

SEQ ID NO: 47396 - DNA, 20 bp, Human gammaherpesvirus 4
aggtgcagcacggcccagag

SEQ ID NO: 47397 - DNA, 20 bp, Human gammaherpesvirus 4
cgccagtcgctgcgcctgct

SEQ ID NO: 47398 - DNA, 20 bp, Human gammaherpesvirus 4
ccagcagcaggcgcagcgac

SEQ ID NO: 47399 - DNA, 20 bp, Human gammaherpesvirus 4
gatctggaccttgctcgccc

SEQ ID NO: 47400 - DNA, 20 bp, Human gammaherpesvirus 4
ttgggtgcaaggctcgtgcc

SEQ ID NO: 47401 - DNA, 20 bp, Human gammaherpesvirus 4
ggtgcaaggctcgtgcctgg

SEQ ID NO: 47402 - DNA, 20 bp, Human gammaherpesvirus 4
gtaaattgcaggcccaggca

SEQ ID NO: 47403 - DNA, 20 bp, Human gammaherpesvirus 4
caggcccaggcacgagcctt

SEQ ID NO: 47404 - DNA, 20 bp, Human gammaherpesvirus 4
cacccaacaaggcaggacgc

SEQ ID NO: 47405 - DNA, 20 bp, Human gammaherpesvirus 4
tgtgacagggtttcctggac

SEQ ID NO: 47406 - DNA, 20 bp, Human gammaherpesvirus 4
cctggacacccagtcttagt

SEQ ID NO: 47407 - DNA, 20 bp, Human gammaherpesvirus 4
ctggacacccagtcttagtt

SEQ ID NO: 47408 - DNA, 20 bp, Human gammaherpesvirus 4
gttcaggtagacacccagtt

SEQ ID NO: 47409 - DNA, 20 bp, Human gammaherpesvirus 4
aggtagacacccagttatgc

SEQ ID NO: 47410 - DNA, 20 bp, Human gammaherpesvirus 4
ggcctggctccccatagact

SEQ ID NO: 47411 - DNA, 20 bp, Human gammaherpesvirus 4
tgcccccctggcggcccagc

SEQ ID NO: 47412 - DNA, 20 bp, Human gammaherpesvirus 4
gcccccctggcggcccagcc

SEQ ID NO: 47413 - DNA, 20 bp, Human gammaherpesvirus 4
cccccctggcggcccagccc

SEQ ID NO: 47414 - DNA, 20 bp, Human gammaherpesvirus 4
catgggagtctatggggagc

SEQ ID NO: 47415 - DNA, 20 bp, Human gammaherpesvirus 4
gcagaaaaaattaaagtcca

SEQ ID NO: 47416 - DNA, 20 bp, Human gammaherpesvirus 4
aagtccacttacctctggcc

SEQ ID NO: 47417 - DNA, 20 bp, Human gammaherpesvirus 4
cctctggcccgataccgggg

SEQ ID NO: 47418 - DNA, 20 bp, Human gammaherpesvirus 4
gtccagggccttcacttcgg

SEQ ID NO: 47419 - DNA, 20 bp, Human gammaherpesvirus 4
acttcggtctcccctaggct

SEQ ID NO: 47420 - DNA, 20 bp, Human gammaherpesvirus 4
ccacctcctcttcttgctgg

SEQ ID NO: 47421 - DNA, 20 bp, Human gammaherpesvirus 4
ttgctggacgaggacccttc

SEQ ID NO: 47422 - DNA, 20 bp, Human gammaherpesvirus 4
ctggacgaggacccttctac

SEQ ID NO: 47423 - DNA, 20 bp, Human gammaherpesvirus 4
tacggactcgtctgggttct

SEQ ID NO: 47424 - DNA, 20 bp, Human gammaherpesvirus 4
ttggccccctctggtaggac

SEQ ID NO: 47425 - DNA, 20 bp, Human gammaherpesvirus 4
gggccctcaagtccagcccc

SEQ ID NO: 47426 - DNA, 20 bp, Human gammaherpesvirus 4
ggccctcaagtccagcccca

SEQ ID NO: 47427 - DNA, 20 bp, Human gammaherpesvirus 4
agggcccaaagaggcccctc

SEQ ID NO: 47428 - DNA, 20 bp, Human gammaherpesvirus 4
tacggactcgtctgggttct

SEQ ID NO: 47429 - DNA, 20 bp, Human gammaherpesvirus 4
ttggccccctctggtaggac

SEQ ID NO: 47430 - DNA, 20 bp, Human gammaherpesvirus 4
gccccctctggtaggactgg

SEQ ID NO: 47431 - DNA, 20 bp, Human gammaherpesvirus 4
ttaggagctgtccgagggga

SEQ ID NO: 47432 - DNA, 20 bp, Human gammaherpesvirus 4
ggagctgtccgaggggaccc

SEQ ID NO: 47433 - DNA, 20 bp, Human gammaherpesvirus 4
gcgttgctaggccaccttct

SEQ ID NO: 47434 - DNA, 20 bp, Human gammaherpesvirus 4
ctaggccaccttctcagtcc

SEQ ID NO: 47435 - DNA, 20 bp, Human gammaherpesvirus 4
tcagtccagcgcgtttacgt

SEQ ID NO: 47436 - DNA, 20 bp, Human gammaherpesvirus 4
acgtaagccagacagcagcc

SEQ ID NO: 47437 - DNA, 20 bp, Human gammaherpesvirus 4
cgtaagccagacagcagcca

SEQ ID NO: 47438 - DNA, 20 bp, Human gammaherpesvirus 4
ttggccccctctggtaggac

SEQ ID NO: 47439 - DNA, 20 bp, Human gammaherpesvirus 4
gccccctctggtaggactgg

SEQ ID NO: 47440 - DNA, 20 bp, Human gammaherpesvirus 4
ttaggagctgtccgagggga

SEQ ID NO: 47441 - DNA, 20 bp, Human gammaherpesvirus 4
ggagctgtccgaggggaccc

SEQ ID NO: 47442 - DNA, 20 bp, Human gammaherpesvirus 4
gccagcaacttatagcatgg

SEQ ID NO: 47443 - DNA, 20 bp, Human gammaherpesvirus 4
ccagcaacttatagcatggt

SEQ ID NO: 47444 - DNA, 20 bp, Human gammaherpesvirus 4
tagcatggtaggcagctcaa

SEQ ID NO: 47445 - DNA, 20 bp, Human gammaherpesvirus 4
ctgcccagcctactctccac

SEQ ID NO: 47446 - DNA, 20 bp, Human gammaherpesvirus 4
agctgcctaccatgctataa

SEQ ID NO: 47447 - DNA, 20 bp, Human gammaherpesvirus 4
ggacttggataacttttcag

SEQ ID NO: 47448 - DNA, 20 bp, Human gammaherpesvirus 4
gataacttttcagaagctga

SEQ ID NO: 47449 - DNA, 20 bp, Human gammaherpesvirus 4
tcagaagctgagaccgaaga

SEQ ID NO: 47450 - DNA, 20 bp, Human gammaherpesvirus 4
cagaagctgagaccgaagac

SEQ ID NO: 47451 - DNA, 20 bp, Human gammaherpesvirus 4
agaagctgagaccgaagacg

SEQ ID NO: 47452 - DNA, 20 bp, Human gammaherpesvirus 4
tccgctgggccaggtcacag

SEQ ID NO: 47453 - DNA, 20 bp, Human gammaherpesvirus 4
gcccgtccctcttgtccctt

SEQ ID NO: 47454 - DNA, 20 bp, Human gammaherpesvirus 4
tccctttcagtggtcaccgg

SEQ ID NO: 47455 - DNA, 20 bp, Human gammaherpesvirus 4
gccatcaagaattatgtccc

SEQ ID NO: 47456 - DNA, 20 bp, Human gammaherpesvirus 4
ccatcaagaattatgtcccg

SEQ ID NO: 47457 - DNA, 20 bp, Human gammaherpesvirus 4
tgtcccgggcctggactcac

SEQ ID NO: 47458 - DNA, 20 bp, Human gammaherpesvirus 4
tcccgctgggcccagtctca

SEQ ID NO: 47459 - DNA, 20 bp, Human gammaherpesvirus 4
gtgagtccaggcccgggaca

SEQ ID NO: 47460 - DNA, 20 bp, Human gammaherpesvirus 4
gggagcttcccggagaccgg

SEQ ID NO: 47461 - DNA, 20 bp, Human gammaherpesvirus 4
ccggagaccggtctgggctc

SEQ ID NO: 47462 - DNA, 20 bp, Human gammaherpesvirus 4
cggccccgaaatagggcctt

SEQ ID NO: 47463 - DNA, 20 bp, Human gammaherpesvirus 4
ggccccgaaatagggccttg

SEQ ID NO: 47464 - DNA, 20 bp, Human gammaherpesvirus 4
atggcaaggccctatttcgg

SEQ ID NO: 47465 - DNA, 20 bp, Human gammaherpesvirus 4
gggggaaaccggagaacagc

SEQ ID NO: 47466 - DNA, 20 bp, Human gammaherpesvirus 4
cgtggattcgggggaagctg

SEQ ID NO: 47467 - DNA, 20 bp, Human gammaherpesvirus 4
gggggaagctggtatccaac

SEQ ID NO: 47468 - DNA, 20 bp, Human gammaherpesvirus 4
gataccagcttcccccgaat

SEQ ID NO: 47469 - DNA, 20 bp, Human gammaherpesvirus 4
ccccgaatccacgcaacgtc

SEQ ID NO: 47470 - DNA, 20 bp, Human gammaherpesvirus 4
agctggcgcgggtcggtgtg

SEQ ID NO: 47471 - DNA, 20 bp, Human gammaherpesvirus 4
gggcctcggctggctcccag

SEQ ID NO: 47472 - DNA, 20 bp, Human gammaherpesvirus 4
tccagtctgcgacggtctcc

SEQ ID NO: 47473 - DNA, 20 bp, Human gammaherpesvirus 4
ccagtctgcgacggtctcct

SEQ ID NO: 47474 - DNA, 20 bp, Human gammaherpesvirus 4
cagtctgcgacggtctcctt

SEQ ID NO: 47475 - DNA, 20 bp, Human gammaherpesvirus 4
ccccccgcgacccgcttggg

SEQ ID NO: 47476 - DNA, 20 bp, Human gammaherpesvirus 4
gggtccaacgtggccagagc

SEQ ID NO: 47477 - DNA, 20 bp, Human gammaherpesvirus 4
cgcggcctccattctctccg

SEQ ID NO: 47478 - DNA, 20 bp, Human gammaherpesvirus 4
tctccgccgcaccaccatcg

SEQ ID NO: 47479 - DNA, 20 bp, Human gammaherpesvirus 4
tccctgatgtccgccgtaca

SEQ ID NO: 47480 - DNA, 20 bp, Human gammaherpesvirus 4
ttggaccggacggccacgtt

SEQ ID NO: 47481 - DNA, 20 bp, Human gammaherpesvirus 4
gaccggacggccacgttgtg

SEQ ID NO: 47482 - DNA, 20 bp, Human gammaherpesvirus 4
tggacaaaggggggcactga

SEQ ID NO: 47483 - DNA, 20 bp, Human gammaherpesvirus 4
gtccacaacgtggccgtccg

SEQ ID NO: 47484 - DNA, 20 bp, Human gammaherpesvirus 4
gggcggcctccgccagggat

SEQ ID NO: 47485 - DNA, 20 bp, Human gammaherpesvirus 4
cagctttcgtcgtccaggac

SEQ ID NO: 47486 - DNA, 20 bp, Human gammaherpesvirus 4
cgtcgtccaggaccaagggg

SEQ ID NO: 47487 - DNA, 20 bp, Human gammaherpesvirus 4
gtcgtccaggaccaagggga

SEQ ID NO: 47488 - DNA, 20 bp, Human gammaherpesvirus 4
catctacaggggcccgcacg

SEQ ID NO: 47489 - DNA, 20 bp, Human gammaherpesvirus 4
gggcagcagccctcctttgg

SEQ ID NO: 47490 - DNA, 20 bp, Human gammaherpesvirus 4
ggggatgatgcatctggggg

SEQ ID NO: 47491 - DNA, 20 bp, Human gammaherpesvirus 4
gggatgatgcatctgggggt

SEQ ID NO: 47492 - DNA, 20 bp, Human gammaherpesvirus 4
tttggcggggaggatgcgga

SEQ ID NO: 47493 - DNA, 20 bp, Human gammaherpesvirus 4
ttggcggggaggatgcggaa

SEQ ID NO: 47494 - DNA, 20 bp, Human gammaherpesvirus 4
tggcggggaggatgcggaat

SEQ ID NO: 47495 - DNA, 20 bp, Human gammaherpesvirus 4
ggcggggaggatgcggaatg

SEQ ID NO: 47496 - DNA, 20 bp, Human gammaherpesvirus 4
gcggggaggatgcggaatgg

SEQ ID NO: 47497 - DNA, 20 bp, Human gammaherpesvirus 4
agcgtctggaggtccgtgga

SEQ ID NO: 47498 - DNA, 20 bp, Human gammaherpesvirus 4
gcgtctggaggtccgtggag

SEQ ID NO: 47499 - DNA, 20 bp, Human gammaherpesvirus 4
tccttcaccgctaccaccgc

SEQ ID NO: 47500 - DNA, 20 bp, Human gammaherpesvirus 4
ccttcaccgctaccaccgcc

SEQ ID NO: 47501 - DNA, 20 bp, Human gammaherpesvirus 4
cttcaccgctaccaccgcct

SEQ ID NO: 47502 - DNA, 20 bp, Human gammaherpesvirus 4
accctgagatacagcacgac

SEQ ID NO: 47503 - DNA, 20 bp, Human gammaherpesvirus 4
ggcctggccacccgccgctt

SEQ ID NO: 47504 - DNA, 20 bp, Human gammaherpesvirus 4
ctggtctcgggtgagaccct

SEQ ID NO: 47505 - DNA, 20 bp, Human gammaherpesvirus 4
tggtctcgggtgagaccctc

SEQ ID NO: 47506 - DNA, 20 bp, Human gammaherpesvirus 4
ggaactcgatgaaggcggcc

SEQ ID NO: 47507 - DNA, 20 bp, Human gammaherpesvirus 4
gaactcgatgaaggcggccg

SEQ ID NO: 47508 - DNA, 20 bp, Human gammaherpesvirus 4
ttcccggccgccttcatcga

SEQ ID NO: 47509 - DNA, 20 bp, Human gammaherpesvirus 4
ccggccgccttcatcgagtt

SEQ ID NO: 47510 - DNA, 20 bp, Human gammaherpesvirus 4
atcgagttccaaatctggcc

SEQ ID NO: 47511 - DNA, 20 bp, Human gammaherpesvirus 4
acggggctctttgtccccga

SEQ ID NO: 47512 - DNA, 20 bp, Human gammaherpesvirus 4
cggggctctttgtccccgag

SEQ ID NO: 47513 - DNA, 20 bp, Human gammaherpesvirus 4
gtccccgagctcttcttcaa

SEQ ID NO: 47514 - DNA, 20 bp, Human gammaherpesvirus 4
tccccgagctcttcttcaag

SEQ ID NO: 47515 - DNA, 20 bp, Human gammaherpesvirus 4
ttcaagctttttagggacac

SEQ ID NO: 47516 - DNA, 20 bp, Human gammaherpesvirus 4
tctatcgtcaactgcgccgt

SEQ ID NO: 47517 - DNA, 20 bp, Human gammaherpesvirus 4
atccttttgaaggaggcctg

SEQ ID NO: 47518 - DNA, 20 bp, Human gammaherpesvirus 4
tgaaggaggcctgcaacgcc

SEQ ID NO: 47519 - DNA, 20 bp, Human gammaherpesvirus 4
gaaggaggcctgcaacgccc

SEQ ID NO: 47520 - DNA, 20 bp, Human gammaherpesvirus 4
aaggaggcctgcaacgccca

SEQ ID NO: 47521 - DNA, 20 bp, Human gammaherpesvirus 4
accaggcagcgcgggaggca

SEQ ID NO: 47522 - DNA, 20 bp, Human gammaherpesvirus 4
gccagattgcaggtggccac

SEQ ID NO: 47523 - DNA, 20 bp, Human gammaherpesvirus 4
caggtggccacagacttcct

SEQ ID NO: 47524 - DNA, 20 bp, Human gammaherpesvirus 4
aggcccacgttgtctgctcg

SEQ ID NO: 47525 - DNA, 20 bp, Human gammaherpesvirus 4
tctgctcggtagcagcggac

SEQ ID NO: 47526 - DNA, 20 bp, Human gammaherpesvirus 4
ggagagtccggcaaggccag

SEQ ID NO: 47527 - DNA, 20 bp, Human gammaherpesvirus 4
ccagccactccagcaacacc

SEQ ID NO: 47528 - DNA, 20 bp, Human gammaherpesvirus 4
ctggagtggctgggaatggc

SEQ ID NO: 47529 - DNA, 20 bp, Human gammaherpesvirus 4
ccggactctcccaagtaggg

SEQ ID NO: 47530 - DNA, 20 bp, Human gammaherpesvirus 4
gtcttctggcacagctgttg

SEQ ID NO: 47531 - DNA, 20 bp, Human gammaherpesvirus 4
tcttctggcacagctgttgc

SEQ ID NO: 47532 - DNA, 20 bp, Human gammaherpesvirus 4
tggcacagctgttgccaggg

SEQ ID NO: 47533 - DNA, 20 bp, Human gammaherpesvirus 4
ccagggtgctcatgagcgag

SEQ ID NO: 47534 - DNA, 20 bp, Human gammaherpesvirus 4
tcagctgctggacacgcaca

SEQ ID NO: 47535 - DNA, 20 bp, Human gammaherpesvirus 4
cagctgctggacacgcacat

SEQ ID NO: 47536 - DNA, 20 bp, Human gammaherpesvirus 4
agctgctggacacgcacatg

SEQ ID NO: 47537 - DNA, 20 bp, Human gammaherpesvirus 4
cctggctgagcatgtgcgtg

SEQ ID NO: 47538 - DNA, 20 bp, Human gammaherpesvirus 4
cacgagagaacccgccacgt

SEQ ID NO: 47539 - DNA, 20 bp, Human gammaherpesvirus 4
tggcacaaacaaaacaggcg

SEQ ID NO: 47540 - DNA, 20 bp, Human gammaherpesvirus 4
cgcctgttttgtttgtgcca

SEQ ID NO: 47541 - DNA, 20 bp, Human gammaherpesvirus 4
tgtttgtgccacaacgcctc

SEQ ID NO: 47542 - DNA, 20 bp, Human gammaherpesvirus 4
gtttgtgccacaacgcctcg

SEQ ID NO: 47543 - DNA, 20 bp, Human gammaherpesvirus 4
atgggacccttgtcctcctc

SEQ ID NO: 47544 - DNA, 20 bp, Human gammaherpesvirus 4
tcctcctccatctggggggt

SEQ ID NO: 47545 - DNA, 20 bp, Human gammaherpesvirus 4
tgagctccgatggacgcagc

SEQ ID NO: 47546 - DNA, 20 bp, Human gammaherpesvirus 4
gagctccgatggacgcagcg

SEQ ID NO: 47547 - DNA, 20 bp, Human gammaherpesvirus 4
agctccgatggacgcagcgt

SEQ ID NO: 47548 - DNA, 20 bp, Human gammaherpesvirus 4
tggtcttcatcgggcgcagc

SEQ ID NO: 47549 - DNA, 20 bp, Human gammaherpesvirus 4
cagtcccacaaacgcggcgg

SEQ ID NO: 47550 - DNA, 20 bp, Human gammaherpesvirus 4
cctgactgaagcccaggacc

SEQ ID NO: 47551 - DNA, 20 bp, Human gammaherpesvirus 4
tactcctacacatgtaatgc

SEQ ID NO: 47552 - DNA, 20 bp, Human gammaherpesvirus 4
catgtgtaggagtagaactg

SEQ ID NO: 47553 - DNA, 20 bp, Human gammaherpesvirus 4
agtcagggaagccgccgccg

SEQ ID NO: 47554 - DNA, 20 bp, Human gammaherpesvirus 4
aacaagtttgtgaacacgct

SEQ ID NO: 47555 - DNA, 20 bp, Human gammaherpesvirus 4
acaagtttgtgaacacgctg

SEQ ID NO: 47556 - DNA, 20 bp, Human gammaherpesvirus 4
gtgaacacgctgctgacgga

SEQ ID NO: 47557 - DNA, 20 bp, Human gammaherpesvirus 4
tgaacacgctgctgacggat

SEQ ID NO: 47558 - DNA, 20 bp, Human gammaherpesvirus 4
gatggggatatttaaaaggg

SEQ ID NO: 47559 - DNA, 20 bp, Human gammaherpesvirus 4
catgaacaacacggcatggc

SEQ ID NO: 47560 - DNA, 20 bp, Human gammaherpesvirus 4
ccccctgtatctccagggga

SEQ ID NO: 47561 - DNA, 20 bp, Human gammaherpesvirus 4
atcccctggagatacagggg

SEQ ID NO: 47562 - DNA, 20 bp, Human gammaherpesvirus 4
ttcatgtaatgggtatgcca

SEQ ID NO: 47563 - DNA, 20 bp, Human gammaherpesvirus 4
gaggcccgcaccttggacgc

SEQ ID NO: 47564 - DNA, 20 bp, Human gammaherpesvirus 4
gacgccaaatccaccccgtt

SEQ ID NO: 47565 - DNA, 20 bp, Human gammaherpesvirus 4
tcccagtcagatgtccgtgc

SEQ ID NO: 47566 - DNA, 20 bp, Human gammaherpesvirus 4
ggcgtccaaggtgcgggcct

SEQ ID NO: 47567 - DNA, 20 bp, Human gammaherpesvirus 4
gcgtccaaggtgcgggcctc

SEQ ID NO: 47568 - DNA, 20 bp, Human gammaherpesvirus 4
tgagtcagggggggacaatg

SEQ ID NO: 47569 - DNA, 20 bp, Human gammaherpesvirus 4
gagtcagggggggacaatgt

SEQ ID NO: 47570 - DNA, 20 bp, Human gammaherpesvirus 4
agtcagggggggacaatgtc

SEQ ID NO: 47571 - DNA, 20 bp, Human gammaherpesvirus 4
tgactgctacgctaggatgt

SEQ ID NO: 47572 - DNA, 20 bp, Human gammaherpesvirus 4
tccccccctgactcaaaact

SEQ ID NO: 47573 - DNA, 20 bp, Human gammaherpesvirus 4
agccaagtcagactccagat

SEQ ID NO: 47574 - DNA, 20 bp, Human gammaherpesvirus 4
ccggtggccgggactgtttc

SEQ ID NO: 47575 - DNA, 20 bp, Human gammaherpesvirus 4
cggtggccgggactgtttcg

SEQ ID NO: 47576 - DNA, 20 bp, Human gammaherpesvirus 4
cgttgggtcatctggagtct

SEQ ID NO: 47577 - DNA, 20 bp, Human gammaherpesvirus 4
gttgggtcatctggagtctg

SEQ ID NO: 47578 - DNA, 20 bp, Human gammaherpesvirus 4
gggcaccgggcttcaggggc

SEQ ID NO: 47579 - DNA, 20 bp, Human gammaherpesvirus 4
ggcaccgggcttcaggggca

SEQ ID NO: 47580 - DNA, 20 bp, Human gammaherpesvirus 4
aggggcatggtcgggctcgg

SEQ ID NO: 47581 - DNA, 20 bp, Human gammaherpesvirus 4
cgagttcatctgtaaaagca

SEQ ID NO: 47582 - DNA, 20 bp, Human gammaherpesvirus 4
gagttcatctgtaaaagcat

SEQ ID NO: 47583 - DNA, 20 bp, Human gammaherpesvirus 4
ttttggttcctgaacatctg

SEQ ID NO: 47584 - DNA, 20 bp, Human gammaherpesvirus 4
tggttcctgaacatctggct

SEQ ID NO: 47585 - DNA, 20 bp, Human gammaherpesvirus 4
ggttcctgaacatctggctg

SEQ ID NO: 47586 - DNA, 20 bp, Human gammaherpesvirus 4
gttcctgaacatctggctgg

SEQ ID NO: 47587 - DNA, 20 bp, Human gammaherpesvirus 4
ctgaacatctggctggggca

SEQ ID NO: 47588 - DNA, 20 bp, Human gammaherpesvirus 4
ggccagcccggggggacctc

SEQ ID NO: 47589 - DNA, 20 bp, Human gammaherpesvirus 4
ccccagtttgccccatcgtt

SEQ ID NO: 47590 - DNA, 20 bp, Human gammaherpesvirus 4
gccccatcgtttccctgacg

SEQ ID NO: 47591 - DNA, 20 bp, Human gammaherpesvirus 4
ccccatcgtttccctgacgg

SEQ ID NO: 47592 - DNA, 20 bp, Human gammaherpesvirus 4
ccctgacggcctcaggggcc

SEQ ID NO: 47593 - DNA, 20 bp, Human gammaherpesvirus 4
agattcagacgagtctgact

SEQ ID NO: 47594 - DNA, 20 bp, Human gammaherpesvirus 4
agacgagtctgactacagcg

SEQ ID NO: 47595 - DNA, 20 bp, Human gammaherpesvirus 4
aagatcgtgaggcctgagag

SEQ ID NO: 47596 - DNA, 20 bp, Human gammaherpesvirus 4
cttcatcctcgtcgctctcg

SEQ ID NO: 47597 - DNA, 20 bp, Human gammaherpesvirus 4
atcctcgtcgctctcgctgt

SEQ ID NO: 47598 - DNA, 20 bp, Human gammaherpesvirus 4
cccgttttcacagagagaat

SEQ ID NO: 47599 - DNA, 20 bp, Human gammaherpesvirus 4
tcacagagagaatgtcctcc

SEQ ID NO: 47600 - DNA, 20 bp, Human gammaherpesvirus 4
cacagagagaatgtcctccg

SEQ ID NO: 47601 - DNA, 20 bp, Human gammaherpesvirus 4
acagagagaatgtcctccgt

SEQ ID NO: 47602 - DNA, 20 bp, Human gammaherpesvirus 4
tctctgtgaaaacggggaat

SEQ ID NO: 47603 - DNA, 20 bp, Human gammaherpesvirus 4
gtggtccatagctgcccctg

SEQ ID NO: 47604 - DNA, 20 bp, Human gammaherpesvirus 4
gaggtcctgagagacatgca

SEQ ID NO: 47605 - DNA, 20 bp, Human gammaherpesvirus 4
aggtcctgagagacatgcac

SEQ ID NO: 47606 - DNA, 20 bp, Human gammaherpesvirus 4
atgtggcggctcttgaaccc

SEQ ID NO: 47607 - DNA, 20 bp, Human gammaherpesvirus 4
tgtggcggctcttgaaccca

SEQ ID NO: 47608 - DNA, 20 bp, Human gammaherpesvirus 4
aacccaaaggcgctatagac

SEQ ID NO: 47609 - DNA, 20 bp, Human gammaherpesvirus 4
gggttcaagagccgccacat

SEQ ID NO: 47610 - DNA, 20 bp, Human gammaherpesvirus 4
ggttcaagagccgccacata

SEQ ID NO: 47611 - DNA, 20 bp, Human gammaherpesvirus 4
cccccggccatctttgccgg

SEQ ID NO: 47612 - DNA, 20 bp, Human gammaherpesvirus 4
gccggaacggtgaccttcga

SEQ ID NO: 47613 - DNA, 20 bp, Human gammaherpesvirus 4
ccggaacggtgaccttcgac

SEQ ID NO: 47614 - DNA, 20 bp, Human gammaherpesvirus 4
cggcaaagatggccgggggg

SEQ ID NO: 47615 - DNA, 20 bp, Human gammaherpesvirus 4
ctttttgcatggtcaggctc

SEQ ID NO: 47616 - DNA, 20 bp, Human gammaherpesvirus 4
ttgcatggtcaggctccgtg

SEQ ID NO: 47617 - DNA, 20 bp, Human gammaherpesvirus 4
tgcatggtcaggctccgtgt

SEQ ID NO: 47618 - DNA, 20 bp, Human gammaherpesvirus 4
gcatggtcaggctccgtgtc

SEQ ID NO: 47619 - DNA, 20 bp, Human gammaherpesvirus 4
catggtcaggctccgtgtcc

SEQ ID NO: 47620 - DNA, 20 bp, Human gammaherpesvirus 4
acatccgagacctccgggcc

SEQ ID NO: 47621 - DNA, 20 bp, Human gammaherpesvirus 4
tgcggctacgtcctcgtgag

SEQ ID NO: 47622 - DNA, 20 bp, Human gammaherpesvirus 4
gcggctacgtcctcgtgagt

SEQ ID NO: 47623 - DNA, 20 bp, Human gammaherpesvirus 4
cggctacgtcctcgtgagtc

SEQ ID NO: 47624 - DNA, 20 bp, Human gammaherpesvirus 4
acgtgggcccggaggtctcg

SEQ ID NO: 47625 - DNA, 20 bp, Human gammaherpesvirus 4
gcgtagcaggaggcatagat

SEQ ID NO: 47626 - DNA, 20 bp, Human gammaherpesvirus 4
acaagccaggactcgaatcc

SEQ ID NO: 47627 - DNA, 20 bp, Human gammaherpesvirus 4
gagtcctggcttgtcaactc

SEQ ID NO: 47628 - DNA, 20 bp, Human gammaherpesvirus 4
tcaactcttggagtatggcc

SEQ ID NO: 47629 - DNA, 20 bp, Human gammaherpesvirus 4
gagtatggccgggggcgggc

SEQ ID NO: 47630 - DNA, 20 bp, Human gammaherpesvirus 4
ttggtcccgcccatcatccc

SEQ ID NO: 47631 - DNA, 20 bp, Human gammaherpesvirus 4
gtcccgcccatcatcccccg

SEQ ID NO: 47632 - DNA, 20 bp, Human gammaherpesvirus 4
ggcagaccacctgtgctgga

SEQ ID NO: 47633 - DNA, 20 bp, Human gammaherpesvirus 4
atggcttcgggtccgagatg

SEQ ID NO: 47634 - DNA, 20 bp, Human gammaherpesvirus 4
gcaaattatttaaaaggtga

SEQ ID NO: 47635 - DNA, 20 bp, Human gammaherpesvirus 4
caaattatttaaaaggtgaa

SEQ ID NO: 47636 - DNA, 20 bp, Human gammaherpesvirus 4
tttaaaaggtgaatgctcaa

SEQ ID NO: 47637 - DNA, 20 bp, Human gammaherpesvirus 4
aaaaggtgaatgctcaactg

SEQ ID NO: 47638 - DNA, 20 bp, Human gammaherpesvirus 4
aaaggtgaatgctcaactga

SEQ ID NO: 47639 - DNA, 20 bp, Human gammaherpesvirus 4
caggagccagccgcggtgct

SEQ ID NO: 47640 - DNA, 20 bp, Human gammaherpesvirus 4
cggatgacagagtccggcag

SEQ ID NO: 47641 - DNA, 20 bp, Human gammaherpesvirus 4
ccgtggcggtgctggtgaca

SEQ ID NO: 47642 - DNA, 20 bp, Human gammaherpesvirus 4
agcaccgcggctggctcctg

SEQ ID NO: 47643 - DNA, 20 bp, Human gammaherpesvirus 4
ggggctgcaaattgcaaaaa

SEQ ID NO: 47644 - DNA, 20 bp, Human gammaherpesvirus 4
gggctgcaaattgcaaaaag

SEQ ID NO: 47645 - DNA, 20 bp, Human gammaherpesvirus 4
caaaaagtagagcgggtcgg

SEQ ID NO: 47646 - DNA, 20 bp, Human gammaherpesvirus 4
gggtaggggattttgtgggt

SEQ ID NO: 47647 - DNA, 20 bp, Human gammaherpesvirus 4
gaccgatccgacccgctcta

SEQ ID NO: 47648 - DNA, 20 bp, Human gammaherpesvirus 4
tgccccgtgccgcagcgtaa

SEQ ID NO: 47649 - DNA, 20 bp, Human gammaherpesvirus 4
gccccgtgccgcagcgtaaa

SEQ ID NO: 47650 - DNA, 20 bp, Human gammaherpesvirus 4
ccccgtgccgcagcgtaaac

SEQ ID NO: 47651 - DNA, 20 bp, Human gammaherpesvirus 4
acgctgcggcacggggcaaa

SEQ ID NO: 47652 - DNA, 20 bp, Human gammaherpesvirus 4
cgctgcggcacggggcaaaa

SEQ ID NO: 47653 - DNA, 20 bp, Human gammaherpesvirus 4
agggtgtcaacccggcagag

SEQ ID NO: 47654 - DNA, 20 bp, Human gammaherpesvirus 4
atggcatcgtcacgcacagt

SEQ ID NO: 47655 - DNA, 20 bp, Human gammaherpesvirus 4
tcggtgacaataaacacccc

SEQ ID NO: 47656 - DNA, 20 bp, Human gammaherpesvirus 4
attgtcaccgacaacgttct

SEQ ID NO: 47657 - DNA, 20 bp, Human gammaherpesvirus 4
ttgtcaccgacaacgttctg

SEQ ID NO: 47658 - DNA, 20 bp, Human gammaherpesvirus 4
tcaccgacaacgttctgcgc

SEQ ID NO: 47659 - DNA, 20 bp, Human gammaherpesvirus 4
tgcgccagctcttgaccttc

SEQ ID NO: 47660 - DNA, 20 bp, Human gammaherpesvirus 4
ggacacccccgggggcccgg

SEQ ID NO: 47661 - DNA, 20 bp, Human gammaherpesvirus 4
gacacccccgggggcccggc

SEQ ID NO: 47662 - DNA, 20 bp, Human gammaherpesvirus 4
aggtgccccatcttcccttc

SEQ ID NO: 47663 - DNA, 20 bp, Human gammaherpesvirus 4
ggtgccccatcttcccttcg

SEQ ID NO: 47664 - DNA, 20 bp, Human gammaherpesvirus 4
ccttcgcaggagggccacca

SEQ ID NO: 47665 - DNA, 20 bp, Human gammaherpesvirus 4
attcacggggccgtgcacct

SEQ ID NO: 47666 - DNA, 20 bp, Human gammaherpesvirus 4
acggggccgtgcacctgcca

SEQ ID NO: 47667 - DNA, 20 bp, Human gammaherpesvirus 4
tcttccacaccatccacagc

SEQ ID NO: 47668 - DNA, 20 bp, Human gammaherpesvirus 4
cacaccatccacagccccac

SEQ ID NO: 47669 - DNA, 20 bp, Human gammaherpesvirus 4
gatgccaccccctatgcccg

SEQ ID NO: 47670 - DNA, 20 bp, Human gammaherpesvirus 4
gggctccggaggtgggggct

SEQ ID NO: 47671 - DNA, 20 bp, Human gammaherpesvirus 4
ttcaggatggacttggtggg

SEQ ID NO: 47672 - DNA, 20 bp, Human gammaherpesvirus 4
tcaggatggacttggtggga

SEQ ID NO: 47673 - DNA, 20 bp, Human gammaherpesvirus 4
caggatggacttggtgggag

SEQ ID NO: 47674 - DNA, 20 bp, Human gammaherpesvirus 4
ttgccaaaacaacgtgtgct

SEQ ID NO: 47675 - DNA, 20 bp, Human gammaherpesvirus 4
ccaaaacaacgtgtgctctt

SEQ ID NO: 47676 - DNA, 20 bp, Human gammaherpesvirus 4
cttcatacaggcccgcaatt

SEQ ID NO: 47677 - DNA, 20 bp, Human gammaherpesvirus 4
ttcatacaggcccgcaattt

SEQ ID NO: 47678 - DNA, 20 bp, Human gammaherpesvirus 4
atacaggcccgcaatttcca

SEQ ID NO: 47679 - DNA, 20 bp, Human gammaherpesvirus 4
gaaacggccgcctggtccag

SEQ ID NO: 47680 - DNA, 20 bp, Human gammaherpesvirus 4
aaacggccgcctggtccagc

SEQ ID NO: 47681 - DNA, 20 bp, Human gammaherpesvirus 4
cctcctggggggccatgctc

SEQ ID NO: 47682 - DNA, 20 bp, Human gammaherpesvirus 4
caaatgctgtggatgggttt

SEQ ID NO: 47683 - DNA, 20 bp, Human gammaherpesvirus 4
aaatgctgtggatgggtttc

SEQ ID NO: 47684 - DNA, 20 bp, Human gammaherpesvirus 4
gtatagggcaaggttgggcc

SEQ ID NO: 47685 - DNA, 20 bp, Human gammaherpesvirus 4
ggcccctgggtagtcacgtt

SEQ ID NO: 47686 - DNA, 20 bp, Human gammaherpesvirus 4
cggctgaacgtgactaccca

SEQ ID NO: 47687 - DNA, 20 bp, Human gammaherpesvirus 4
ccctataccaactgctgtcc

SEQ ID NO: 47688 - DNA, 20 bp, Human gammaherpesvirus 4
taggccgagagaagcacaga

SEQ ID NO: 47689 - DNA, 20 bp, Human gammaherpesvirus 4
gggtagccgacggtggctaa

SEQ ID NO: 47690 - DNA, 20 bp, Human gammaherpesvirus 4
gccaccgtcggctaccccaa

SEQ ID NO: 47691 - DNA, 20 bp, Human gammaherpesvirus 4
acagtggcctcattggaggc

SEQ ID NO: 47692 - DNA, 20 bp, Human gammaherpesvirus 4
cagtggcctcattggaggcg

SEQ ID NO: 47693 - DNA, 20 bp, Human gammaherpesvirus 4
agaacattcatcacactccc

SEQ ID NO: 47694 - DNA, 20 bp, Human gammaherpesvirus 4
atcacactcccacttagccg

SEQ ID NO: 47695 - DNA, 20 bp, Human gammaherpesvirus 4
gccgcttcagctgggcagca

SEQ ID NO: 47696 - DNA, 20 bp, Human gammaherpesvirus 4
agctgggcagcatgcttgga

SEQ ID NO: 47697 - DNA, 20 bp, Human gammaherpesvirus 4
gataacttactaaactcgcg

SEQ ID NO: 47698 - DNA, 20 bp, Human gammaherpesvirus 4
cggcctcccgctctgccagc

SEQ ID NO: 47699 - DNA, 20 bp, Human gammaherpesvirus 4
ggcctcccgctctgccagct

SEQ ID NO: 47700 - DNA, 20 bp, Human gammaherpesvirus 4
gggggacacgcgcagtgagt

SEQ ID NO: 47701 - DNA, 20 bp, Human gammaherpesvirus 4
gggaggacactgccaaggtt

SEQ ID NO: 47702 - DNA, 20 bp, Human gammaherpesvirus 4
aagagcagatttccgtcagc

SEQ ID NO: 47703 - DNA, 20 bp, Human gammaherpesvirus 4
ccgtcagccagggtgacctg

SEQ ID NO: 47704 - DNA, 20 bp, Human gammaherpesvirus 4
cgtcagccagggtgacctgg

SEQ ID NO: 47705 - DNA, 20 bp, Human gammaherpesvirus 4
gactgcgcagggcgccggac

SEQ ID NO: 47706 - DNA, 20 bp, Human gammaherpesvirus 4
gtggagcgcccggacgcccc

SEQ ID NO: 47707 - DNA, 20 bp, Human gammaherpesvirus 4
acctggatcccctcaccgtc

SEQ ID NO: 47708 - DNA, 20 bp, Human gammaherpesvirus 4
ttcagagggagctggctctt

SEQ ID NO: 47709 - DNA, 20 bp, Human gammaherpesvirus 4
agagggagctggctcttgac

SEQ ID NO: 47710 - DNA, 20 bp, Human gammaherpesvirus 4
acggtgaggggatccaggtg

SEQ ID NO: 47711 - DNA, 20 bp, Human gammaherpesvirus 4
ggagcagggcccagtgcacc

SEQ ID NO: 47712 - DNA, 20 bp, Human gammaherpesvirus 4
gggcgccagggatcgattgg

SEQ ID NO: 47713 - DNA, 20 bp, Human gammaherpesvirus 4
gaaaagggcccagggtcact

SEQ ID NO: 47714 - DNA, 20 bp, Human gammaherpesvirus 4
tccaatcgatccctggcgcc

SEQ ID NO: 47715 - DNA, 20 bp, Human gammaherpesvirus 4
ccaatcgatccctggcgccc

SEQ ID NO: 47716 - DNA, 20 bp, Human gammaherpesvirus 4
agaaatgggggcgtgtgctg

SEQ ID NO: 47717 - DNA, 20 bp, Human gammaherpesvirus 4
gaaatgggggcgtgtgctgc

SEQ ID NO: 47718 - DNA, 20 bp, Human gammaherpesvirus 4
cctgctggcgcagcacacgc

SEQ ID NO: 47719 - DNA, 20 bp, Human gammaherpesvirus 4
ctaaagtcatacgcccgtat

SEQ ID NO: 47720 - DNA, 20 bp, Human gammaherpesvirus 4
taaagtcatacgcccgtatt

SEQ ID NO: 47721 - DNA, 20 bp, Human gammaherpesvirus 4
gctccactggggatctttgc

SEQ ID NO: 47722 - DNA, 20 bp, Human gammaherpesvirus 4
gccagccttcatactagatt

SEQ ID NO: 47723 - DNA, 20 bp, Human gammaherpesvirus 4
ccagccttcatactagattc

SEQ ID NO: 47724 - DNA, 20 bp, Human gammaherpesvirus 4
atactagattcagcgatccc

SEQ ID NO: 47725 - DNA, 20 bp, Human gammaherpesvirus 4
agcgatcccccggttgggaa

SEQ ID NO: 47726 - DNA, 20 bp, Human gammaherpesvirus 4
tggtagacggccaggtgagg

SEQ ID NO: 47727 - DNA, 20 bp, Human gammaherpesvirus 4
taggctgagagcttgcggct

SEQ ID NO: 47728 - DNA, 20 bp, Human gammaherpesvirus 4
cggctgagctccgttgaaaa

SEQ ID NO: 47729 - DNA, 20 bp, Human gammaherpesvirus 4
aaaagcagagctcccccatg

SEQ ID NO: 47730 - DNA, 20 bp, Human gammaherpesvirus 4
tcaacggagctcagccgcaa

SEQ ID NO: 47731 - DNA, 20 bp, Human gammaherpesvirus 4
tttgtaatcagcatcaggca

SEQ ID NO: 47732 - DNA, 20 bp, Human gammaherpesvirus 4
gtaatcagcatcaggcagga

SEQ ID NO: 47733 - DNA, 20 bp, Human gammaherpesvirus 4
taatcagcatcaggcaggag

SEQ ID NO: 47734 - DNA, 20 bp, Human gammaherpesvirus 4
tcggcctccagggagatggg

SEQ ID NO: 47735 - DNA, 20 bp, Human gammaherpesvirus 4
gtggcccccatctccctgga

SEQ ID NO: 47736 - DNA, 20 bp, Human gammaherpesvirus 4
cacgtgcacttgatggccag

SEQ ID NO: 47737 - DNA, 20 bp, Human gammaherpesvirus 4
atggccagctgctgcttgtc

SEQ ID NO: 47738 - DNA, 20 bp, Human gammaherpesvirus 4
tcgaggatggtcctttggcg

SEQ ID NO: 47739 - DNA, 20 bp, Human gammaherpesvirus 4
ggcgcggatcctcgcaggcc

SEQ ID NO: 47740 - DNA, 20 bp, Human gammaherpesvirus 4
gcgcggatcctcgcaggccg

SEQ ID NO: 47741 - DNA, 20 bp, Human gammaherpesvirus 4
tagtctgagaggctgagctt

SEQ ID NO: 47742 - DNA, 20 bp, Human gammaherpesvirus 4
tcccggcacacggcgtacat

SEQ ID NO: 47743 - DNA, 20 bp, Human gammaherpesvirus 4
cgcatgcgggccagctccca

SEQ ID NO: 47744 - DNA, 20 bp, Human gammaherpesvirus 4
ccgtggttgggcagaaccat

SEQ ID NO: 47745 - DNA, 20 bp, Human gammaherpesvirus 4
ggcagaaccatcagctcgcc

SEQ ID NO: 47746 - DNA, 20 bp, Human gammaherpesvirus 4
tgcccaaccacggcaaccct

SEQ ID NO: 47747 - DNA, 20 bp, Human gammaherpesvirus 4
aacatcttgacaaagtcacg

SEQ ID NO: 47748 - DNA, 20 bp, Human gammaherpesvirus 4
acaaagtcacgcgggccatg

SEQ ID NO: 47749 - DNA, 20 bp, Human gammaherpesvirus 4
tctagctttccttcagcgtc

SEQ ID NO: 47750 - DNA, 20 bp, Human gammaherpesvirus 4
ccttcagcgtctatgcccag

SEQ ID NO: 47751 - DNA, 20 bp, Human gammaherpesvirus 4
cttcagcgtctatgcccagc

SEQ ID NO: 47752 - DNA, 20 bp, Human gammaherpesvirus 4
tatcggtgtaacgcagccac

SEQ ID NO: 47753 - DNA, 20 bp, Human gammaherpesvirus 4
gccgactgtgagggtccaga

SEQ ID NO: 47754 - DNA, 20 bp, Human gammaherpesvirus 4
ccgactgtgagggtccagag

SEQ ID NO: 47755 - DNA, 20 bp, Human gammaherpesvirus 4
caccgatataatgccagcct

SEQ ID NO: 47756 - DNA, 20 bp, Human gammaherpesvirus 4
taccccctggccacctaccc

SEQ ID NO: 47757 - DNA, 20 bp, Human gammaherpesvirus 4
accccctggccacctaccct

SEQ ID NO: 47758 - DNA, 20 bp, Human gammaherpesvirus 4
ccccctggccacctaccctc

SEQ ID NO: 47759 - DNA, 20 bp, Human gammaherpesvirus 4
gggaggtggccacactgggg

SEQ ID NO: 47760 - DNA, 20 bp, Human gammaherpesvirus 4
ctatccttcctcagggaggc

SEQ ID NO: 47761 - DNA, 20 bp, Human gammaherpesvirus 4
ctcagggaggccttgatgag

SEQ ID NO: 47762 - DNA, 20 bp, Human gammaherpesvirus 4
atgagccggcagaggaccag

SEQ ID NO: 47763 - DNA, 20 bp, Human gammaherpesvirus 4
gccagccctggtcctctgcc

SEQ ID NO: 47764 - DNA, 20 bp, Human gammaherpesvirus 4
ccagccctggtcctctgccg

SEQ ID NO: 47765 - DNA, 20 bp, Human gammaherpesvirus 4
aggggggttcaggtgaggca

SEQ ID NO: 47766 - DNA, 20 bp, Human gammaherpesvirus 4
ggggggttcaggtgaggcaa

SEQ ID NO: 47767 - DNA, 20 bp, Human gammaherpesvirus 4
aggtgaggcaaggctgtggg

SEQ ID NO: 47768 - DNA, 20 bp, Human gammaherpesvirus 4
gtcacccgccgacccttagc

SEQ ID NO: 47769 - DNA, 20 bp, Human gammaherpesvirus 4
gccctcttagccgcctcacc

SEQ ID NO: 47770 - DNA, 20 bp, Human papillomavirus type 156
cagcaaatccgtcttttctt

SEQ ID NO: 47771 - DNA, 20 bp, Human papillomavirus type 156
agcaaatccgtcttttcttc

SEQ ID NO: 47772 - DNA, 20 bp, Human papillomavirus type 156
tcttcttccatggctgactc

SEQ ID NO: 47773 - DNA, 20 bp, Human papillomavirus type 156
cttcttccatggctgactcg

SEQ ID NO: 47774 - DNA, 20 bp, Human papillomavirus type 156
ttcttccatggctgactcgt

SEQ ID NO: 47775 - DNA, 20 bp, Human papillomavirus type 156
aattagatttgcatgcttta

SEQ ID NO: 47776 - DNA, 20 bp, Human papillomavirus type 156
gatttgcatgctttagtact

SEQ ID NO: 47777 - DNA, 20 bp, Human papillomavirus type 156
gcatgctttagtactacctg

SEQ ID NO: 47778 - DNA, 20 bp, Human papillomavirus type 156
catgctttagtactacctgc

SEQ ID NO: 47779 - DNA, 20 bp, Human papillomavirus type 156
agtactacctgcaaatttac

SEQ ID NO: 47780 - DNA, 20 bp, Human papillomavirus type 156
cagccctaaaacgaaagtta

SEQ ID NO: 47781 - DNA, 20 bp, Human papillomavirus type 156
gttggttctccagtacaaac

SEQ ID NO: 47782 - DNA, 20 bp, Human papillomavirus type 156
gttctccagtacaaacggta

SEQ ID NO: 47783 - DNA, 20 bp, Human papillomavirus type 156
tccagtacaaacggtagcag

SEQ ID NO: 47784 - DNA, 20 bp, Human papillomavirus type 156
agcccgcgattggaagctgt

SEQ ID NO: 47785 - DNA, 20 bp, Human papillomavirus type 156
gcaatcctcctagaactcgt

SEQ ID NO: 47786 - DNA, 20 bp, Human papillomavirus type 156
caatcctcctagaactcgta

SEQ ID NO: 47787 - DNA, 20 bp, Human papillomavirus type 156
ccattttcttctttcaaaaa

SEQ ID NO: 47788 - DNA, 20 bp, Human papillomavirus type 156
tcttctttcaaaaaggtttt

SEQ ID NO: 47789 - DNA, 20 bp, Human papillomavirus type 156
cttctttcaaaaaggttttt

SEQ ID NO: 47790 - DNA, 20 bp, Human papillomavirus type 156
ttttagaaaactcgccacac

SEQ ID NO: 47791 - DNA, 20 bp, Human papillomavirus type 156
tttagaaaactcgccacaca

SEQ ID NO: 47792 - DNA, 20 bp, Human papillomavirus type 156
ttagaaaactcgccacacaa

SEQ ID NO: 47793 - DNA, 20 bp, Human papillomavirus type 156
tagaaaactcgccacacaaa

SEQ ID NO: 47794 - DNA, 20 bp, Human papillomavirus type 156
agaaaactcgccacacaaat

SEQ ID NO: 47795 - DNA, 20 bp, Human papillomavirus type 156
ttttgttgtgtttgcatcag

SEQ ID NO: 47796 - DNA, 20 bp, Human papillomavirus type 156
tgttgtgtttgcatcagatg

SEQ ID NO: 47797 - DNA, 20 bp, Human papillomavirus type 156
gttgtgtttgcatcagatgc

SEQ ID NO: 47798 - DNA, 20 bp, Human papillomavirus type 156
ttgtgtttgcatcagatgcc

SEQ ID NO: 47799 - DNA, 20 bp, Human papillomavirus type 156
tgtttgcatcagatgcccaa

SEQ ID NO: 47800 - DNA, 20 bp, Human papillomavirus type 156
gacctagcacaagacctaca

SEQ ID NO: 47801 - DNA, 20 bp, Human papillomavirus type 156
tcggttcctttagatcctat

SEQ ID NO: 47802 - DNA, 20 bp, Human papillomavirus type 156
cggttcctttagatcctata

SEQ ID NO: 47803 - DNA, 20 bp, Human papillomavirus type 156
ggttcctttagatcctatag

SEQ ID NO: 47804 - DNA, 20 bp, Human papillomavirus type 156
ctttagatcctataggatca

SEQ ID NO: 47805 - DNA, 20 bp, Human papillomavirus type 156
atcccagggcacaatttgaa

SEQ ID NO: 47806 - DNA, 20 bp, Human papillomavirus type 156
gaaattgaagaaccccaacc

SEQ ID NO: 47807 - DNA, 20 bp, Human papillomavirus type 156
aaattgaagaaccccaacct

SEQ ID NO: 47808 - DNA, 20 bp, Human papillomavirus type 156
aagaaccccaacctacaagt

SEQ ID NO: 47809 - DNA, 20 bp, Human papillomavirus type 156
agacagagttcagagagtac

SEQ ID NO: 47810 - DNA, 20 bp, Human papillomavirus type 156
ctaaagtgctgaatacggat

SEQ ID NO: 47811 - DNA, 20 bp, Human papillomavirus type 156
tattaaaagaactggatatt

SEQ ID NO: 47812 - DNA, 20 bp, Human papillomavirus type 156
attaaaagaactggatatta

SEQ ID NO: 47813 - DNA, 20 bp, Human papillomavirus type 156
ttaaaagaactggatattac

SEQ ID NO: 47814 - DNA, 20 bp, Human papillomavirus type 156
aaagaactggatattacttt

SEQ ID NO: 47815 - DNA, 20 bp, Human papillomavirus type 156
tttcacacttacattcaaga

SEQ ID NO: 47816 - DNA, 20 bp, Human papillomavirus type 156
cacacttacattcaagatgg

SEQ ID NO: 47817 - DNA, 20 bp, Human papillomavirus type 156
acacttacattcaagatggt

SEQ ID NO: 47818 - DNA, 20 bp, Human papillomavirus type 156
cattcaagatggtgatatgt

SEQ ID NO: 47819 - DNA, 20 bp, Human papillomavirus type 156
aagatggtgatatgtgtgaa

SEQ ID NO: 47820 - DNA, 20 bp, Human papillomavirus type 156
cagatatattttatcattag

SEQ ID NO: 47821 - DNA, 20 bp, Human papillomavirus type 156
tatcattagctacaaaatgt

SEQ ID NO: 47822 - DNA, 20 bp, Human papillomavirus type 156
atcattagctacaaaatgtc

SEQ ID NO: 47823 - DNA, 20 bp, Human papillomavirus type 156
tcattagctacaaaatgtcc

SEQ ID NO: 47824 - DNA, 20 bp, Human papillomavirus type 156
gctacaaaatgtcctgcaga

SEQ ID NO: 47825 - DNA, 20 bp, Human papillomavirus type 156
atcattttgagagtataaag

SEQ ID NO: 47826 - DNA, 20 bp, Human papillomavirus type 156
tgagagtataaagccaagcc

SEQ ID NO: 47827 - DNA, 20 bp, Human papillomavirus type 156
gagagtataaagccaagcca

SEQ ID NO: 47828 - DNA, 20 bp, Human papillomavirus type 156
agagtataaagccaagccaa

SEQ ID NO: 47829 - DNA, 20 bp, Human papillomavirus type 156
gcacttatcttctgtcagta

SEQ ID NO: 47830 - DNA, 20 bp, Influenza A virus
cagctgcagatgcagacaca

SEQ ID NO: 47831 - DNA, 20 bp, Influenza A virus
aaccgacactgttgacacag

SEQ ID NO: 47832 - DNA, 20 bp, Influenza A virus
acacagtgctcgagaagaat

SEQ ID NO: 47833 - DNA, 20 bp, Influenza A virus
ttctcgagcactgtgtcaac

SEQ ID NO: 47834 - DNA, 20 bp, Influenza A virus
tcgagcactgtgtcaacagt

SEQ ID NO: 47835 - DNA, 20 bp, Influenza A virus
tagaaacaccaaactctgag

SEQ ID NO: 47836 - DNA, 20 bp, Influenza A virus
tccaggagatttcatcgact

SEQ ID NO: 47837 - DNA, 20 bp, Influenza A virus
catcgactatgaggagctga

SEQ ID NO: 47838 - DNA, 20 bp, Influenza A virus
atcgactatgaggagctgag

SEQ ID NO: 47839 - DNA, 20 bp, Influenza A virus
agctcagtgtcatcattcga

SEQ ID NO: 47840 - DNA, 20 bp, Influenza A virus
ttatgtgaacaagaaaggga

SEQ ID NO: 47841 - DNA, 20 bp, Influenza A virus
tgtgaacaagaaagggaaag

SEQ ID NO: 47842 - DNA, 20 bp, Influenza A virus
tactgtggggtattcatcac

SEQ ID NO: 47843 - DNA, 20 bp, Influenza A virus
atcacccgtctaacagtaag

SEQ ID NO: 47844 - DNA, 20 bp, Influenza A virus
ctgttagacgggtgatgaat

SEQ ID NO: 47845 - DNA, 20 bp, Influenza A virus
gaggcaaatggaaatctaat

SEQ ID NO: 47846 - DNA, 20 bp, Influenza A virus
aggcaaatggaaatctaata

SEQ ID NO: 47847 - DNA, 20 bp, Influenza A virus
cgcactgagtagaggctttg

SEQ ID NO: 47848 - DNA, 20 bp, Influenza A virus
gcactgagtagaggctttgg

SEQ ID NO: 47849 - DNA, 20 bp, Influenza A virus
gggtccggcatcatcacctc

SEQ ID NO: 47850 - DNA, 20 bp, Influenza A virus
cgtccattcaatccagaggt

SEQ ID NO: 47851 - DNA, 20 bp, Influenza A virus
aatccagaggtctatttgga

SEQ ID NO: 47852 - DNA, 20 bp, Influenza A virus
ggagccattgccggttttat

SEQ ID NO: 47853 - DNA, 20 bp, Influenza A virus
gagccattgccggttttatt

SEQ ID NO: 47854 - DNA, 20 bp, Influenza A virus
ccggttttattgaaggggga

SEQ ID NO: 47855 - DNA, 20 bp, Influenza A virus
aacagggaaaaggtagatgg

SEQ ID NO: 47856 - DNA, 20 bp, Influenza A virus
gaatcaatggggatctatca

SEQ ID NO: 47857 - DNA, 20 bp, Influenza A virus
tggcgatctactcaactgtc

SEQ ID NO: 47858 - DNA, 20 bp, Influenza A virus
actggtgcttttggtctccc

SEQ ID NO: 47859 - DNA, 20 bp, Influenza A virus
agtagatcgccagaatctga

SEQ ID NO: 47860 - DNA, 20 bp, Human papillomavirus type 9
aaaacgaccgataacggtaa

SEQ ID NO: 47861 - DNA, 20 bp, Human papillomavirus type 9
gcacgtaggtggttatttga

SEQ ID NO: 47862 - DNA, 20 bp, Human papillomavirus type 9
tttgatcgttgggatgattg

SEQ ID NO: 47863 - DNA, 20 bp, Human papillomavirus type 9
gatcgttgggatgattgtgg

SEQ ID NO: 47864 - DNA, 20 bp, Human papillomavirus type 9
atcgttgggatgattgtggt

SEQ ID NO: 47865 - DNA, 20 bp, Human papillomavirus type 9
acagcttatttggacagagg

SEQ ID NO: 47866 - DNA, 20 bp, Human papillomavirus type 9
cagcttatttggacagagga

SEQ ID NO: 47867 - DNA, 20 bp, Human papillomavirus type 9
tttggacagaggaggatttg

SEQ ID NO: 47868 - DNA, 20 bp, Human papillomavirus type 9
ggacagaggaggatttggtg

SEQ ID NO: 47869 - DNA, 20 bp, Human papillomavirus type 9
gacagaggaggatttggtgt

SEQ ID NO: 47870 - DNA, 20 bp, Human papillomavirus type 9
gctacatgctataagtttga

SEQ ID NO: 47871 - DNA, 20 bp, Human papillomavirus type 9
gagcagttttataaggtcag

SEQ ID NO: 47872 - DNA, 20 bp, Human papillomavirus type 9
agcagttttataaggtcaga

SEQ ID NO: 47873 - DNA, 20 bp, Human papillomavirus type 9
tataaggtcagaaacagctg

SEQ ID NO: 47874 - DNA, 20 bp, Human papillomavirus type 9
ataaggtcagaaacagctgg

SEQ ID NO: 47875 - DNA, 20 bp, Human papillomavirus type 9
gagcgcaacaggaacttttg

SEQ ID NO: 47876 - DNA, 20 bp, Human papillomavirus type 9
tgctgggtgatatacaactg

SEQ ID NO: 47877 - DNA, 20 bp, Human papillomavirus type 9
gctgggtgatatacaactgg

SEQ ID NO: 47878 - DNA, 20 bp, Human papillomavirus type 9
ctgggtgatatacaactggt

SEQ ID NO: 47879 - DNA, 20 bp, Human papillomavirus type 9
gccatgagtgacaataaagg

SEQ ID NO: 47880 - DNA, 20 bp, Human papillomavirus type 9
cagacctaatagatgatgga

SEQ ID NO: 47881 - DNA, 20 bp, Human papillomavirus type 9
agacctaatagatgatggag

SEQ ID NO: 47882 - DNA, 20 bp, Human papillomavirus type 9
tgccagcaagagagtgagga

SEQ ID NO: 47883 - DNA, 20 bp, Human papillomavirus type 9
gccagcaagagagtgaggaa

SEQ ID NO: 47884 - DNA, 20 bp, Human papillomavirus type 9
ccagcaagagagtgaggaaa

SEQ ID NO: 47885 - DNA, 20 bp, Human papillomavirus type 9
ggaattgttaaagatttact

SEQ ID NO: 47886 - DNA, 20 bp, Human papillomavirus type 9
ttaaagatttacttaaacat

SEQ ID NO: 47887 - DNA, 20 bp, Human papillomavirus type 9
aagtaaatctttaacaattc

SEQ ID NO: 47888 - DNA, 20 bp, Human papillomavirus type 9
agtaaatctttaacaattcc

SEQ ID NO: 47889 - DNA, 20 bp, Human papillomavirus type 9
aacaattcccaagcccttag

SEQ ID NO: 47890 - DNA, 20 bp, Human papillomavirus type 9
ttattgcagcattgtgctta

SEQ ID NO: 47891 - DNA, 20 bp, Human papillomavirus type 9
ttgcagcattgtgcttatat

SEQ ID NO: 47892 - DNA, 20 bp, Human papillomavirus type 9
cagcattgtgcttatatttg

SEQ ID NO: 47893 - DNA, 20 bp, Human papillomavirus type 9
tgcttatatttggctacatt

SEQ ID NO: 47894 - DNA, 20 bp, Human papillomavirus type 9
tatttggctacattatatgc

SEQ ID NO: 47895 - DNA, 20 bp, Human papillomavirus type 9
atcaccaatctgcaaatgct

SEQ ID NO: 47896 - DNA, 20 bp, Human papillomavirus type 9
gacttatcgacaatgataca

SEQ ID NO: 47897 - DNA, 20 bp, Human papillomavirus type 9
acttatcgacaatgatacaa

SEQ ID NO: 47898 - DNA, 20 bp, Human papillomavirus type 9
tcgacaatgatacaatttgc

SEQ ID NO: 47899 - DNA, 20 bp, Human papillomavirus type 9
gcctatgatcatgaatattt

SEQ ID NO: 47900 - DNA, 20 bp, Human papillomavirus type 9
ctttcaataacaaatttcca

SEQ ID NO: 47901 - DNA, 20 bp, Human papillomavirus type 9
caataacaaatttccacttg

SEQ ID NO: 47902 - DNA, 20 bp, Human papillomavirus type 9
aataacaaatttccacttga

SEQ ID NO: 47903 - DNA, 20 bp, Human papillomavirus type 9
ccacttgatgctaatcacaa

SEQ ID NO: 47904 - DNA, 20 bp, Human papillomavirus type 9
cacttgatgctaatcacaaa

SEQ ID NO: 47905 - DNA, 20 bp, Human papillomavirus type 9
tgcattatgccaggaaaaat

SEQ ID NO: 47906 - DNA, 20 bp, Human papillomavirus type 9
gcattatgccaggaaaaatg

SEQ ID NO: 47907 - DNA, 20 bp, Human papillomavirus type 9
cattatgccaggaaaaatgg

SEQ ID NO: 47908 - DNA, 20 bp, Human papillomavirus type 9
tgccaggaaaaatggagtta

SEQ ID NO: 47909 - DNA, 20 bp, Human papillomavirus type 9
tgcgattggggtaccaacct

SEQ ID NO: 47910 - DNA, 20 bp, Human papillomavirus type 9
ccaggtcggggtcgccaaca

SEQ ID NO: 47911 - DNA, 20 bp, Human papillomavirus type 9
caggtcggggtcgccaacaa

SEQ ID NO: 47912 - DNA, 20 bp, Human papillomavirus type 9
ttggcgaccccgacctggaa

SEQ ID NO: 47913 - DNA, 20 bp, Human papillomavirus type 9
gcgaccccgacctggaaagg

SEQ ID NO: 47914 - DNA, 20 bp, Human papillomavirus type 9
gaggtctctcccccgtctcc

SEQ ID NO: 47915 - DNA, 20 bp, Human papillomavirus type 9
cacctccccttccccttcgc

SEQ ID NO: 47916 - DNA, 20 bp, Human papillomavirus type 9
cccttcgcctgtcggtgggg

SEQ ID NO: 47917 - DNA, 20 bp, Human papillomavirus type 9
gcctgtcggtgggggtagtg

SEQ ID NO: 47918 - DNA, 20 bp, Human papillomavirus type 9
atgctgttgcgtggcgacgc

SEQ ID NO: 47919 - DNA, 20 bp, Human papillomavirus type 9
cgtggcgacgccaatgtgct

SEQ ID NO: 47920 - DNA, 20 bp, Human papillomavirus type 9
agtgctatcgctttcgggaa

SEQ ID NO: 47921 - DNA, 20 bp, Human papillomavirus type 9
cgggaacgcaaaaaaaaaag

SEQ ID NO: 47922 - DNA, 20 bp, Human papillomavirus type 9
gggaacgcaaaaaaaaaaga

SEQ ID NO: 47923 - DNA, 20 bp, Human papillomavirus type 9
ctactaacccatactaacta

SEQ ID NO: 47924 - DNA, 20 bp, Human papillomavirus type 9
gtgcaaaacgtactaaacgt

SEQ ID NO: 47925 - DNA, 20 bp, Human papillomavirus type 9
cagatatatacagaggctgc

SEQ ID NO: 47926 - DNA, 20 bp, Human papillomavirus type 9
gcagcctctgtatatatctg

SEQ ID NO: 47927 - DNA, 20 bp, Human papillomavirus type 9
cagcctctgtatatatctgt

SEQ ID NO: 47928 - DNA, 20 bp, Human papillomavirus type 9
cattaggggaagggccagga

SEQ ID NO: 47929 - DNA, 20 bp, Human papillomavirus type 9
ggggaagggccaggagtccg

SEQ ID NO: 47930 - DNA, 20 bp, Human papillomavirus type 9
gccctggggtgatacctgaa

SEQ ID NO: 47931 - DNA, 20 bp, Human papillomavirus type 9
gcccaactgatctaattcct

SEQ ID NO: 47932 - DNA, 20 bp, Human papillomavirus type 9
gatcagttgggccaattatt

SEQ ID NO: 47933 - DNA, 20 bp, Human papillomavirus type 9
taacagaaggtagaagaggc

SEQ ID NO: 47934 - DNA, 20 bp, Human papillomavirus type 9
tagaggtggctgacccaagc

SEQ ID NO: 47935 - DNA, 20 bp, Human papillomavirus type 9
agaggtggctgacccaagcc

SEQ ID NO: 47936 - DNA, 20 bp, Human papillomavirus type 9
gaggtggctgacccaagccc

SEQ ID NO: 47937 - DNA, 20 bp, Human papillomavirus type 9
gcataggagggcttgggtca

SEQ ID NO: 47938 - DNA, 20 bp, Human papillomavirus type 9
aggagcctccagataggcaa

SEQ ID NO: 47939 - DNA, 20 bp, Human papillomavirus type 9
ttagatgtacaacgccttag

SEQ ID NO: 47940 - DNA, 20 bp, Human papillomavirus type 9
tagatgtacaacgccttagt

SEQ ID NO: 47941 - DNA, 20 bp, Human papillomavirus type 9
agatgtacaacgccttagta

SEQ ID NO: 47942 - DNA, 20 bp, Human papillomavirus type 9
gatgtacaacgccttagtag

SEQ ID NO: 47943 - DNA, 20 bp, Human papillomavirus type 9
aaagttcaattgttgatgtt

SEQ ID NO: 47944 - DNA, 20 bp, Human papillomavirus type 9
aattgttgatgttaatattg

SEQ ID NO: 47945 - DNA, 20 bp, Human papillomavirus type 9
ttgatgttaatattgatgaa

SEQ ID NO: 47946 - DNA, 20 bp, Human papillomavirus type 9
atgttaatattgatgaacct

SEQ ID NO: 47947 - DNA, 20 bp, Human papillomavirus type 9
atattgatgaacctgatggt

SEQ ID NO: 47948 - DNA, 20 bp, Human papillomavirus type 9
tttatcatgcaattagtgac

SEQ ID NO: 47949 - DNA, 20 bp, Human papillomavirus type 9
ttatcatgcaattagtgacc

SEQ ID NO: 47950 - DNA, 20 bp, Human papillomavirus type 9
tatcatgcaattagtgaccg

SEQ ID NO: 47951 - DNA, 20 bp, Human papillomavirus type 9
atcatgcaattagtgaccgt

SEQ ID NO: 47952 - DNA, 20 bp, Human papillomavirus type 9
tcatgcaattagtgaccgtt

SEQ ID NO: 47953 - DNA, 20 bp, Human papillomavirus type 9
aaataggcagaggacaacct

SEQ ID NO: 47954 - DNA, 20 bp, Human papillomavirus type 9
aggggttggaacatcaggtc

SEQ ID NO: 47955 - DNA, 20 bp, Human papillomavirus type 9
ggggttggaacatcaggtca

SEQ ID NO: 47956 - DNA, 20 bp, Human papillomavirus type 9
gaacatcaggtcacccatta

SEQ ID NO: 47957 - DNA, 20 bp, Human papillomavirus type 9
tttaataaggttagagacac

SEQ ID NO: 47958 - DNA, 20 bp, Human papillomavirus type 9
gtgacgctgttcctgatggt

SEQ ID NO: 47959 - DNA, 20 bp, Human papillomavirus type 9
ctgatggtgcagtaaaccag

SEQ ID NO: 47960 - DNA, 20 bp, Human papillomavirus type 9
ctttttgccagcaaaaagtg

SEQ ID NO: 47961 - DNA, 20 bp, Human papillomavirus type 9
tttttgccagcaaaaagtga

SEQ ID NO: 47962 - DNA, 20 bp, Human papillomavirus type 9
ttgccagcaaaaagtgatca

SEQ ID NO: 47963 - DNA, 20 bp, Chlamydia trachomatis
taacagaattggggaaaaat

SEQ ID NO: 47964 - DNA, 20 bp, Chlamydia trachomatis
gggaaaaatttcgataaaaa

SEQ ID NO: 47965 - DNA, 20 bp, Chlamydia trachomatis
cgataaaaaacggcccctcc

SEQ ID NO: 47966 - DNA, 20 bp, Chlamydia trachomatis
gataaaaaacggcccctcct

SEQ ID NO: 47967 - DNA, 20 bp, Chlamydia trachomatis
tgtatgcctcttggggaact

SEQ ID NO: 47968 - DNA, 20 bp, Chlamydia trachomatis
gactcttgtttcaaatatgg

SEQ ID NO: 47969 - DNA, 20 bp, Chlamydia trachomatis
tttcaaatatggcgctagct

SEQ ID NO: 47970 - DNA, 20 bp, Chlamydia trachomatis
caaatatggcgctagctgtg

SEQ ID NO: 47971 - DNA, 20 bp, Chlamydia trachomatis
aaatatggcgctagctgtgc

SEQ ID NO: 47972 - DNA, 20 bp, Chlamydia trachomatis
tttgtctttaatacggacat

SEQ ID NO: 47973 - DNA, 20 bp, Chlamydia trachomatis
ataggccagaagatcccaac

SEQ ID NO: 47974 - DNA, 20 bp, Chlamydia trachomatis
tcaacgggaacaaaaccaaa

SEQ ID NO: 47975 - DNA, 20 bp, Chlamydia trachomatis
caacgggaacaaaaccaaaa

SEQ ID NO: 47976 - DNA, 20 bp, Chlamydia trachomatis
aacgggaacaaaaccaaaat

SEQ ID NO: 47977 - DNA, 20 bp, Chlamydia trachomatis
tggttttgttcccgttgaaa

SEQ ID NO: 47978 - DNA, 20 bp, Chlamydia trachomatis
ataagttcttgaaacgatac

SEQ ID NO: 47979 - DNA, 20 bp, Chlamydia trachomatis
ttgaaacgatacagtggcat

SEQ ID NO: 47980 - DNA, 20 bp, Chlamydia trachomatis
aaacgatacagtggcattaa

SEQ ID NO: 47981 - DNA, 20 bp, Chlamydia trachomatis
agcagtctgctcctaagcct

SEQ ID NO: 47982 - DNA, 20 bp, Chlamydia trachomatis
cacaacggtttcaggcttag

SEQ ID NO: 47983 - DNA, 20 bp, Chlamydia trachomatis
taccaatttagaaggacagg

SEQ ID NO: 47984 - DNA, 20 bp, Chlamydia trachomatis
agaaggacaggaatcgagta

SEQ ID NO: 47985 - DNA, 20 bp, Chlamydia trachomatis
gaaggacaggaatcgagtac

SEQ ID NO: 47986 - DNA, 20 bp, Chlamydia trachomatis
acgtgtcttccctgaaggtt

SEQ ID NO: 47987 - DNA, 20 bp, Chlamydia trachomatis
cctgaaggttgagacaattt

SEQ ID NO: 47988 - DNA, 20 bp, Chlamydia trachomatis
tggatctctagagaagactg

SEQ ID NO: 47989 - DNA, 20 bp, Chlamydia trachomatis
cctgtacccagtaccgcaaa

SEQ ID NO: 47990 - DNA, 20 bp, Chlamydia trachomatis
ctgtacccagtaccgcaaag

SEQ ID NO: 47991 - DNA, 20 bp, Chlamydia trachomatis
gcggtactgggtacaggaaa

SEQ ID NO: 47992 - DNA, 20 bp, Chlamydia trachomatis
cggtactgggtacaggaaat

SEQ ID NO: 47993 - DNA, 20 bp, Chlamydia trachomatis
tcgtccagcgctgatatcag

SEQ ID NO: 47994 - DNA, 20 bp, Chlamydia trachomatis
gccatttcacaacggtttca

SEQ ID NO: 47995 - DNA, 20 bp, Chlamydia trachomatis
cacaacggtttcaataaaaa

SEQ ID NO: 47996 - DNA, 20 bp, Chlamydia trachomatis
acaacggtttcaataaaaag

SEQ ID NO: 47997 - DNA, 20 bp, Chlamydia trachomatis
caataaaaagctgtgcaaaa

SEQ ID NO: 47998 - DNA, 20 bp, Chlamydia trachomatis
gcgcttctgcagctaaaaga

SEQ ID NO: 47999 - DNA, 20 bp, Chlamydia trachomatis
cgcttctgcagctaaaagaa

SEQ ID NO: 48000 - DNA, 20 bp, Chlamydia trachomatis
tgcagctaaaagaaaaacga

SEQ ID NO: 48001 - DNA, 20 bp, Chlamydia trachomatis
tcgtacagctcacagttggc

SEQ ID NO: 48002 - DNA, 20 bp, Chlamydia trachomatis
gcgtcaacaattaatgaaat

SEQ ID NO: 48003 - DNA, 20 bp, Chlamydia trachomatis
tctccattatatcacttgtc

SEQ ID NO: 48004 - DNA, 20 bp, Chlamydia trachomatis
tatcacttgtctccgagtca

SEQ ID NO: 48005 - DNA, 20 bp, Chlamydia trachomatis
tctccgagtcaaggcagcgt

SEQ ID NO: 48006 - DNA, 20 bp, Chlamydia trachomatis
tacaattcccctctatctga

SEQ ID NO: 48007 - DNA, 20 bp, Chlamydia trachomatis
ccctctatctgaatacgccg

SEQ ID NO: 48008 - DNA, 20 bp, Chlamydia trachomatis
cttcaggaatgccttctcat

SEQ ID NO: 48009 - DNA, 20 bp, Chlamydia trachomatis
aggaatgccttctcatgtaa

SEQ ID NO: 48010 - DNA, 20 bp, Chlamydia trachomatis
tcatgtaaagatggaagatc

SEQ ID NO: 48011 - DNA, 20 bp, Chlamydia trachomatis
atgctctgggggttgaaggg

SEQ ID NO: 48012 - DNA, 20 bp, Chlamydia trachomatis
tgctctgggggttgaagggt

SEQ ID NO: 48013 - DNA, 20 bp, Chlamydia trachomatis
gccgtgatgggcaaaaacct

SEQ ID NO: 48014 - DNA, 20 bp, Chlamydia trachomatis
tattgaacatggtggatcat

SEQ ID NO: 48015 - DNA, 20 bp, Chlamydia trachomatis
aacatggtggatcatggttt

SEQ ID NO: 48016 - DNA, 20 bp, Chlamydia trachomatis
ttctgtttctgtctataacc

SEQ ID NO: 48017 - DNA, 20 bp, Chlamydia trachomatis
tctgtttctgtctataaccg

SEQ ID NO: 48018 - DNA, 20 bp, Chlamydia trachomatis
tgccgcttagctttttcttt

SEQ ID NO: 48019 - DNA, 20 bp, Chlamydia trachomatis
gctttttcttttctaaagga

SEQ ID NO: 48020 - DNA, 20 bp, Chlamydia trachomatis
ttcttttctaaaggatttgt

SEQ ID NO: 48021 - DNA, 20 bp, Chlamydia trachomatis
tcttttctaaaggatttgtc

SEQ ID NO: 48022 - DNA, 20 bp, Chlamydia trachomatis
cttttctaaaggatttgtca

SEQ ID NO: 48023 - DNA, 20 bp, Chlamydia trachomatis
cgtcctccaacaatcgcctg

SEQ ID NO: 48024 - DNA, 20 bp, Chlamydia trachomatis
tggctcatcagttgatgctt

SEQ ID NO: 48025 - DNA, 20 bp, Chlamydia trachomatis
atgctttgcctgaatgagag

SEQ ID NO: 48026 - DNA, 20 bp, Chlamydia trachomatis
gcctgaatgagagtggactt

SEQ ID NO: 48027 - DNA, 20 bp, Chlamydia trachomatis
cctgaatgagagtggactta

SEQ ID NO: 48028 - DNA, 20 bp, Chlamydia trachomatis
ctaaatgcgctaccgctgca

SEQ ID NO: 48029 - DNA, 20 bp, Chlamydia trachomatis
gtcttcaaacagcatgatgt

SEQ ID NO: 48030 - DNA, 20 bp, Chlamydia trachomatis
tcttcaaacagcatgatgtc

SEQ ID NO: 48031 - DNA, 20 bp, Chlamydia trachomatis
aaacagcatgatgtccgata

SEQ ID NO: 48032 - DNA, 20 bp, Chlamydia trachomatis
acccgactatcggacatcat

SEQ ID NO: 48033 - DNA, 20 bp, Chlamydia trachomatis
cgttcattttgtacagcata

SEQ ID NO: 48034 - DNA, 20 bp, Chlamydia trachomatis
attttgtacagcatatcgac

SEQ ID NO: 48035 - DNA, 20 bp, Chlamydia trachomatis
tgtacagcatatcgacaagg

SEQ ID NO: 48036 - DNA, 20 bp, Chlamydia trachomatis
gtacagcatatcgacaaggg

SEQ ID NO: 48037 - DNA, 20 bp, Chlamydia trachomatis
tacagcatatcgacaaggga

SEQ ID NO: 48038 - DNA, 20 bp, Chlamydia trachomatis
cattgcaaaaagctcctaag

SEQ ID NO: 48039 - DNA, 20 bp, Chlamydia trachomatis
caaaaagctcctaagactag

SEQ ID NO: 48040 - DNA, 20 bp, Chlamydia trachomatis
ttgtagagggtgatgcagac

SEQ ID NO: 48041 - DNA, 20 bp, Chlamydia trachomatis
tgtagagggtgatgcagact

SEQ ID NO: 48042 - DNA, 20 bp, Chlamydia trachomatis
gtagagggtgatgcagactt

SEQ ID NO: 48043 - DNA, 20 bp, Chlamydia trachomatis
gcccgtttgagagggaatga

SEQ ID NO: 48044 - DNA, 20 bp, Chlamydia trachomatis
gagagggaatgaaccttcaa

SEQ ID NO: 48045 - DNA, 20 bp, Chlamydia trachomatis
agagggaatgaaccttcaac

SEQ ID NO: 48046 - DNA, 20 bp, Chlamydia trachomatis
aacttgcgatactgtgatga

SEQ ID NO: 48047 - DNA, 20 bp, Chlamydia trachomatis
cgatactgtgatgatgagtt

SEQ ID NO: 48048 - DNA, 20 bp, Chlamydia trachomatis
cgaaaggtgtgtacattatc

SEQ ID NO: 48049 - DNA, 20 bp, Chlamydia trachomatis
tcaacgtaggagttgggaag

SEQ ID NO: 48050 - DNA, 20 bp, Chlamydia trachomatis
ccaactcctacgttgataat

SEQ ID NO: 48051 - DNA, 20 bp, Chlamydia trachomatis
ataatgtacacacctttcgc

SEQ ID NO: 48052 - DNA, 20 bp, Chlamydia trachomatis
cgcaagcatttgcaggcctg

SEQ ID NO: 48053 - DNA, 20 bp, Chlamydia trachomatis
aagaaggaatgggacatgtg

SEQ ID NO: 48054 - DNA, 20 bp, Chlamydia trachomatis
tcgggggcataaaggagaac

SEQ ID NO: 48055 - DNA, 20 bp, Chlamydia trachomatis
cgggggcataaaggagaacc

SEQ ID NO: 48056 - DNA, 20 bp, Chlamydia trachomatis
gggggcataaaggagaacct

SEQ ID NO: 48057 - DNA, 20 bp, Chlamydia trachomatis
tctcagtatatcgcgtattc

SEQ ID NO: 48058 - DNA, 20 bp, Chlamydia trachomatis
gagagcggttgagtgctatt

SEQ ID NO: 48059 - DNA, 20 bp, Chlamydia trachomatis
agtgctatttcggataagca

SEQ ID NO: 48060 - DNA, 20 bp, Chlamydia trachomatis
cggataagcaatggttggct

SEQ ID NO: 48061 - DNA, 20 bp, Chlamydia trachomatis
ggataagcaatggttggcta

SEQ ID NO: 48062 - DNA, 20 bp, Chlamydia trachomatis
gctattagctcccaggttac

SEQ ID NO: 48063 - DNA, 20 bp, Chlamydia trachomatis
ccatggaagaggtagcaaag

SEQ ID NO: 48064 - DNA, 20 bp, Chlamydia trachomatis
catggaagaggtagcaaagg

SEQ ID NO: 48065 - DNA, 20 bp, Chlamydia trachomatis
ctcgcttaacagaagaggat

SEQ ID NO: 48066 - DNA, 20 bp, Chlamydia trachomatis
tcgcttaacagaagaggata

SEQ ID NO: 48067 - DNA, 20 bp, Chlamydia trachomatis
acagaagaggataagacaaa

SEQ ID NO: 48068 - DNA, 20 bp, Chlamydia trachomatis
ctccgaatgttcgggagact

SEQ ID NO: 48069 - DNA, 20 bp, Chlamydia trachomatis
gggagactcaggaaattgga

SEQ ID NO: 48070 - DNA, 20 bp, Chlamydia trachomatis
gatagcaaaaccgctttcct

SEQ ID NO: 48071 - DNA, 20 bp, Chlamydia trachomatis
cctgtgtgtaatcataacgc

SEQ ID NO: 48072 - DNA, 20 bp, Chlamydia trachomatis
ctgtgtgtaatcataacgct

SEQ ID NO: 48073 - DNA, 20 bp, Chlamydia trachomatis
cccaaatccattatcacaca

SEQ ID NO: 48074 - DNA, 20 bp, Chlamydia trachomatis
ccaaatccattatcacacac

SEQ ID NO: 48075 - DNA, 20 bp, Chlamydia trachomatis
tcacacacaactagaacgct

SEQ ID NO: 48076 - DNA, 20 bp, Chlamydia trachomatis
gatcttcagttacaacttga

SEQ ID NO: 48077 - DNA, 20 bp, Chlamydia trachomatis
atcttcagttacaacttgac

SEQ ID NO: 48078 - DNA, 20 bp, Chlamydia trachomatis
tccgaaatagaaatacctcc

SEQ ID NO: 48079 - DNA, 20 bp, Chlamydia trachomatis
caatatgcgaacaacgacct

SEQ ID NO: 48080 - DNA, 20 bp, Chlamydia trachomatis
cctcatcgatactgttatcc

SEQ ID NO: 48081 - DNA, 20 bp, Chlamydia trachomatis
ttgtaccgaggtcgttgttc

SEQ ID NO: 48082 - DNA, 20 bp, Chlamydia trachomatis
tgtaccgaggtcgttgttcg

SEQ ID NO: 48083 - DNA, 20 bp, Chlamydia trachomatis
taaacaaagaagctcttgcc

SEQ ID NO: 48084 - DNA, 20 bp, Chlamydia trachomatis
aaacaaagaagctcttgcct

SEQ ID NO: 48085 - DNA, 20 bp, Chlamydia trachomatis
aacaaagaagctcttgcctc

SEQ ID NO: 48086 - DNA, 20 bp, Chlamydia trachomatis
cctccttggcttttgttaaa

SEQ ID NO: 48087 - DNA, 20 bp, Chlamydia trachomatis
gcttttgttaaacctgcaaa

SEQ ID NO: 48088 - DNA, 20 bp, Chlamydia trachomatis
ctctactccgtgaagctgac

SEQ ID NO: 48089 - DNA, 20 bp, Chlamydia trachomatis
tctactccgtgaagctgact

SEQ ID NO: 48090 - DNA, 20 bp, Chlamydia trachomatis
gccgatctttatgtagtagc

SEQ ID NO: 48091 - DNA, 20 bp, Chlamydia trachomatis
atgtagtagcccctttagaa

SEQ ID NO: 48092 - DNA, 20 bp, Chlamydia trachomatis
tgtagtagcccctttagaag

SEQ ID NO: 48093 - DNA, 20 bp, Chlamydia trachomatis
ccttttcttcttgctgcact

SEQ ID NO: 48094 - DNA, 20 bp, Chlamydia trachomatis
cttttcttcttgctgcactt

SEQ ID NO: 48095 - DNA, 20 bp, Chlamydia trachomatis
tcttcttgctgcacttaaca

SEQ ID NO: 48096 - DNA, 20 bp, Chlamydia trachomatis
cttcttgctgcacttaacac

SEQ ID NO: 48097 - DNA, 20 bp, Chlamydia trachomatis
ttcttgctgcacttaacacc

SEQ ID NO: 48098 - DNA, 20 bp, Chlamydia trachomatis
tcaatacactgaaaaagaca

SEQ ID NO: 48099 - DNA, 20 bp, Chlamydia trachomatis
actgaacactctagctgccc

SEQ ID NO: 48100 - DNA, 20 bp, Chlamydia trachomatis
ctgaacactctagctgccct

SEQ ID NO: 48101 - DNA, 20 bp, Chlamydia trachomatis
agtaaagcttgtgcagcttg

SEQ ID NO: 48102 - DNA, 20 bp, Chlamydia trachomatis
tgcagcttgtgtgtcttttg

SEQ ID NO: 48103 - DNA, 20 bp, Chlamydia trachomatis
ctgtcagcgaacggttcttc

SEQ ID NO: 48104 - DNA, 20 bp, Chlamydia trachomatis
ttcttaggaggtgaaaccac

SEQ ID NO: 48105 - DNA, 20 bp, Chlamydia trachomatis
ttaggaggtgaaaccactgt

SEQ ID NO: 48106 - DNA, 20 bp, Chlamydia trachomatis
ggaggtgaaaccactgttcg

SEQ ID NO: 48107 - DNA, 20 bp, Chlamydia trachomatis
gcggttacaaaccttttatt

SEQ ID NO: 48108 - DNA, 20 bp, Chlamydia trachomatis
gtaaagctgaacaggatgtc

SEQ ID NO: 48109 - DNA, 20 bp, Chlamydia trachomatis
ggcctccaccattcggaaaa

SEQ ID NO: 48110 - DNA, 20 bp, Chlamydia trachomatis
gcctccaccattcggaaaaa

SEQ ID NO: 48111 - DNA, 20 bp, Chlamydia trachomatis
ggaaaaatcactccccaagg

SEQ ID NO: 48112 - DNA, 20 bp, Chlamydia trachomatis
gggagtgatttttccgaatg

SEQ ID NO: 48113 - DNA, 20 bp, Chlamydia trachomatis
cttagaacaacttcaaaatt

SEQ ID NO: 48114 - DNA, 20 bp, Chlamydia trachomatis
gaacaacttcaaaattttgt

SEQ ID NO: 48115 - DNA, 20 bp, Chlamydia trachomatis
aaaattttgtaactactccg

SEQ ID NO: 48116 - DNA, 20 bp, Chlamydia trachomatis
tgtaactactccgataaccg

SEQ ID NO: 48117 - DNA, 20 bp, Chlamydia trachomatis
gtaactactccgataaccga

SEQ ID NO: 48118 - DNA, 20 bp, Chlamydia trachomatis
ctctaaattatctgcttccc

SEQ ID NO: 48119 - DNA, 20 bp, Chlamydia trachomatis
tctgcttcccaagtagcgaa

SEQ ID NO: 48120 - DNA, 20 bp, Chlamydia trachomatis
ccaagtagcgaaaaatccaa

SEQ ID NO: 48121 - DNA, 20 bp, Chlamydia trachomatis
tatagctgttggatttttcg

SEQ ID NO: 48122 - DNA, 20 bp, Chlamydia trachomatis
gatttttcgctacttgggaa

SEQ ID NO: 48123 - DNA, 20 bp, Chlamydia trachomatis
tggatcaacaatcaaccttt

SEQ ID NO: 48124 - DNA, 20 bp, Chlamydia trachomatis
gatcgctatcttaggtatct

SEQ ID NO: 48125 - DNA, 20 bp, Chlamydia trachomatis
atcgctatcttaggtatctg

SEQ ID NO: 48126 - DNA, 20 bp, Chlamydia trachomatis
ggtatctgctcagctcttgc

SEQ ID NO: 48127 - DNA, 20 bp, Chlamydia trachomatis
cggttacgactacggtgact

SEQ ID NO: 48128 - DNA, 20 bp, Chlamydia trachomatis
acaggaattgatatttccaa

SEQ ID NO: 48129 - DNA, 20 bp, Chlamydia trachomatis
atatttccaaacccacaaca

SEQ ID NO: 48130 - DNA, 20 bp, Chlamydia trachomatis
ccaaacccacaacatctaaa

SEQ ID NO: 48131 - DNA, 20 bp, Chlamydia trachomatis
caaacccacaacatctaaac

SEQ ID NO: 48132 - DNA, 20 bp, Chlamydia trachomatis
gtcacgaatatagccactga

SEQ ID NO: 48133 - DNA, 20 bp, Chlamydia trachomatis
taaatccacatcccctttag

SEQ ID NO: 48134 - DNA, 20 bp, Chlamydia trachomatis
agaacattgaagatcctcta

SEQ ID NO: 48135 - DNA, 20 bp, Chlamydia trachomatis
gaacattgaagatcctctaa

SEQ ID NO: 48136 - DNA, 20 bp, Chlamydia trachomatis
aagatcctctaaatttgaac

SEQ ID NO: 48137 - DNA, 20 bp, Chlamydia trachomatis
gaacctccgataaaaatgta

SEQ ID NO: 48138 - DNA, 20 bp, Chlamydia trachomatis
cttctttaagagataagcaa

SEQ ID NO: 48139 - DNA, 20 bp, Chlamydia trachomatis
tttaagagataagcaacaac

SEQ ID NO: 48140 - DNA, 20 bp, Chlamydia trachomatis
aagagataagcaacaaccga

SEQ ID NO: 48141 - DNA, 20 bp, Chlamydia trachomatis
agagataagcaacaaccgag

SEQ ID NO: 48142 - DNA, 20 bp, Chlamydia trachomatis
tacgcacaatgaacccagaa

SEQ ID NO: 48143 - DNA, 20 bp, Chlamydia trachomatis
gcaacaacggtatcgacagt

SEQ ID NO: 48144 - DNA, 20 bp, Chlamydia trachomatis
ccagaagaaatcacccatgt

SEQ ID NO: 48145 - DNA, 20 bp, Chlamydia trachomatis
cttcctcaaaacaagagaaa

SEQ ID NO: 48146 - DNA, 20 bp, Chlamydia trachomatis
ctcaaaacaagagaaaggca

SEQ ID NO: 48147 - DNA, 20 bp, Chlamydia trachomatis
tgatcacaagattatggtgc

SEQ ID NO: 48148 - DNA, 20 bp, Chlamydia trachomatis
tagaggcagcagttcttcag

SEQ ID NO: 48149 - DNA, 20 bp, Chlamydia trachomatis
agaggcagcagttcttcaga

SEQ ID NO: 48150 - DNA, 20 bp, Chlamydia trachomatis
gaggcagcagttcttcagaa

SEQ ID NO: 48151 - DNA, 20 bp, Chlamydia trachomatis
ttcagaaccctgacggattg

SEQ ID NO: 48152 - DNA, 20 bp, Chlamydia trachomatis
agaaccctgacggattgtcg

SEQ ID NO: 48153 - DNA, 20 bp, Chlamydia trachomatis
ctaacttatcaaacagccct

SEQ ID NO: 48154 - DNA, 20 bp, Chlamydia trachomatis
taacttatcaaacagccctt

SEQ ID NO: 48155 - DNA, 20 bp, Chlamydia trachomatis
tcaaacagcccttcttttac

SEQ ID NO: 48156 - DNA, 20 bp, Chlamydia trachomatis
ttttaccagggctgcatcgt

SEQ ID NO: 48157 - DNA, 20 bp, Chlamydia trachomatis
taccagggctgcatcgtctc

SEQ ID NO: 48158 - DNA, 20 bp, Chlamydia trachomatis
aatagcctctgcagccttat

SEQ ID NO: 48159 - DNA, 20 bp, Chlamydia trachomatis
tctccagcagcaaaaactaa

SEQ ID NO: 48160 - DNA, 20 bp, Chlamydia trachomatis
gcaaaactttacctgtaccg

SEQ ID NO: 48161 - DNA, 20 bp, Chlamydia trachomatis
tgcgaattttagtttttgct

SEQ ID NO: 48162 - DNA, 20 bp, Chlamydia trachomatis
gcgaattttagtttttgctg

SEQ ID NO: 48163 - DNA, 20 bp, Chlamydia trachomatis
cctcaggcagagttaccaca

SEQ ID NO: 48164 - DNA, 20 bp, Chlamydia trachomatis
ccacacctgtgacgtctgtt

SEQ ID NO: 48165 - DNA, 20 bp, Chlamydia trachomatis
tacggaagaagaattgaggt

SEQ ID NO: 48166 - DNA, 20 bp, Chlamydia trachomatis
aggtctatatcctgtgaaga

SEQ ID NO: 48167 - DNA, 20 bp, Chlamydia trachomatis
cttcacaggatatagacctc

SEQ ID NO: 48168 - DNA, 20 bp, Chlamydia trachomatis
ctctttccacatcgttctta

SEQ ID NO: 48169 - DNA, 20 bp, Chlamydia trachomatis
ccacatcgttcttaccaata

SEQ ID NO: 48170 - DNA, 20 bp, Chlamydia trachomatis
cacatcgttcttaccaatac

SEQ ID NO: 48171 - DNA, 20 bp, Chlamydia trachomatis
ttaccaatacctctgaggag

SEQ ID NO: 48172 - DNA, 20 bp, Chlamydia trachomatis
ccaatacctctgaggagcaa

SEQ ID NO: 48173 - DNA, 20 bp, Chlamydia trachomatis
ctctgcccgaagaaatggaa

SEQ ID NO: 48174 - DNA, 20 bp, Chlamydia trachomatis
tctgcccgaagaaatggaac

SEQ ID NO: 48175 - DNA, 20 bp, Chlamydia trachomatis
ggcaagaaaccacaagtagt

SEQ ID NO: 48176 - DNA, 20 bp, Chlamydia trachomatis
ctatgctcgacaataaaatt

SEQ ID NO: 48177 - DNA, 20 bp, Chlamydia trachomatis
gttgagctgagcaattttat

SEQ ID NO: 48178 - DNA, 20 bp, Chlamydia trachomatis
cggaacgcacccccattctt

SEQ ID NO: 48179 - DNA, 20 bp, Chlamydia trachomatis
tttacggaggatctgtgaaa

SEQ ID NO: 48180 - DNA, 20 bp, Chlamydia trachomatis
acggaggatctgtgaaagcc

SEQ ID NO: 48181 - DNA, 20 bp, Chlamydia trachomatis
cggaggatctgtgaaagccg

SEQ ID NO: 48182 - DNA, 20 bp, Chlamydia trachomatis
ccctctgccctgatgttaat

SEQ ID NO: 48183 - DNA, 20 bp, Chlamydia trachomatis
cataacctgtccttcctgtt

SEQ ID NO: 48184 - DNA, 20 bp, Chlamydia trachomatis
ctgtttagggaaacgattcc

SEQ ID NO: 48185 - DNA, 20 bp, Chlamydia trachomatis
agggaaacgattcctccctc

SEQ ID NO: 48186 - DNA, 20 bp, Chlamydia trachomatis
gggaaacgattcctccctca

SEQ ID NO: 48187 - DNA, 20 bp, Chlamydia trachomatis
taatacttgagggaggaatc

SEQ ID NO: 48188 - DNA, 20 bp, Chlamydia trachomatis
tcgcgatagaaaaaacgagc

SEQ ID NO: 48189 - DNA, 20 bp, Chlamydia trachomatis
caatcattctgtggcttctg

SEQ ID NO: 48190 - DNA, 20 bp, Chlamydia trachomatis
tgtggcttctgcattagaaa

SEQ ID NO: 48191 - DNA, 20 bp, Chlamydia trachomatis
tgcattagaaatctcagaaa

SEQ ID NO: 48192 - DNA, 20 bp, Chlamydia trachomatis
gaaatctcagaaatgctaga

SEQ ID NO: 48193 - DNA, 20 bp, Chlamydia trachomatis
cgaagaaacaccacaacttt

SEQ ID NO: 48194 - DNA, 20 bp, Chlamydia trachomatis
ctgtctcagtatccacttct

SEQ ID NO: 48195 - DNA, 20 bp, Chlamydia trachomatis
tgtctcagtatccacttcta

SEQ ID NO: 48196 - DNA, 20 bp, Chlamydia trachomatis
tacgatccaaattgagaacc

SEQ ID NO: 48197 - DNA, 20 bp, Chlamydia trachomatis
agaaccttgctttcccttta

SEQ ID NO: 48198 - DNA, 20 bp, Chlamydia trachomatis
tgccgcctcctcgaaggaca

SEQ ID NO: 48199 - DNA, 20 bp, Chlamydia trachomatis
gccgcctcctcgaaggacag

SEQ ID NO: 48200 - DNA, 20 bp, Chlamydia trachomatis
ccgcctcctcgaaggacagc

SEQ ID NO: 48201 - DNA, 20 bp, Chlamydia trachomatis
ttactagctccttgtcgaga

SEQ ID NO: 48202 - DNA, 20 bp, Chlamydia trachomatis
ctagctccttgtcgagaact

SEQ ID NO: 48203 - DNA, 20 bp, Chlamydia trachomatis
ttcaaagaattggctaacag

SEQ ID NO: 48204 - DNA, 20 bp, Chlamydia trachomatis
tcaaagaattggctaacagc

SEQ ID NO: 48205 - DNA, 20 bp, Chlamydia trachomatis
caaagaattggctaacagct

SEQ ID NO: 48206 - DNA, 20 bp, Chlamydia trachomatis
aaagaattggctaacagctt

SEQ ID NO: 48207 - DNA, 20 bp, Chlamydia trachomatis
gctaacagcttgcgtctttg

SEQ ID NO: 48208 - DNA, 20 bp, Chlamydia trachomatis
cttcggatcttccaaactta

SEQ ID NO: 48209 - DNA, 20 bp, Chlamydia trachomatis
ggatcttccaaacttaccat

SEQ ID NO: 48210 - DNA, 20 bp, Chlamydia trachomatis
tatggtaagtttggaagatc

SEQ ID NO: 48211 - DNA, 20 bp, Chlamydia trachomatis
ggaagatccgaagcaagatc

SEQ ID NO: 48212 - DNA, 20 bp, Chlamydia trachomatis
gaagatccgaagcaagatcg

SEQ ID NO: 48213 - DNA, 20 bp, Chlamydia trachomatis
tgtgtagagcctcaaagact

SEQ ID NO: 48214 - DNA, 20 bp, Chlamydia trachomatis
gctcccactaatgcaactaa

SEQ ID NO: 48215 - DNA, 20 bp, Chlamydia trachomatis
tgaggggcctttatctttag

SEQ ID NO: 48216 - DNA, 20 bp, Chlamydia trachomatis
atctttagttgcattagtgg

SEQ ID NO: 48217 - DNA, 20 bp, Chlamydia trachomatis
tctttagttgcattagtggg

SEQ ID NO: 48218 - DNA, 20 bp, Chlamydia trachomatis
tagcgaggtctgagatcttc

SEQ ID NO: 48219 - DNA, 20 bp, Chlamydia trachomatis
ttgaaaacccctttcccaaa

SEQ ID NO: 48220 - DNA, 20 bp, Chlamydia trachomatis
aaaacccctttcccaaaaaa

SEQ ID NO: 48221 - DNA, 20 bp, Chlamydia trachomatis
cccaaaaaacagtgaggacg

SEQ ID NO: 48222 - DNA, 20 bp, Chlamydia trachomatis
ccaaaaaacagtgaggacga

SEQ ID NO: 48223 - DNA, 20 bp, Chlamydia trachomatis
ttaacgtggtaactccaccg

SEQ ID NO: 48224 - DNA, 20 bp, Chlamydia trachomatis
acgtggtaactccaccgaca

SEQ ID NO: 48225 - DNA, 20 bp, Chlamydia trachomatis
ctgaaaaagcaatcgctaaa

SEQ ID NO: 48226 - DNA, 20 bp, Chlamydia trachomatis
cggaactccaggagctagta

SEQ ID NO: 48227 - DNA, 20 bp, Chlamydia trachomatis
cgcaatcgattgttttagcg

SEQ ID NO: 48228 - DNA, 20 bp, Chlamydia trachomatis
gacactaccaagcagatttt

SEQ ID NO: 48229 - DNA, 20 bp, Chlamydia trachomatis
tcctttgcggtcttccttct

SEQ ID NO: 48230 - DNA, 20 bp, Chlamydia trachomatis
cctttgcggtcttccttctg

SEQ ID NO: 48231 - DNA, 20 bp, Chlamydia trachomatis
ctttgcggtcttccttctgt

SEQ ID NO: 48232 - DNA, 20 bp, Chlamydia trachomatis
gcggtcttccttctgtaggt

SEQ ID NO: 48233 - DNA, 20 bp, Chlamydia trachomatis
ggttttactgactgctctgc

SEQ ID NO: 48234 - DNA, 20 bp, Chlamydia trachomatis
tactgactgctctgctctcc

SEQ ID NO: 48235 - DNA, 20 bp, Chlamydia trachomatis
actgactgctctgctctccc

SEQ ID NO: 48236 - DNA, 20 bp, Chlamydia trachomatis
ctgactgctctgctctccct

SEQ ID NO: 48237 - DNA, 20 bp, Chlamydia trachomatis
cttttacgactaccatgcag

SEQ ID NO: 48238 - DNA, 20 bp, Chlamydia trachomatis
ttctttagaagatctcttct

SEQ ID NO: 48239 - DNA, 20 bp, Chlamydia trachomatis
tctttagaagatctcttctc

SEQ ID NO: 48240 - DNA, 20 bp, Chlamydia trachomatis
ctttagaagatctcttctct

SEQ ID NO: 48241 - DNA, 20 bp, Chlamydia trachomatis
tttagaagatctcttctctc

SEQ ID NO: 48242 - DNA, 20 bp, Chlamydia trachomatis
agaagatctcttctctccat

SEQ ID NO: 48243 - DNA, 20 bp, Chlamydia trachomatis
ttgctttgctgtactgagct

SEQ ID NO: 48244 - DNA, 20 bp, Chlamydia trachomatis
tgctttgctgtactgagctg

SEQ ID NO: 48245 - DNA, 20 bp, Chlamydia trachomatis
gctttgctgtactgagctgc

SEQ ID NO: 48246 - DNA, 20 bp, Chlamydia trachomatis
ctttgctgtactgagctgca

SEQ ID NO: 48247 - DNA, 20 bp, Chlamydia trachomatis
gctgtactgagctgcaacta

SEQ ID NO: 48248 - DNA, 20 bp, Chlamydia trachomatis
ctcctcccaaagagaagaaa

SEQ ID NO: 48249 - DNA, 20 bp, Chlamydia trachomatis
tcctcccaaagagaagaaat

SEQ ID NO: 48250 - DNA, 20 bp, Chlamydia trachomatis
tcctgccatgctaacggacg

SEQ ID NO: 48251 - DNA, 20 bp, Chlamydia trachomatis
ccttttccatgacttgtttc

SEQ ID NO: 48252 - DNA, 20 bp, Chlamydia trachomatis
cttttccatgacttgtttca

SEQ ID NO: 48253 - DNA, 20 bp, Chlamydia trachomatis
gtacgcttctcttccttagg

SEQ ID NO: 48254 - DNA, 20 bp, Chlamydia trachomatis
tacgcttctcttccttaggg

SEQ ID NO: 48255 - DNA, 20 bp, Chlamydia trachomatis
tcttccttagggaaacgtga

SEQ ID NO: 48256 - DNA, 20 bp, Chlamydia trachomatis
cttagggaaacgtgaagaca

SEQ ID NO: 48257 - DNA, 20 bp, Chlamydia trachomatis
gggaaacgtgaagacatatt

SEQ ID NO: 48258 - DNA, 20 bp, Chlamydia trachomatis
cctggaaaagtcatccctat

SEQ ID NO: 48259 - DNA, 20 bp, Chlamydia trachomatis
agccctttctgacaatctgt

SEQ ID NO: 48260 - DNA, 20 bp, Chlamydia trachomatis
ctgacaatctgtgcagctta

SEQ ID NO: 48261 - DNA, 20 bp, Chlamydia trachomatis
tgacaatctgtgcagcttaa

SEQ ID NO: 48262 - DNA, 20 bp, Chlamydia trachomatis
aaacctaatgtggatcgctt

SEQ ID NO: 48263 - DNA, 20 bp, Chlamydia trachomatis
ctgagcatttgcgtcctgga

SEQ ID NO: 48264 - DNA, 20 bp, Chlamydia trachomatis
gcgtcctggagctgttattt

SEQ ID NO: 48265 - DNA, 20 bp, Chlamydia trachomatis
cgtcctggagctgttatttc

SEQ ID NO: 48266 - DNA, 20 bp, Chlamydia trachomatis
tttctgtgcaactggcttct

SEQ ID NO: 48267 - DNA, 20 bp, Chlamydia trachomatis
ctgtgcaactggcttctgtc

SEQ ID NO: 48268 - DNA, 20 bp, Chlamydia trachomatis
tttcttactatatttccctt

SEQ ID NO: 48269 - DNA, 20 bp, Chlamydia trachomatis
ttcttactatatttcccttt

SEQ ID NO: 48270 - DNA, 20 bp, Chlamydia trachomatis
tcttactatatttccctttg

SEQ ID NO: 48271 - DNA, 20 bp, Chlamydia trachomatis
cttactatatttccctttgt

SEQ ID NO: 48272 - DNA, 20 bp, Chlamydia trachomatis
ttactatatttccctttgta

SEQ ID NO: 48273 - DNA, 20 bp, Chlamydia trachomatis
ttcagaatgtcggtttaacc

SEQ ID NO: 48274 - DNA, 20 bp, Chlamydia trachomatis
agaatgtcggtttaacccat

SEQ ID NO: 48275 - DNA, 20 bp, Chlamydia trachomatis
aacccatgtctggggacccc

SEQ ID NO: 48276 - DNA, 20 bp, Chlamydia trachomatis
acccatgtctggggacccct

SEQ ID NO: 48277 - DNA, 20 bp, Chlamydia trachomatis
ctgtcaattctacattatgt

SEQ ID NO: 48278 - DNA, 20 bp, Chlamydia trachomatis
tacaacagaaactcttactt

SEQ ID NO: 48279 - DNA, 20 bp, Chlamydia trachomatis
aagtaagagtttctgttgta

SEQ ID NO: 48280 - DNA, 20 bp, Chlamydia trachomatis
ctgttgtagaaccagcttct

SEQ ID NO: 48281 - DNA, 20 bp, Chlamydia trachomatis
tgttgtagaaccagcttctg

SEQ ID NO: 48282 - DNA, 20 bp, Chlamydia trachomatis
tagaaccagcttctggctca

SEQ ID NO: 48283 - DNA, 20 bp, Chlamydia trachomatis
ggttattttatgacacgaat

SEQ ID NO: 48284 - DNA, 20 bp, Chlamydia trachomatis
ttttatgacacgaatgagta

SEQ ID NO: 48285 - DNA, 20 bp, Chlamydia trachomatis
tatgacacgaatgagtaaac

SEQ ID NO: 48286 - DNA, 20 bp, Chlamydia trachomatis
atgacacgaatgagtaaaca

SEQ ID NO: 48287 - DNA, 20 bp, Chlamydia trachomatis
tgacacgaatgagtaaacaa

SEQ ID NO: 48288 - DNA, 20 bp, Chlamydia trachomatis
gtgatgactgcgcgttaaac

SEQ ID NO: 48289 - DNA, 20 bp, Chlamydia trachomatis
aacttttttgcaacatcctc

SEQ ID NO: 48290 - DNA, 20 bp, Chlamydia trachomatis
tttgcaacatcctctttcga

SEQ ID NO: 48291 - DNA, 20 bp, Chlamydia trachomatis
ttgcaacatcctctttcgaa

SEQ ID NO: 48292 - DNA, 20 bp, Chlamydia trachomatis
tgcaacatcctctttcgaaa

SEQ ID NO: 48293 - DNA, 20 bp, Chlamydia trachomatis
aggaattacccctccgacga

SEQ ID NO: 48294 - DNA, 20 bp, Chlamydia trachomatis
ggaattacccctccgacgat

SEQ ID NO: 48295 - DNA, 20 bp, Chlamydia trachomatis
cccctccgacgatcttactg

SEQ ID NO: 48296 - DNA, 20 bp, Chlamydia trachomatis
ctgacaacctcgtttccttt

SEQ ID NO: 48297 - DNA, 20 bp, Chlamydia trachomatis
ccttttccaggttcatttgg

SEQ ID NO: 48298 - DNA, 20 bp, Chlamydia trachomatis
actttgactgtatacattct

SEQ ID NO: 48299 - DNA, 20 bp, Chlamydia trachomatis
gactgtatacattctgccaa

SEQ ID NO: 48300 - DNA, 20 bp, Chlamydia trachomatis
actgtatacattctgccaaa

SEQ ID NO: 48301 - DNA, 20 bp, Chlamydia trachomatis
tgccaaagcaagaatcctgt

SEQ ID NO: 48302 - DNA, 20 bp, Chlamydia trachomatis
aggtcctgtagctttagact

SEQ ID NO: 48303 - DNA, 20 bp, Chlamydia trachomatis
gttgcacccaattcattgac

SEQ ID NO: 48304 - DNA, 20 bp, Chlamydia trachomatis
cacccaattcattgactgta

SEQ ID NO: 48305 - DNA, 20 bp, Chlamydia trachomatis
ggtgcaacgaatagtgcctt

SEQ ID NO: 48306 - DNA, 20 bp, Chlamydia trachomatis
attgatcgttttgctaggga

SEQ ID NO: 48307 - DNA, 20 bp, Chlamydia trachomatis
atcgttttgctagggatttc

SEQ ID NO: 48308 - DNA, 20 bp, Chlamydia trachomatis
cctgtagaatagcgacacga

SEQ ID NO: 48309 - DNA, 20 bp, Chlamydia trachomatis
gcactcaaacactcgtgaaa

SEQ ID NO: 48310 - DNA, 20 bp, Chlamydia trachomatis
ttaccaaacctttcaaatac

SEQ ID NO: 48311 - DNA, 20 bp, Chlamydia trachomatis
taccaaacctttcaaatacc

SEQ ID NO: 48312 - DNA, 20 bp, Chlamydia trachomatis
accaaacctttcaaataccc

SEQ ID NO: 48313 - DNA, 20 bp, Chlamydia trachomatis
aagagcagcattcttaataa

SEQ ID NO: 48314 - DNA, 20 bp, Chlamydia trachomatis
ttaataatcgttcgtccttg

SEQ ID NO: 48315 - DNA, 20 bp, Chlamydia trachomatis
ataatcgttcgtccttgagc

SEQ ID NO: 48316 - DNA, 20 bp, Chlamydia trachomatis
gtccttgagcccctacagaa

SEQ ID NO: 48317 - DNA, 20 bp, Chlamydia trachomatis
agcccctacagaagcaagga

SEQ ID NO: 48318 - DNA, 20 bp, Chlamydia trachomatis
caatcacttgcgcttgctga

SEQ ID NO: 48319 - DNA, 20 bp, Chlamydia trachomatis
aatcacttgcgcttgctgat

SEQ ID NO: 48320 - DNA, 20 bp, Chlamydia trachomatis
cgcttgctgatcccactcta

SEQ ID NO: 48321 - DNA, 20 bp, Chlamydia trachomatis
ctgatcccactctacaatcg

SEQ ID NO: 48322 - DNA, 20 bp, Chlamydia trachomatis
ggcaaacggtagatctttgt

SEQ ID NO: 48323 - DNA, 20 bp, Chlamydia trachomatis
ctccataatcaaccaggtag

SEQ ID NO: 48324 - DNA, 20 bp, Chlamydia trachomatis
tccataatcaaccaggtagg

SEQ ID NO: 48325 - DNA, 20 bp, Chlamydia trachomatis
gataaaagcatctaggagct

SEQ ID NO: 48326 - DNA, 20 bp, Chlamydia trachomatis
ataaaagcatctaggagctc

SEQ ID NO: 48327 - DNA, 20 bp, Chlamydia trachomatis
tatcaaagcctacctggttg

SEQ ID NO: 48328 - DNA, 20 bp, Chlamydia trachomatis
gttagaatctgagtttttcg

SEQ ID NO: 48329 - DNA, 20 bp, Chlamydia trachomatis
ttagaatctgagtttttcgg

SEQ ID NO: 48330 - DNA, 20 bp, Chlamydia trachomatis
gaatctgagtttttcgggca

SEQ ID NO: 48331 - DNA, 20 bp, Chlamydia trachomatis
ttcgggcacgaaaaaggagc

SEQ ID NO: 48332 - DNA, 20 bp, Chlamydia trachomatis
tcgggcacgaaaaaggagct

SEQ ID NO: 48333 - DNA, 20 bp, Chlamydia trachomatis
acaatcacgcaccataatac

SEQ ID NO: 48334 - DNA, 20 bp, Chlamydia trachomatis
acacggatttgtcagtattt

SEQ ID NO: 48335 - DNA, 20 bp, Chlamydia trachomatis
cacggatttgtcagtatttg

SEQ ID NO: 48336 - DNA, 20 bp, Chlamydia trachomatis
gtcagtatttgcttacagag

SEQ ID NO: 48337 - DNA, 20 bp, Chlamydia trachomatis
tcagtatttgcttacagaga

SEQ ID NO: 48338 - DNA, 20 bp, Chlamydia trachomatis
gtaacctgctccaaaggaac

SEQ ID NO: 48339 - DNA, 20 bp, Chlamydia trachomatis
aacacttgcgaagcggtgaa

SEQ ID NO: 48340 - DNA, 20 bp, Chlamydia trachomatis
cgaagcggtgaatgcatgaa

SEQ ID NO: 48341 - DNA, 20 bp, Chlamydia trachomatis
taattctggcgaggatattc

SEQ ID NO: 48342 - DNA, 20 bp, Chlamydia trachomatis
aattctggcgaggatattca

SEQ ID NO: 48343 - DNA, 20 bp, Chlamydia trachomatis
acaagaagttctagcacgca

SEQ ID NO: 48344 - DNA, 20 bp, Chlamydia trachomatis
caagaagttctagcacgcac

SEQ ID NO: 48345 - DNA, 20 bp, Chlamydia trachomatis
tagcacgcacgactggaaaa

SEQ ID NO: 48346 - DNA, 20 bp, Chlamydia trachomatis
tatgttaaagttctaaaaaa

SEQ ID NO: 48347 - DNA, 20 bp, Chlamydia trachomatis
tttttagaactttaacatac

SEQ ID NO: 48348 - DNA, 20 bp, Chlamydia trachomatis
ctattgcttcaagcatttta

SEQ ID NO: 48349 - DNA, 20 bp, Chlamydia trachomatis
cttcaagcattttactatgc

SEQ ID NO: 48350 - DNA, 20 bp, Chlamydia trachomatis
aagcattttactatgctcga

SEQ ID NO: 48351 - DNA, 20 bp, Chlamydia trachomatis
tactatgctcgatatcaacg

SEQ ID NO: 48352 - DNA, 20 bp, Chlamydia trachomatis
actatgctcgatatcaacgt

SEQ ID NO: 48353 - DNA, 20 bp, Chlamydia trachomatis
ccctttacgttttaaatatc

SEQ ID NO: 48354 - DNA, 20 bp, Chlamydia trachomatis
cctttacgttttaaatatct

SEQ ID NO: 48355 - DNA, 20 bp, Chlamydia trachomatis
acgttttaaatatctgttga

SEQ ID NO: 48356 - DNA, 20 bp, Chlamydia trachomatis
cgttttaaatatctgttgat

SEQ ID NO: 48357 - DNA, 20 bp, Chlamydia trachomatis
taaatatctgttgatagcaa

SEQ ID NO: 48358 - DNA, 20 bp, Chlamydia trachomatis
ttataccattccgaccgagc

SEQ ID NO: 48359 - DNA, 20 bp, Chlamydia trachomatis
taccattccgaccgagcaat

SEQ ID NO: 48360 - DNA, 20 bp, Chlamydia trachomatis
cgaccgagcaatctcagctc

SEQ ID NO: 48361 - DNA, 20 bp, Chlamydia trachomatis
ctggtcgtttagctggagct

SEQ ID NO: 48362 - DNA, 20 bp, Chlamydia trachomatis
tggtcgtttagctggagctg

SEQ ID NO: 48363 - DNA, 20 bp, Chlamydia trachomatis
tatattttcattggactctg

SEQ ID NO: 48364 - DNA, 20 bp, Chlamydia trachomatis
atattttcattggactctgc

SEQ ID NO: 48365 - DNA, 20 bp, Chlamydia trachomatis
tattttcattggactctgca

SEQ ID NO: 48366 - DNA, 20 bp, Chlamydia trachomatis
tcattggactctgcatttgc

SEQ ID NO: 48367 - DNA, 20 bp, Chlamydia trachomatis
cattggactctgcatttgca

SEQ ID NO: 48368 - DNA, 20 bp, Chlamydia trachomatis
tgattggagttttcttctcc

SEQ ID NO: 48369 - DNA, 20 bp, Chlamydia trachomatis
gattggagttttcttctcca

SEQ ID NO: 48370 - DNA, 20 bp, Chlamydia trachomatis
attggagttttcttctccaa

SEQ ID NO: 48371 - DNA, 20 bp, Chlamydia trachomatis
gagttttcttctccaaagcg

SEQ ID NO: 48372 - DNA, 20 bp, Chlamydia trachomatis
tcttctccaaagcgttcata

SEQ ID NO: 48373 - DNA, 20 bp, Chlamydia trachomatis
ggaccgaaaacaatccctcc

SEQ ID NO: 48374 - DNA, 20 bp, Chlamydia trachomatis
aggagctgccaagcaacctt

SEQ ID NO: 48375 - DNA, 20 bp, Chlamydia trachomatis
acgggcattccccgtccctt

SEQ ID NO: 48376 - DNA, 20 bp, Chlamydia trachomatis
cccgtccctttttgtctaaa

SEQ ID NO: 48377 - DNA, 20 bp, Chlamydia trachomatis
tagacaaaaagggacgggga

SEQ ID NO: 48378 - DNA, 20 bp, Chlamydia trachomatis
taagcgcaaagctcttctct

SEQ ID NO: 48379 - DNA, 20 bp, Chlamydia trachomatis
aagcgcaaagctcttctctg

SEQ ID NO: 48380 - DNA, 20 bp, Chlamydia trachomatis
agcgcaaagctcttctctgg

SEQ ID NO: 48381 - DNA, 20 bp, Chlamydia trachomatis
tctggtctgcttccctaaac

SEQ ID NO: 48382 - DNA, 20 bp, Chlamydia trachomatis
cctaaaccggcgtatttctt

SEQ ID NO: 48383 - DNA, 20 bp, Chlamydia trachomatis
taggacacattgcaaagaaa

SEQ ID NO: 48384 - DNA, 20 bp, Chlamydia trachomatis
caaagaaattccctggggaa

SEQ ID NO: 48385 - DNA, 20 bp, Chlamydia trachomatis
cctggggaagaccctcttac

SEQ ID NO: 48386 - DNA, 20 bp, Chlamydia trachomatis
cgctggttaaagaacgtctc

SEQ ID NO: 48387 - DNA, 20 bp, Chlamydia trachomatis
aagaacgtctcaaattggaa

SEQ ID NO: 48388 - DNA, 20 bp, Chlamydia trachomatis
aaaatgcttttgagatcgga

SEQ ID NO: 48389 - DNA, 20 bp, Chlamydia trachomatis
tgagatcggagtcttgattt

SEQ ID NO: 48390 - DNA, 20 bp, Chlamydia trachomatis
gagatcggagtcttgattta

SEQ ID NO: 48391 - DNA, 20 bp, Chlamydia trachomatis
agatcggagtcttgatttac

SEQ ID NO: 48392 - DNA, 20 bp, Chlamydia trachomatis
atttacctccctttctttgt

SEQ ID NO: 48393 - DNA, 20 bp, Chlamydia trachomatis
gatgggattgctgctacctc

SEQ ID NO: 48394 - DNA, 20 bp, Chlamydia trachomatis
ctgctacctcaggtgataca

SEQ ID NO: 48395 - DNA, 20 bp, Chlamydia trachomatis
tctatatccttcttattaag

SEQ ID NO: 48396 - DNA, 20 bp, Chlamydia trachomatis
ctatatccttcttattaagg

SEQ ID NO: 48397 - DNA, 20 bp, Chlamydia trachomatis
ataagaaggatatagaaaat

SEQ ID NO: 48398 - DNA, 20 bp, Chlamydia trachomatis
ttaataggcccgtttttagc

SEQ ID NO: 48399 - DNA, 20 bp, Chlamydia trachomatis
taataggcccgtttttagcg

SEQ ID NO: 48400 - DNA, 20 bp, Chlamydia trachomatis
aataggcccgtttttagcgt

SEQ ID NO: 48401 - DNA, 20 bp, Chlamydia trachomatis
ataggcccgtttttagcgta

SEQ ID NO: 48402 - DNA, 20 bp, Chlamydia trachomatis
ttagcgtaatagctctgcag

SEQ ID NO: 48403 - DNA, 20 bp, Chlamydia trachomatis
ctacatcgccgatagcttga

SEQ ID NO: 48404 - DNA, 20 bp, Chlamydia trachomatis
atgaagctaaaccaacccga

SEQ ID NO: 48405 - DNA, 20 bp, Chlamydia trachomatis
agattcttcgggttggttta

SEQ ID NO: 48406 - DNA, 20 bp, Chlamydia trachomatis
ttcgggttggtttagcttca

SEQ ID NO: 48407 - DNA, 20 bp, Chlamydia trachomatis
gggttggtttagcttcatca

SEQ ID NO: 48408 - DNA, 20 bp, Chlamydia trachomatis
tcccagacaaagaagctgct

SEQ ID NO: 48409 - DNA, 20 bp, Chlamydia trachomatis
cccagacaaagaagctgctc

SEQ ID NO: 48410 - DNA, 20 bp, Chlamydia trachomatis
ccagacaaagaagctgctct

SEQ ID NO: 48411 - DNA, 20 bp, Chlamydia trachomatis
cctatttttctcaaaatccc

SEQ ID NO: 48412 - DNA, 20 bp, Chlamydia trachomatis
ttctcaaaatccctttaaag

SEQ ID NO: 48413 - DNA, 20 bp, Chlamydia trachomatis
ttttcatcgtgtaatttatg

SEQ ID NO: 48414 - DNA, 20 bp, Chlamydia trachomatis
tcatcgtgtaatttatgtat

SEQ ID NO: 48415 - DNA, 20 bp, Chlamydia trachomatis
catcgtgtaatttatgtatc

SEQ ID NO: 48416 - DNA, 20 bp, Chlamydia trachomatis
atcgtgtaatttatgtatcc

SEQ ID NO: 48417 - DNA, 20 bp, Chlamydia trachomatis
atgtatccgcaactcctgga

SEQ ID NO: 48418 - DNA, 20 bp, Chlamydia trachomatis
gagacgacctatttgtgacg

SEQ ID NO: 48419 - DNA, 20 bp, Chlamydia trachomatis
gtgacgaattctgcattgat

SEQ ID NO: 48420 - DNA, 20 bp, Chlamydia trachomatis
tgacgaattctgcattgatt

SEQ ID NO: 48421 - DNA, 20 bp, Chlamydia trachomatis
tgcattgattgctgaaggaa

SEQ ID NO: 48422 - DNA, 20 bp, Chlamydia trachomatis
attgctgaaggaatcgctca

SEQ ID NO: 48423 - DNA, 20 bp, Chlamydia trachomatis
cggcaatccacttcgatagc

SEQ ID NO: 48424 - DNA, 20 bp, Chlamydia trachomatis
ggcaatccacttcgatagcc

SEQ ID NO: 48425 - DNA, 20 bp, Chlamydia trachomatis
gatagcctggtggaggggcc

SEQ ID NO: 48426 - DNA, 20 bp, Chlamydia trachomatis
cgtaatctatgggattcgga

SEQ ID NO: 48427 - DNA, 20 bp, Chlamydia trachomatis
ggcgttgtatccgaatccca

SEQ ID NO: 48428 - DNA, 20 bp, Chlamydia trachomatis
acgaagaacctgggagacaa

SEQ ID NO: 48429 - DNA, 20 bp, Chlamydia trachomatis
aatggttgtcttgcggtgca

SEQ ID NO: 48430 - DNA, 20 bp, Chlamydia trachomatis
tcttgcggtgcatcttgtct

SEQ ID NO: 48431 - DNA, 20 bp, Chlamydia trachomatis
cggtgcatcttgtctcccag

SEQ ID NO: 48432 - DNA, 20 bp, Chlamydia trachomatis
tctcccaggttcttcgtcaa

SEQ ID NO: 48433 - DNA, 20 bp, Chlamydia trachomatis
cgctcgcaactaacagtcat

SEQ ID NO: 48434 - DNA, 20 bp, Chlamydia trachomatis
cgctgctcttacaagacggt

SEQ ID NO: 48435 - DNA, 20 bp, Chlamydia trachomatis
taagagcagcggaactatat

SEQ ID NO: 48436 - DNA, 20 bp, Chlamydia trachomatis
gggtgttgcgcatggatgac

SEQ ID NO: 48437 - DNA, 20 bp, Chlamydia trachomatis
cgcatggatgactgttagtt

SEQ ID NO: 48438 - DNA, 20 bp, Chlamydia trachomatis
ggacgatccagaacaattaa

SEQ ID NO: 48439 - DNA, 20 bp, Chlamydia trachomatis
attccttcttgctgctcgca

SEQ ID NO: 48440 - DNA, 20 bp, Chlamydia trachomatis
cttcttgctgctcgcagatg

SEQ ID NO: 48441 - DNA, 20 bp, Chlamydia trachomatis
ttgctgctcgcagatgcttt

SEQ ID NO: 48442 - DNA, 20 bp, Chlamydia trachomatis
ctgctcgcagatgcttttac

SEQ ID NO: 48443 - DNA, 20 bp, Chlamydia trachomatis
cctagaagatctagctctaa

SEQ ID NO: 48444 - DNA, 20 bp, Chlamydia trachomatis
ctagaagatctagctctaaa

SEQ ID NO: 48445 - DNA, 20 bp, Chlamydia trachomatis
cgcagatgaaacagcaagtt

SEQ ID NO: 48446 - DNA, 20 bp, Chlamydia trachomatis
ccatgatcgcctcaagctca

SEQ ID NO: 48447 - DNA, 20 bp, Chlamydia trachomatis
actgttatggatcgtcatga

SEQ ID NO: 48448 - DNA, 20 bp, Chlamydia trachomatis
ggcttgaataaagacttctc

SEQ ID NO: 48449 - DNA, 20 bp, Chlamydia trachomatis
gcttgaataaagacttctcg

SEQ ID NO: 48450 - DNA, 20 bp, Chlamydia trachomatis
aataaagacttctcgagctt

SEQ ID NO: 48451 - DNA, 20 bp, Chlamydia trachomatis
tcgagcttgtcccaattgct

SEQ ID NO: 48452 - DNA, 20 bp, Chlamydia trachomatis
tcccaattgctccaccaact

SEQ ID NO: 48453 - DNA, 20 bp, Chlamydia trachomatis
ctttgcagcatctttgactt

SEQ ID NO: 48454 - DNA, 20 bp, Chlamydia trachomatis
gcagcatctttgacttgctg

SEQ ID NO: 48455 - DNA, 20 bp, Chlamydia trachomatis
cagcatctttgacttgctgg

SEQ ID NO: 48456 - DNA, 20 bp, Chlamydia trachomatis
gacttgctggctcaggcttt

SEQ ID NO: 48457 - DNA, 20 bp, Chlamydia trachomatis
acttgctggctcaggctttc

SEQ ID NO: 48458 - DNA, 20 bp, Chlamydia trachomatis
tctcaggacttccttctaat

SEQ ID NO: 48459 - DNA, 20 bp, Chlamydia trachomatis
cttctaatatcatcagcgga

SEQ ID NO: 48460 - DNA, 20 bp, Chlamydia trachomatis
taatatcatcagcggaggac

SEQ ID NO: 48461 - DNA, 20 bp, Chlamydia trachomatis
cccgtacaagcaagtgtgca

SEQ ID NO: 48462 - DNA, 20 bp, Chlamydia trachomatis
ttggtcagattgcacacttg

SEQ ID NO: 48463 - DNA, 20 bp, Chlamydia trachomatis
ttgcaacgatgataccgcag

SEQ ID NO: 48464 - DNA, 20 bp, Chlamydia trachomatis
caacgatgataccgcagcat

SEQ ID NO: 48465 - DNA, 20 bp, Chlamydia trachomatis
accatttgctgctgctcagc

SEQ ID NO: 48466 - DNA, 20 bp, Chlamydia trachomatis
gctgctgctcagctgttaaa

SEQ ID NO: 48467 - DNA, 20 bp, Chlamydia trachomatis
ctgctgctcagctgttaaaa

SEQ ID NO: 48468 - DNA, 20 bp, Chlamydia trachomatis
taggaaacactccgtgctca

SEQ ID NO: 48469 - DNA, 20 bp, Chlamydia trachomatis
aggaaacactccgtgctcat

SEQ ID NO: 48470 - DNA, 20 bp, Chlamydia trachomatis
ggaaacactccgtgctcata

SEQ ID NO: 48471 - DNA, 20 bp, Chlamydia trachomatis
tggtggttatgacgatgggg

SEQ ID NO: 48472 - DNA, 20 bp, Chlamydia trachomatis
tgacgatggggctattgctt

SEQ ID NO: 48473 - DNA, 20 bp, Chlamydia trachomatis
tattcgcacggaatacatca

SEQ ID NO: 48474 - DNA, 20 bp, Chlamydia trachomatis
gcacggaatacatcagatac

SEQ ID NO: 48475 - DNA, 20 bp, Chlamydia trachomatis
cgtgcgaatacaacagttac

SEQ ID NO: 48476 - DNA, 20 bp, Chlamydia trachomatis
cctgtccatttatttggtct

SEQ ID NO: 48477 - DNA, 20 bp, Chlamydia trachomatis
atttggtcttggagtcttca

SEQ ID NO: 48478 - DNA, 20 bp, Chlamydia trachomatis
gttttcgatgaccggatggc

SEQ ID NO: 48479 - DNA, 20 bp, Chlamydia trachomatis
ttttcgatgaccggatggct

SEQ ID NO: 48480 - DNA, 20 bp, Chlamydia trachomatis
tcgatgaccggatggctatg

SEQ ID NO: 48481 - DNA, 20 bp, Chlamydia trachomatis
cgatgaccggatggctatgc

SEQ ID NO: 48482 - DNA, 20 bp, Chlamydia trachomatis
gatgaccggatggctatgcc

SEQ ID NO: 48483 - DNA, 20 bp, Chlamydia trachomatis
ccgtctgttggagaatttcc

SEQ ID NO: 48484 - DNA, 20 bp, Chlamydia trachomatis
gagaatttcctgcgatcttt

SEQ ID NO: 48485 - DNA, 20 bp, Chlamydia trachomatis
cctgcgatcttttgtctaat

SEQ ID NO: 48486 - DNA, 20 bp, Chlamydia trachomatis
ctgcgatcttttgtctaatt

SEQ ID NO: 48487 - DNA, 20 bp, Chlamydia trachomatis
tgtctaattcttggattttt

SEQ ID NO: 48488 - DNA, 20 bp, Chlamydia trachomatis
ctttgcttatgcacctaagt

SEQ ID NO: 48489 - DNA, 20 bp, Chlamydia trachomatis
gcttatgcacctaagtgaag

SEQ ID NO: 48490 - DNA, 20 bp, Chlamydia trachomatis
cttatgcacctaagtgaagg

SEQ ID NO: 48491 - DNA, 20 bp, Chlamydia trachomatis
tgcacctaagtgaaggaaac

SEQ ID NO: 48492 - DNA, 20 bp, Chlamydia trachomatis
gtttttcatcaaggtggttg

SEQ ID NO: 48493 - DNA, 20 bp, Chlamydia trachomatis
tctcttttgctttgttaagg

SEQ ID NO: 48494 - DNA, 20 bp, Chlamydia trachomatis
ctcttttgctttgttaaggc

SEQ ID NO: 48495 - DNA, 20 bp, Chlamydia trachomatis
tcttttgctttgttaaggca

SEQ ID NO: 48496 - DNA, 20 bp, Chlamydia trachomatis
tgctttgttaaggcaagagc

SEQ ID NO: 48497 - DNA, 20 bp, Chlamydia trachomatis
gctttgttaaggcaagagca

SEQ ID NO: 48498 - DNA, 20 bp, Chlamydia trachomatis
ttctttgcagtaggccatgg

SEQ ID NO: 48499 - DNA, 20 bp, Chlamydia trachomatis
tctttgcagtaggccatggg

SEQ ID NO: 48500 - DNA, 20 bp, Chlamydia trachomatis
ctttgcagtaggccatgggg

SEQ ID NO: 48501 - DNA, 20 bp, Chlamydia trachomatis
tttgcagtaggccatgggga

SEQ ID NO: 48502 - DNA, 20 bp, Chlamydia trachomatis
gcagtaggccatggggatgg

SEQ ID NO: 48503 - DNA, 20 bp, Chlamydia trachomatis
agccgacatacgacggtaag

SEQ ID NO: 48504 - DNA, 20 bp, Chlamydia trachomatis
gcgggattttctgatttccc

SEQ ID NO: 48505 - DNA, 20 bp, Chlamydia trachomatis
tctgatttcccttaccgtcg

SEQ ID NO: 48506 - DNA, 20 bp, Chlamydia trachomatis
ctgatttcccttaccgtcgt

SEQ ID NO: 48507 - DNA, 20 bp, Chlamydia trachomatis
tgatttcccttaccgtcgta

SEQ ID NO: 48508 - DNA, 20 bp, Chlamydia trachomatis
agaatttatcaatgatcaac

SEQ ID NO: 48509 - DNA, 20 bp, Chlamydia trachomatis
gaatttatcaatgatcaact

SEQ ID NO: 48510 - DNA, 20 bp, Chlamydia trachomatis
atcaatgatcaactgcagtc

SEQ ID NO: 48511 - DNA, 20 bp, Chlamydia trachomatis
tcaatgatcaactgcagtcg

SEQ ID NO: 48512 - DNA, 20 bp, Chlamydia trachomatis
attgtgtgcgataggctttc

SEQ ID NO: 48513 - DNA, 20 bp, Chlamydia trachomatis
gatagaacgcatatcagaaa

SEQ ID NO: 48514 - DNA, 20 bp, Chlamydia trachomatis
ttgtacccaaaagaacaacc

SEQ ID NO: 48515 - DNA, 20 bp, Chlamydia trachomatis
tacccaaaagaacaaccgcg

SEQ ID NO: 48516 - DNA, 20 bp, Chlamydia trachomatis
agatgattttgttatttcct

SEQ ID NO: 48517 - DNA, 20 bp, Chlamydia trachomatis
tgttatttcctgtggacagc

SEQ ID NO: 48518 - DNA, 20 bp, Chlamydia trachomatis
gccttcggcaacaaaaatcg

SEQ ID NO: 48519 - DNA, 20 bp, Chlamydia trachomatis
ccttcggcaacaaaaatcgt

SEQ ID NO: 48520 - DNA, 20 bp, Chlamydia trachomatis
ggcaacaaaaatcgttgctg

SEQ ID NO: 48521 - DNA, 20 bp, Chlamydia trachomatis
ctgaagtagctcgctattct

SEQ ID NO: 48522 - DNA, 20 bp, Chlamydia trachomatis
agcaacgatttttgttgccg

SEQ ID NO: 48523 - DNA, 20 bp, Chlamydia trachomatis
ttgttagcaacaaaatcggt

SEQ ID NO: 48524 - DNA, 20 bp, Chlamydia trachomatis
ttagcaacaaaatcggtttc

SEQ ID NO: 48525 - DNA, 20 bp, Chlamydia trachomatis
gcaacaaaatcggtttcaac

SEQ ID NO: 48526 - DNA, 20 bp, Chlamydia trachomatis
caacgttaacttcaacaagc

SEQ ID NO: 48527 - DNA, 20 bp, Chlamydia trachomatis
aacgttaacttcaacaagcg

SEQ ID NO: 48528 - DNA, 20 bp, Chlamydia trachomatis
tcctgttggaagaggaagct

SEQ ID NO: 48529 - DNA, 20 bp, Chlamydia trachomatis
gaagaggaagctcttcaaca

SEQ ID NO: 48530 - DNA, 20 bp, Chlamydia trachomatis
aacagcttcttccgcaggtc

SEQ ID NO: 48531 - DNA, 20 bp, Chlamydia trachomatis
ttccgcaggtctttctgcag

SEQ ID NO: 48532 - DNA, 20 bp, Chlamydia trachomatis
cgcaggtctttctgcaggac

SEQ ID NO: 48533 - DNA, 20 bp, Chlamydia trachomatis
tcctgatttagtgaagcgct

SEQ ID NO: 48534 - DNA, 20 bp, Chlamydia trachomatis
agtgaagcgctatttaggat

SEQ ID NO: 48535 - DNA, 20 bp, Chlamydia trachomatis
gtgaagcgctatttaggatc

SEQ ID NO: 48536 - DNA, 20 bp, Chlamydia trachomatis
aggatccgtagtgccagctc

SEQ ID NO: 48537 - DNA, 20 bp, Chlamydia trachomatis
ggatccgtagtgccagctcg

SEQ ID NO: 48538 - DNA, 20 bp, Chlamydia trachomatis
ttgtatcataacgcataatc

SEQ ID NO: 48539 - DNA, 20 bp, Chlamydia trachomatis
tgtatcataacgcataatcc

SEQ ID NO: 48540 - DNA, 20 bp, Chlamydia trachomatis
gtatcataacgcataatcct

SEQ ID NO: 48541 - DNA, 20 bp, Chlamydia trachomatis
tatcataacgcataatccta

SEQ ID NO: 48542 - DNA, 20 bp, Chlamydia trachomatis
ggtgatctcctgcagccaga

SEQ ID NO: 48543 - DNA, 20 bp, Chlamydia trachomatis
atttgctgtagacggagctc

SEQ ID NO: 48544 - DNA, 20 bp, Chlamydia trachomatis
tttgctgtagacggagctca

SEQ ID NO: 48545 - DNA, 20 bp, Chlamydia trachomatis
gctgtagacggagctcaagg

SEQ ID NO: 48546 - DNA, 20 bp, Chlamydia trachomatis
ctgtagacggagctcaagga

SEQ ID NO: 48547 - DNA, 20 bp, Chlamydia trachomatis
ggaaagggcctcttaatctt

SEQ ID NO: 48548 - DNA, 20 bp, Chlamydia trachomatis
tgcaatcgacctctgggcct

SEQ ID NO: 48549 - DNA, 20 bp, Chlamydia trachomatis
cgaaggccatacggtatctt

SEQ ID NO: 48550 - DNA, 20 bp, Chlamydia trachomatis
tcgaggaggatttcaaggga

SEQ ID NO: 48551 - DNA, 20 bp, Chlamydia trachomatis
aaatcctcctcgagaagata

SEQ ID NO: 48552 - DNA, 20 bp, Chlamydia trachomatis
gtaattaggcccagaggtcg

SEQ ID NO: 48553 - DNA, 20 bp, Chlamydia trachomatis
cgaagatcgattagtaaata

SEQ ID NO: 48554 - DNA, 20 bp, Chlamydia trachomatis
gtaaataatgatgctccggt

SEQ ID NO: 48555 - DNA, 20 bp, Chlamydia trachomatis
ttgatgatgctgtagacgat

SEQ ID NO: 48556 - DNA, 20 bp, Chlamydia trachomatis
atgatgctgtagacgatatt

SEQ ID NO: 48557 - DNA, 20 bp, Chlamydia trachomatis
aatatcgtctacagcatcat

SEQ ID NO: 48558 - DNA, 20 bp, Chlamydia trachomatis
gatggggcgtcctaagagca

SEQ ID NO: 48559 - DNA, 20 bp, Chlamydia trachomatis
atacccagcattgcgtaatt

SEQ ID NO: 48560 - DNA, 20 bp, Chlamydia trachomatis
ttcggaaattacgcaatgct

SEQ ID NO: 48561 - DNA, 20 bp, Chlamydia trachomatis
ggaaattacgcaatgctggg

SEQ ID NO: 48562 - DNA, 20 bp, Chlamydia trachomatis
cgcaatgctgggtatcaagc

SEQ ID NO: 48563 - DNA, 20 bp, Chlamydia trachomatis
tgcgagaacgctttgccagt

SEQ ID NO: 48564 - DNA, 20 bp, Chlamydia trachomatis
gcgagaacgctttgccagta

SEQ ID NO: 48565 - DNA, 20 bp, Chlamydia trachomatis
cgagaacgctttgccagtat

SEQ ID NO: 48566 - DNA, 20 bp, Chlamydia trachomatis
gccagtattccgaaattatg

SEQ ID NO: 48567 - DNA, 20 bp, Chlamydia trachomatis
ccagtattccgaaattatgc

SEQ ID NO: 48568 - DNA, 20 bp, Chlamydia trachomatis
aggcaacgttaagaggctat

SEQ ID NO: 48569 - DNA, 20 bp, Chlamydia trachomatis
agaggctatcagaaagaagg

SEQ ID NO: 48570 - DNA, 20 bp, Chlamydia trachomatis
gttagagcgtctgcgtaaga

SEQ ID NO: 48571 - DNA, 20 bp, Chlamydia trachomatis
gagcgtctgcgtaagatgca

SEQ ID NO: 48572 - DNA, 20 bp, Chlamydia trachomatis
atggaattcttgcagatgac

SEQ ID NO: 48573 - DNA, 20 bp, Chlamydia trachomatis
agcagcttacaacatttgaa

SEQ ID NO: 48574 - DNA, 20 bp, Chlamydia trachomatis
caacatttgaaagtgctgtg

SEQ ID NO: 48575 - DNA, 20 bp, Chlamydia trachomatis
gaaagtgctgtgattgaagg

SEQ ID NO: 48576 - DNA, 20 bp, Chlamydia trachomatis
aaagtgctgtgattgaaggt

SEQ ID NO: 48577 - DNA, 20 bp, Chlamydia trachomatis
aaggtgggcgtaatggtgtg

SEQ ID NO: 48578 - DNA, 20 bp, Chlamydia trachomatis
gactgtacttcaatcatccc

SEQ ID NO: 48579 - DNA, 20 bp, Chlamydia trachomatis
aatcatcccgtccgtaactt

SEQ ID NO: 48580 - DNA, 20 bp, Chlamydia trachomatis
tgattcagaattgagaggtt

SEQ ID NO: 48581 - DNA, 20 bp, Chlamydia trachomatis
agaattgagaggttccgagg

SEQ ID NO: 48582 - DNA, 20 bp, Chlamydia trachomatis
agaggttccgaggtgaagtc

SEQ ID NO: 48583 - DNA, 20 bp, Chlamydia trachomatis
aaaatattaagcagtcgaaa

SEQ ID NO: 48584 - DNA, 20 bp, Chlamydia trachomatis
agcagtcgaaagacaagagg

SEQ ID NO: 48585 - DNA, 20 bp, Chlamydia trachomatis
gcctcaataaatttttggca

SEQ ID NO: 48586 - DNA, 20 bp, Chlamydia trachomatis
ttggcatcagcaggagttgc

SEQ ID NO: 48587 - DNA, 20 bp, Chlamydia trachomatis
tggcatcagcaggagttgct

SEQ ID NO: 48588 - DNA, 20 bp, Chlamydia trachomatis
tggaccaaaatcttcgcatc

SEQ ID NO: 48589 - DNA, 20 bp, Chlamydia trachomatis
gcatcctgaacaggttaaat

SEQ ID NO: 48590 - DNA, 20 bp, Chlamydia trachomatis
aacctgttcaggatgcgaag

SEQ ID NO: 48591 - DNA, 20 bp, Chlamydia trachomatis
acctgttcaggatgcgaaga

SEQ ID NO: 48592 - DNA, 20 bp, Chlamydia trachomatis
aggatgcgaagattttggtc

SEQ ID NO: 48593 - DNA, 20 bp, Chlamydia trachomatis
tgtctgagcaacaactgttt

SEQ ID NO: 48594 - DNA, 20 bp, Chlamydia trachomatis
gtctgagcaacaactgtttt

SEQ ID NO: 48595 - DNA, 20 bp, Chlamydia trachomatis
tctgagcaacaactgttttt

SEQ ID NO: 48596 - DNA, 20 bp, Chlamydia trachomatis
tttatgcgcaaagccgttgc

SEQ ID NO: 48597 - DNA, 20 bp, Chlamydia trachomatis
ttatgcgcaaagccgttgcc

SEQ ID NO: 48598 - DNA, 20 bp, Chlamydia trachomatis
ttctgtaggaagggttttga

SEQ ID NO: 48599 - DNA, 20 bp, Chlamydia trachomatis
tgtaggaagggttttgaagc

SEQ ID NO: 48600 - DNA, 20 bp, Chlamydia trachomatis
tgaagcttgtggttaaaatc

SEQ ID NO: 48601 - DNA, 20 bp, Chlamydia trachomatis
gaagcttgtggttaaaatcg

SEQ ID NO: 48602 - DNA, 20 bp, Chlamydia trachomatis
aagcttgtggttaaaatcgc

SEQ ID NO: 48603 - DNA, 20 bp, Chlamydia trachomatis
gagcaattacgggatgaaca

SEQ ID NO: 48604 - DNA, 20 bp, Chlamydia trachomatis
agcaattacgggatgaacat

SEQ ID NO: 48605 - DNA, 20 bp, Chlamydia trachomatis
cgggatgaacatctgtgatc

SEQ ID NO: 48606 - DNA, 20 bp, Chlamydia trachomatis
aagagatcacagatgttcat

SEQ ID NO: 48607 - DNA, 20 bp, Chlamydia trachomatis
atcccgtaattgctcaaagt

SEQ ID NO: 48608 - DNA, 20 bp, Chlamydia trachomatis
acgtttatgcgaggagttgc

SEQ ID NO: 48609 - DNA, 20 bp, Chlamydia trachomatis
cgtttatgcgaggagttgca

SEQ ID NO: 48610 - DNA, 20 bp, Chlamydia trachomatis
atgcgaggagttgcaagaaa

SEQ ID NO: 48611 - DNA, 20 bp, Chlamydia trachomatis
tgcgaggagttgcaagaaaa

SEQ ID NO: 48612 - DNA, 20 bp, Chlamydia trachomatis
caagaaaatctgacttcagg

SEQ ID NO: 48613 - DNA, 20 bp, Chlamydia trachomatis
cggctgcccgcataatgatt

SEQ ID NO: 48614 - DNA, 20 bp, Chlamydia trachomatis
ctgttttcccgaaccctgca

SEQ ID NO: 48615 - DNA, 20 bp, Chlamydia trachomatis
tgttttcccgaaccctgcat

SEQ ID NO: 48616 - DNA, 20 bp, Chlamydia trachomatis
tcccgaaccctgcatctcca

SEQ ID NO: 48617 - DNA, 20 bp, Chlamydia trachomatis
cccgaaccctgcatctccac

SEQ ID NO: 48618 - DNA, 20 bp, Chlamydia trachomatis
tagtagaaaaatagttccgt

SEQ ID NO: 48619 - DNA, 20 bp, Chlamydia trachomatis
cgttgtttttgtctacggag

SEQ ID NO: 48620 - DNA, 20 bp, Chlamydia trachomatis
tttttgtctacggaggactt

SEQ ID NO: 48621 - DNA, 20 bp, Chlamydia trachomatis
ttgtctacggaggactttgc

SEQ ID NO: 48622 - DNA, 20 bp, Chlamydia trachomatis
tgtctacggaggactttgct

SEQ ID NO: 48623 - DNA, 20 bp, Chlamydia trachomatis
gaatgttggcttagaggcag

SEQ ID NO: 48624 - DNA, 20 bp, Chlamydia trachomatis
gcttagaggcagcaatcatt

SEQ ID NO: 48625 - DNA, 20 bp, Chlamydia trachomatis
gaggcagcaatcatttaaag

SEQ ID NO: 48626 - DNA, 20 bp, Chlamydia trachomatis
aaagagtgcgtaacagctca

SEQ ID NO: 48627 - DNA, 20 bp, Chlamydia trachomatis
aagagtgcgtaacagctcac

SEQ ID NO: 48628 - DNA, 20 bp, Chlamydia trachomatis
agtttgttcagaaagagaat

SEQ ID NO: 48629 - DNA, 20 bp, Chlamydia trachomatis
gttcagaaagagaatcatcg

SEQ ID NO: 48630 - DNA, 20 bp, Chlamydia trachomatis
ttcagaaagagaatcatcgg

SEQ ID NO: 48631 - DNA, 20 bp, Chlamydia trachomatis
agaaagagaatcatcggctt

SEQ ID NO: 48632 - DNA, 20 bp, Chlamydia trachomatis
cccaaactccatgtgcggca

SEQ ID NO: 48633 - DNA, 20 bp, Chlamydia trachomatis
ttgcctgccatgcgtttcga

SEQ ID NO: 48634 - DNA, 20 bp, Chlamydia trachomatis
tgcctgccatgcgtttcgaa

SEQ ID NO: 48635 - DNA, 20 bp, Chlamydia trachomatis
gcctgccatgcgtttcgaac

SEQ ID NO: 48636 - DNA, 20 bp, Chlamydia trachomatis
cctgccatgcgtttcgaaca

SEQ ID NO: 48637 - DNA, 20 bp, Chlamydia trachomatis
cgaacagcaagagcacaatg

SEQ ID NO: 48638 - DNA, 20 bp, Chlamydia trachomatis
aagcagttggttgggatgga

SEQ ID NO: 48639 - DNA, 20 bp, Chlamydia trachomatis
agcagttggttgggatggaa

SEQ ID NO: 48640 - DNA, 20 bp, Chlamydia trachomatis
gttgggatggaagaggttct

SEQ ID NO: 48641 - DNA, 20 bp, Chlamydia trachomatis
ggatggaagaggttctttta

SEQ ID NO: 48642 - DNA, 20 bp, Chlamydia trachomatis
ttttatgaatcgtagaaaca

SEQ ID NO: 48643 - DNA, 20 bp, Chlamydia trachomatis
tccgctggttgcaaagaggt

SEQ ID NO: 48644 - DNA, 20 bp, Chlamydia trachomatis
ccgctggttgcaaagaggta

SEQ ID NO: 48645 - DNA, 20 bp, Chlamydia trachomatis
cgctggttgcaaagaggtaa

SEQ ID NO: 48646 - DNA, 20 bp, Chlamydia trachomatis
caaagaggtaacaatcactc

SEQ ID NO: 48647 - DNA, 20 bp, Chlamydia trachomatis
tagggagcgaatgttgctgt

SEQ ID NO: 48648 - DNA, 20 bp, Chlamydia trachomatis
ctaggagggaagcagttcca

SEQ ID NO: 48649 - DNA, 20 bp, Chlamydia trachomatis
taggagggaagcagttccac

SEQ ID NO: 48650 - DNA, 20 bp, Chlamydia trachomatis
cactgatttatcctccggtt

SEQ ID NO: 48651 - DNA, 20 bp, Chlamydia trachomatis
atcctccggttccagatcct

SEQ ID NO: 48652 - DNA, 20 bp, Chlamydia trachomatis
tcctccggttccagatccta

SEQ ID NO: 48653 - DNA, 20 bp, Chlamydia trachomatis
gtttcgagtgctttcatcat

SEQ ID NO: 48654 - DNA, 20 bp, Chlamydia trachomatis
cgagtgctttcatcatcgct

SEQ ID NO: 48655 - DNA, 20 bp, Chlamydia trachomatis
gagtgctttcatcatcgcta

SEQ ID NO: 48656 - DNA, 20 bp, Chlamydia trachomatis
catcatcgctagcgacacgc

SEQ ID NO: 48657 - DNA, 20 bp, Chlamydia trachomatis
atcatcgctagcgacacgca

SEQ ID NO: 48658 - DNA, 20 bp, Chlamydia trachomatis
aatgtgaatctcttattgaa

SEQ ID NO: 48659 - DNA, 20 bp, Chlamydia trachomatis
atgtgaatctcttattgaat

SEQ ID NO: 48660 - DNA, 20 bp, Chlamydia trachomatis
ttgaataggagagattttcg

SEQ ID NO: 48661 - DNA, 20 bp, Chlamydia trachomatis
aataggagagattttcgatt

SEQ ID NO: 48662 - DNA, 20 bp, Chlamydia trachomatis
tcgattggggccatctaagg

SEQ ID NO: 48663 - DNA, 20 bp, Chlamydia trachomatis
atgtgtctttttgaataaat

SEQ ID NO: 48664 - DNA, 20 bp, Chlamydia trachomatis
ttgaataaatacacagaaga

SEQ ID NO: 48665 - DNA, 20 bp, Chlamydia trachomatis
tgaataaatacacagaagat

SEQ ID NO: 48666 - DNA, 20 bp, Chlamydia trachomatis
gaataaatacacagaagatc

SEQ ID NO: 48667 - DNA, 20 bp, Chlamydia trachomatis
aataaatacacagaagatcg

SEQ ID NO: 48668 - DNA, 20 bp, Chlamydia trachomatis
tgcgattcggaagaagaggg

SEQ ID NO: 48669 - DNA, 20 bp, Chlamydia trachomatis
gcgattcggaagaagagggt

SEQ ID NO: 48670 - DNA, 20 bp, Chlamydia trachomatis
cgattcggaagaagagggta

SEQ ID NO: 48671 - DNA, 20 bp, Chlamydia trachomatis
ggaagaagagggtatgtgtt

SEQ ID NO: 48672 - DNA, 20 bp, Chlamydia trachomatis
tcctgtggaaattcggggga

SEQ ID NO: 48673 - DNA, 20 bp, Chlamydia trachomatis
ttggttctgtatatacagga

SEQ ID NO: 48674 - DNA, 20 bp, Chlamydia trachomatis
gttctgtatatacaggattt

SEQ ID NO: 48675 - DNA, 20 bp, Chlamydia trachomatis
tgtatatacaggatttttag

SEQ ID NO: 48676 - DNA, 20 bp, Chlamydia trachomatis
ttagctggatcctggttctt

SEQ ID NO: 48677 - DNA, 20 bp, Chlamydia trachomatis
tagctggatcctggttcttc

SEQ ID NO: 48678 - DNA, 20 bp, Chlamydia trachomatis
ggtgtgccgcgtatacaggg

SEQ ID NO: 48679 - DNA, 20 bp, Chlamydia trachomatis
cgagcttcctggttttcctc

SEQ ID NO: 48680 - DNA, 20 bp, Chlamydia trachomatis
ctggttttcctctcttaata

SEQ ID NO: 48681 - DNA, 20 bp, Chlamydia trachomatis
tcctctcttaatagcttgcc

SEQ ID NO: 48682 - DNA, 20 bp, Chlamydia trachomatis
cctctcttaatagcttgcct

SEQ ID NO: 48683 - DNA, 20 bp, Chlamydia trachomatis
ttgcgcactctccggaagac

SEQ ID NO: 48684 - DNA, 20 bp, Chlamydia trachomatis
cgcactctccggaagactta

SEQ ID NO: 48685 - DNA, 20 bp, Chlamydia trachomatis
ttagcagcagctgataagct

SEQ ID NO: 48686 - DNA, 20 bp, Chlamydia trachomatis
gcagcagctgataagctact

SEQ ID NO: 48687 - DNA, 20 bp, Chlamydia trachomatis
tcagctgctgctaataagtc

SEQ ID NO: 48688 - DNA, 20 bp, Chlamydia trachomatis
tcaggaaaatattcgtgacg

SEQ ID NO: 48689 - DNA, 20 bp, Chlamydia trachomatis
gtgacgtactagctaagcag

SEQ ID NO: 48690 - DNA, 20 bp, Chlamydia trachomatis
ggcctttcatacattgctct

SEQ ID NO: 48691 - DNA, 20 bp, Chlamydia trachomatis
catacattgctctagatgga

SEQ ID NO: 48692 - DNA, 20 bp, Chlamydia trachomatis
atacattgctctagatggaa

SEQ ID NO: 48693 - DNA, 20 bp, Chlamydia trachomatis
ttacacagggtattacaggg

SEQ ID NO: 48694 - DNA, 20 bp, Chlamydia trachomatis
cacagggtattacagggaaa

SEQ ID NO: 48695 - DNA, 20 bp, Chlamydia trachomatis
cagggaaagcagggtctttt

SEQ ID NO: 48696 - DNA, 20 bp, Chlamydia trachomatis
tcacactacacaatgtgtcg

SEQ ID NO: 48697 - DNA, 20 bp, Chlamydia trachomatis
cacactacacaatgtgtcgc

SEQ ID NO: 48698 - DNA, 20 bp, Chlamydia trachomatis
gctacttgttacaaattgga

SEQ ID NO: 48699 - DNA, 20 bp, Chlamydia trachomatis
ttacaaattggaaaaagtgt

SEQ ID NO: 48700 - DNA, 20 bp, Chlamydia trachomatis
caaattggaaaaagtgtacg

SEQ ID NO: 48701 - DNA, 20 bp, Chlamydia trachomatis
gaaaaagtgtacggagcttt

SEQ ID NO: 48702 - DNA, 20 bp, Chlamydia trachomatis
ggtgacggatgttgttaaag

SEQ ID NO: 48703 - DNA, 20 bp, Chlamydia trachomatis
ctccaaggaattcgtgatat

SEQ ID NO: 48704 - DNA, 20 bp, Chlamydia trachomatis
gtgatatggctgcgggagat

SEQ ID NO: 48705 - DNA, 20 bp, Chlamydia trachomatis
ctcagaagaggatgtgcatg

SEQ ID NO: 48706 - DNA, 20 bp, Chlamydia trachomatis
tcagaagaggatgtgcatga

SEQ ID NO: 48707 - DNA, 20 bp, Chlamydia trachomatis
cttcatgcacatcctcttct

SEQ ID NO: 48708 - DNA, 20 bp, Chlamydia trachomatis
ttcaggctttagaagcagct

SEQ ID NO: 48709 - DNA, 20 bp, Chlamydia trachomatis
tcaggctttagaagcagctt

SEQ ID NO: 48710 - DNA, 20 bp, Chlamydia trachomatis
caggctttagaagcagcttt

SEQ ID NO: 48711 - DNA, 20 bp, Chlamydia trachomatis
aggctttagaagcagctttt

SEQ ID NO: 48712 - DNA, 20 bp, Chlamydia trachomatis
agaagcagcttttcgagaca

SEQ ID NO: 48713 - DNA, 20 bp, Chlamydia trachomatis
cttgacgttgtatataagga

SEQ ID NO: 48714 - DNA, 20 bp, Chlamydia trachomatis
acgttgtatataaggaagcg

SEQ ID NO: 48715 - DNA, 20 bp, Chlamydia trachomatis
tatataaggaagcgttaggg

SEQ ID NO: 48716 - DNA, 20 bp, Chlamydia trachomatis
gggaaatcgaaatatgctga

SEQ ID NO: 48717 - DNA, 20 bp, Chlamydia trachomatis
agaacaagcacatcgcgatc

SEQ ID NO: 48718 - DNA, 20 bp, Chlamydia trachomatis
cgttcgataatcgttaagcg

SEQ ID NO: 48719 - DNA, 20 bp, Chlamydia trachomatis
gataatcgttaagcgagcaa

SEQ ID NO: 48720 - DNA, 20 bp, Chlamydia trachomatis
agcgagcaagagttgtggtt

SEQ ID NO: 48721 - DNA, 20 bp, Chlamydia trachomatis
tggttcgaatggtcgcatcg

SEQ ID NO: 48722 - DNA, 20 bp, Chlamydia trachomatis
gaatggtcgcatcgagcaaa

SEQ ID NO: 48723 - DNA, 20 bp, Chlamydia trachomatis
ttagcaaaaggacaaaacaa

SEQ ID NO: 48724 - DNA, 20 bp, Chlamydia trachomatis
gcaaaaggacaaaacaaagt

SEQ ID NO: 48725 - DNA, 20 bp, Chlamydia trachomatis
tgcggatgtagcagggatag

SEQ ID NO: 48726 - DNA, 20 bp, Chlamydia trachomatis
gcggatgtagcagggataga

SEQ ID NO: 48727 - DNA, 20 bp, Chlamydia trachomatis
cggatgtagcagggatagag

SEQ ID NO: 48728 - DNA, 20 bp, Chlamydia trachomatis
aactggcctttttcgttaat

SEQ ID NO: 48729 - DNA, 20 bp, Chlamydia trachomatis
ttcgttaatgctaaggagtt

SEQ ID NO: 48730 - DNA, 20 bp, Chlamydia trachomatis
tcgttaatgctaaggagttt

SEQ ID NO: 48731 - DNA, 20 bp, Chlamydia trachomatis
cgttaatgctaaggagttta

SEQ ID NO: 48732 - DNA, 20 bp, Chlamydia trachomatis
gttaatgctaaggagtttaa

SEQ ID NO: 48733 - DNA, 20 bp, Chlamydia trachomatis
cgatttttgaggtattgatc

SEQ ID NO: 48734 - DNA, 20 bp, Chlamydia trachomatis
ttgaggtattgatctgcata

SEQ ID NO: 48735 - DNA, 20 bp, Chlamydia trachomatis
tgaggtattgatctgcatag

SEQ ID NO: 48736 - DNA, 20 bp, Chlamydia trachomatis
gaggtattgatctgcatagt

SEQ ID NO: 48737 - DNA, 20 bp, Chlamydia trachomatis
aggtattgatctgcatagtt

SEQ ID NO: 48738 - DNA, 20 bp, Chlamydia trachomatis
agagccctgtctcatgtgtg

SEQ ID NO: 48739 - DNA, 20 bp, Chlamydia trachomatis
gagccctgtctcatgtgtgc

SEQ ID NO: 48740 - DNA, 20 bp, Chlamydia trachomatis
agttagcacgtattcctaga

SEQ ID NO: 48741 - DNA, 20 bp, Chlamydia trachomatis
gcacgtattcctagaattgt

SEQ ID NO: 48742 - DNA, 20 bp, Chlamydia trachomatis
ctagaattgtttggggggct

SEQ ID NO: 48743 - DNA, 20 bp, Chlamydia trachomatis
aactttctggtccgaagaaa

SEQ ID NO: 48744 - DNA, 20 bp, Chlamydia trachomatis
ctggtccgaagaaagcttgg

SEQ ID NO: 48745 - DNA, 20 bp, Chlamydia trachomatis
tggtccgaagaaagcttggg

SEQ ID NO: 48746 - DNA, 20 bp, Chlamydia trachomatis
ggtgcttccaattaaccata

SEQ ID NO: 48747 - DNA, 20 bp, Chlamydia trachomatis
caattaaccatagaaaggcc

SEQ ID NO: 48748 - DNA, 20 bp, Chlamydia trachomatis
ctttataaaagaggatgaaa

SEQ ID NO: 48749 - DNA, 20 bp, Chlamydia trachomatis
ataaaagaggatgaaatcca

SEQ ID NO: 48750 - DNA, 20 bp, Chlamydia trachomatis
taaaagaggatgaaatccaa

SEQ ID NO: 48751 - DNA, 20 bp, Chlamydia trachomatis
cgcatgagtaggcgttgcgt

SEQ ID NO: 48752 - DNA, 20 bp, Chlamydia trachomatis
cgtgatctcaaggctgcgaa

SEQ ID NO: 48753 - DNA, 20 bp, Chlamydia trachomatis
tttggggtcaggacctcgtt

SEQ ID NO: 48754 - DNA, 20 bp, Chlamydia trachomatis
ttggggtcaggacctcgttg

SEQ ID NO: 48755 - DNA, 20 bp, Chlamydia trachomatis
tggggtcaggacctcgttgt

SEQ ID NO: 48756 - DNA, 20 bp, Chlamydia trachomatis
ggggtcaggacctcgttgtg

SEQ ID NO: 48757 - DNA, 20 bp, Chlamydia trachomatis
gggtcaggacctcgttgtgg

SEQ ID NO: 48758 - DNA, 20 bp, Chlamydia trachomatis
aataaaagtgcctagtccgg

SEQ ID NO: 48759 - DNA, 20 bp, Chlamydia trachomatis
ataaaagtgcctagtccggc

SEQ ID NO: 48760 - DNA, 20 bp, Chlamydia trachomatis
actatcacattgatggctgg

SEQ ID NO: 48761 - DNA, 20 bp, Chlamydia trachomatis
ctatcacattgatggctggg

SEQ ID NO: 48762 - DNA, 20 bp, Chlamydia trachomatis
atggctgggatcttcctcat

SEQ ID NO: 48763 - DNA, 20 bp, Chlamydia trachomatis
gcgtttttcatcaccaattc

SEQ ID NO: 48764 - DNA, 20 bp, Chlamydia trachomatis
ttcatcaccaattcgcgatc

SEQ ID NO: 48765 - DNA, 20 bp, Chlamydia trachomatis
tcatcaccaattcgcgatcg

SEQ ID NO: 48766 - DNA, 20 bp, Chlamydia trachomatis
catcaccaattcgcgatcgg

SEQ ID NO: 48767 - DNA, 20 bp, Chlamydia trachomatis
atcaccaattcgcgatcggt

SEQ ID NO: 48768 - DNA, 20 bp, Chlamydia trachomatis
gattcactctcctcatggtg

SEQ ID NO: 48769 - DNA, 20 bp, Chlamydia trachomatis
actctcctcatggtgagggg

SEQ ID NO: 48770 - DNA, 20 bp, Chlamydia trachomatis
gcgtatgccgcatattttaa

SEQ ID NO: 48771 - DNA, 20 bp, Chlamydia trachomatis
cgtatgccgcatattttaac

SEQ ID NO: 48772 - DNA, 20 bp, Chlamydia trachomatis
taacgcgtatcgatatttct

SEQ ID NO: 48773 - DNA, 20 bp, Chlamydia trachomatis
ctgaaggtgtaggagatttg

SEQ ID NO: 48774 - DNA, 20 bp, Chlamydia trachomatis
ggctaccatagctccttcta

SEQ ID NO: 48775 - DNA, 20 bp, Chlamydia trachomatis
gctaccatagctccttctat

SEQ ID NO: 48776 - DNA, 20 bp, Chlamydia trachomatis
tatcagggctccacagttac

SEQ ID NO: 48777 - DNA, 20 bp, Chlamydia trachomatis
cagaaatcgatgagaagctt

SEQ ID NO: 48778 - DNA, 20 bp, Chlamydia trachomatis
cagcgactcccatttctatc

SEQ ID NO: 48779 - DNA, 20 bp, Chlamydia trachomatis
gatagaaatgggagtcgctg

SEQ ID NO: 48780 - DNA, 20 bp, Chlamydia trachomatis
gaggtggcatcctttcctgg

SEQ ID NO: 48781 - DNA, 20 bp, Chlamydia trachomatis
cctggtgttcccttttcgca

SEQ ID NO: 48782 - DNA, 20 bp, Chlamydia trachomatis
ctggtgttcccttttcgcag

SEQ ID NO: 48783 - DNA, 20 bp, Chlamydia trachomatis
tactacttgtgcttgatgga

SEQ ID NO: 48784 - DNA, 20 bp, Chlamydia trachomatis
tgcttgatggagtttggccg

SEQ ID NO: 48785 - DNA, 20 bp, Chlamydia trachomatis
atggagtttggccggtacca

SEQ ID NO: 48786 - DNA, 20 bp, Chlamydia trachomatis
ggccggtaccagtattttgg

SEQ ID NO: 48787 - DNA, 20 bp, Chlamydia trachomatis
gccggtaccagtattttggg

SEQ ID NO: 48788 - DNA, 20 bp, Chlamydia trachomatis
gatggagagggagtagtttt

SEQ ID NO: 48789 - DNA, 20 bp, Chlamydia trachomatis
atggagagggagtagttttc

SEQ ID NO: 48790 - DNA, 20 bp, Chlamydia trachomatis
tctttagtagcaatgtagct

SEQ ID NO: 48791 - DNA, 20 bp, Chlamydia trachomatis
ctttagtagcaatgtagctg

SEQ ID NO: 48792 - DNA, 20 bp, Chlamydia trachomatis
tttagtagcaatgtagctgc

SEQ ID NO: 48793 - DNA, 20 bp, Chlamydia trachomatis
caaatagtttatggggatcc

SEQ ID NO: 48794 - DNA, 20 bp, Chlamydia trachomatis
atggggatccattttagata

SEQ ID NO: 48795 - DNA, 20 bp, Chlamydia trachomatis
tggggatccattttagatat

SEQ ID NO: 48796 - DNA, 20 bp, Chlamydia trachomatis
tagatatacgatctgcgcat

SEQ ID NO: 48797 - DNA, 20 bp, Chlamydia trachomatis
agatatacgatctgcgcatt

SEQ ID NO: 48798 - DNA, 20 bp, Chlamydia trachomatis
atccgtgctagctacgggtt

SEQ ID NO: 48799 - DNA, 20 bp, Chlamydia trachomatis
tccgtgctagctacgggttt

SEQ ID NO: 48800 - DNA, 20 bp, Chlamydia trachomatis
gggaaccagcatatgaaaac

SEQ ID NO: 48801 - DNA, 20 bp, Chlamydia trachomatis
ggaaccagcatatgaaaacc

SEQ ID NO: 48802 - DNA, 20 bp, Chlamydia trachomatis
gcagaggagagcgatgttcg

SEQ ID NO: 48803 - DNA, 20 bp, Chlamydia trachomatis
tatgatcctgtagtacaaaa

SEQ ID NO: 48804 - DNA, 20 bp, Chlamydia trachomatis
atgatcctgtagtacaaaat

SEQ ID NO: 48805 - DNA, 20 bp, Chlamydia trachomatis
tgatcctgtagtacaaaata

SEQ ID NO: 48806 - DNA, 20 bp, Chlamydia trachomatis
agcagcgggtgcatcgacac

SEQ ID NO: 48807 - DNA, 20 bp, Chlamydia trachomatis
ttcttctatgcctggtgctg

SEQ ID NO: 48808 - DNA, 20 bp, Chlamydia trachomatis
tgttttctaacggaatcgag

SEQ ID NO: 48809 - DNA, 20 bp, Chlamydia trachomatis
gttttctaacggaatcgagg

SEQ ID NO: 48810 - DNA, 20 bp, Chlamydia trachomatis
ttttctaacggaatcgaggt

SEQ ID NO: 48811 - DNA, 20 bp, Chlamydia trachomatis
tctaacggaatcgaggtgaa

SEQ ID NO: 48812 - DNA, 20 bp, Chlamydia trachomatis
ctaacggaatcgaggtgaat

SEQ ID NO: 48813 - DNA, 20 bp, Chlamydia trachomatis
cgagacaaagtcgggatctg

SEQ ID NO: 48814 - DNA, 20 bp, Chlamydia trachomatis
gagacaaagtcgggatctgt

SEQ ID NO: 48815 - DNA, 20 bp, Chlamydia trachomatis
cagatgcggttgctctgaaa

SEQ ID NO: 48816 - DNA, 20 bp, Chlamydia trachomatis
ctctgaaacacttctgtcgg

SEQ ID NO: 48817 - DNA, 20 bp, Chlamydia trachomatis
tgtcggagaacttaaatgtg

SEQ ID NO: 48818 - DNA, 20 bp, Influenza A virus
atggaattggacgattctac

SEQ ID NO: 48819 - DNA, 20 bp, Influenza A virus
gacgattctacatccaaatg

SEQ ID NO: 48820 - DNA, 20 bp, Influenza A virus
tacatccaaatgtgcaccga

SEQ ID NO: 48821 - DNA, 20 bp, Influenza A virus
aagttcggtgcacatttgga

SEQ ID NO: 48822 - DNA, 20 bp, Influenza A virus
agttcggtgcacatttggat

SEQ ID NO: 48823 - DNA, 20 bp, Influenza A virus
atgacaaagaagaaataagg

SEQ ID NO: 48824 - DNA, 20 bp, Influenza A virus
tgacaaagaagaaataaggc

SEQ ID NO: 48825 - DNA, 20 bp, Influenza A virus
catcatcaccattattggct

SEQ ID NO: 48826 - DNA, 20 bp, Influenza A virus
ttggcttggcgccagattcg

SEQ ID NO: 48827 - DNA, 20 bp, Influenza A virus
gcttggcgccagattcgcct

SEQ ID NO: 48828 - DNA, 20 bp, Influenza A virus
atcaggatgatcaaacgtgg

SEQ ID NO: 48829 - DNA, 20 bp, Influenza A virus
tggagaggtgagaatggacg

SEQ ID NO: 48830 - DNA, 20 bp, Influenza A virus
tctcgtaagcactccttgtt

SEQ ID NO: 48831 - DNA, 20 bp, Influenza A virus
ttttccgtccattctcacct

SEQ ID NO: 48832 - DNA, 20 bp, Influenza A virus
tccgtccattctcacctctc

SEQ ID NO: 48833 - DNA, 20 bp, Influenza A virus
aactaagaagcaggtactgg

SEQ ID NO: 48834 - DNA, 20 bp, Influenza A virus
attagtgtttcctccacttc

SEQ ID NO: 48835 - DNA, 20 bp, Influenza A virus
gtgtttcctccacttctggt

SEQ ID NO: 48836 - DNA, 20 bp, Influenza A virus
cctccacttctggtccttat

SEQ ID NO: 48837 - DNA, 20 bp, Influenza A virus
ctccacttctggtccttatg

SEQ ID NO: 48838 - DNA, 20 bp, Influenza A virus
caagggggatgtgtttgtca

SEQ ID NO: 48839 - DNA, 20 bp, Influenza A virus
gtcataagggaaccattcat

SEQ ID NO: 48840 - DNA, 20 bp, Influenza A virus
tcataagggaaccattcata

SEQ ID NO: 48841 - DNA, 20 bp, Influenza A virus
atatcatgctcccccttgga

SEQ ID NO: 48842 - DNA, 20 bp, Influenza A virus
caagggggagcatgatatga

SEQ ID NO: 48843 - DNA, 20 bp, Influenza A virus
gctaacaattggaatttctg

SEQ ID NO: 48844 - DNA, 20 bp, Influenza A virus
gaatttctggcccagacaat

SEQ ID NO: 48845 - DNA, 20 bp, Influenza A virus
ctggcccagacaatggggca

SEQ ID NO: 48846 - DNA, 20 bp, Influenza A virus
tggcccagacaatggggcag

SEQ ID NO: 48847 - DNA, 20 bp, Influenza A virus
aagtacaacggcataataac

SEQ ID NO: 48848 - DNA, 20 bp, Influenza A virus
tcactatgaggaatgctcct

SEQ ID NO: 48849 - DNA, 20 bp, Influenza A virus
tcctgattctagtgaaatca

SEQ ID NO: 48850 - DNA, 20 bp, Influenza A virus
tagtgaaatcacatgtgtgt

SEQ ID NO: 48851 - DNA, 20 bp, Influenza A virus
gagccatgccagttatccct

SEQ ID NO: 48852 - DNA, 20 bp, Influenza A virus
tccctgcacacacatgtgat

SEQ ID NO: 48853 - DNA, 20 bp, Influenza A virus
aaatacggcaatggtgtttg

SEQ ID NO: 48854 - DNA, 20 bp, Influenza A virus
ggatagggagaactaaaagc

SEQ ID NO: 48855 - DNA, 20 bp, Influenza A virus
gatagggagaactaaaagca

SEQ ID NO: 48856 - DNA, 20 bp, Influenza A virus
gttcaagaaacggttttgag

SEQ ID NO: 48857 - DNA, 20 bp, Influenza A virus
aagaaacggttttgagatga

SEQ ID NO: 48858 - DNA, 20 bp, Influenza A virus
ttttcaaatgcatttatcgc

SEQ ID NO: 48859 - DNA, 20 bp, Influenza A virus
tttcaaatgcatttatcgct

SEQ ID NO: 48860 - DNA, 20 bp, Influenza A virus
ttcaaatgcatttatcgctt

SEQ ID NO: 48861 - DNA, 20 bp, Influenza A virus
tcaaatgcatttatcgcttc

SEQ ID NO: 48862 - DNA, 20 bp, Influenza A virus
caaatgcatttatcgcttct

SEQ ID NO: 48863 - DNA, 20 bp, Influenza C virus
aaaagcaagtgaacagtagc

SEQ ID NO: 48864 - DNA, 20 bp, Influenza C virus
agcctacacaatggcttcgg

SEQ ID NO: 48865 - DNA, 20 bp, Influenza C virus
ggaggaaatttgtatgccac

SEQ ID NO: 48866 - DNA, 20 bp, Influenza C virus
gtatgccacggaagaaaaaa

SEQ ID NO: 48867 - DNA, 20 bp, Influenza C virus
tatgccacggaagaaaaaag

SEQ ID NO: 48868 - DNA, 20 bp, Influenza C virus
atgttgagtatgtttggacc

SEQ ID NO: 48869 - DNA, 20 bp, Influenza C virus
agtatgtttggaccacctgg

SEQ ID NO: 48870 - DNA, 20 bp, Influenza C virus
ggaccacctgggaaggtaga

SEQ ID NO: 48871 - DNA, 20 bp, Influenza C virus
gaccacctgggaaggtagac

SEQ ID NO: 48872 - DNA, 20 bp, Influenza C virus
accaaggatgtggaaaacat

SEQ ID NO: 48873 - DNA, 20 bp, Influenza C virus
ctttacaagcgactgcaggg

SEQ ID NO: 48874 - DNA, 20 bp, Influenza C virus
acaagcgactgcaggggttg

SEQ ID NO: 48875 - DNA, 20 bp, Influenza C virus
caagcgactgcaggggttgc

SEQ ID NO: 48876 - DNA, 20 bp, Influenza C virus
caaaaaattgcaacaacagc

SEQ ID NO: 48877 - DNA, 20 bp, Influenza C virus
caacaacagcttcttaaaaa

SEQ ID NO: 48878 - DNA, 20 bp, Influenza C virus
atctggaaaagttgttggag

SEQ ID NO: 48879 - DNA, 20 bp, Influenza C virus
ttggaggactagataacagg

SEQ ID NO: 48880 - DNA, 20 bp, Influenza C virus
gaggactagataacagggta

SEQ ID NO: 48881 - DNA, 20 bp, Influenza C virus
cacagggaattctggagaca

SEQ ID NO: 48882 - DNA, 20 bp, Influenza C virus
tggagacaccccaacaatgc

SEQ ID NO: 48883 - DNA, 20 bp, Influenza C virus
ctgtcaggactggactatga

SEQ ID NO: 48884 - DNA, 20 bp, Influenza C virus
attcacccaccctgattgtg

SEQ ID NO: 48885 - DNA, 20 bp, Influenza C virus
acccaccctgattgtgatat

SEQ ID NO: 48886 - DNA, 20 bp, Influenza C virus
tgatatgcatctagcttcat

SEQ ID NO: 48887 - DNA, 20 bp, Influenza C virus
atagtccagtcctgacagca

SEQ ID NO: 48888 - DNA, 20 bp, Influenza C virus
taattcccaccagtggaact

SEQ ID NO: 48889 - DNA, 20 bp, Influenza C virus
ccaccagtggaactgatacc

SEQ ID NO: 48890 - DNA, 20 bp, Influenza C virus
ttggaatcgatgacctcatt

SEQ ID NO: 48891 - DNA, 20 bp, Influenza C virus
tggaatcgatgacctcatta

SEQ ID NO: 48892 - DNA, 20 bp, Influenza C virus
ggaatcgatgacctcattat

SEQ ID NO: 48893 - DNA, 20 bp, Influenza C virus
agaaattgaaaatgcaagat

SEQ ID NO: 48894 - DNA, 20 bp, Influenza C virus
gaaattgaaaatgcaagatc

SEQ ID NO: 48895 - DNA, 20 bp, Influenza C virus
aaaatgcaagatctgaagct

SEQ ID NO: 48896 - DNA, 20 bp, Influenza C virus
gttaggagaattgggaataa

SEQ ID NO: 48897 - DNA, 20 bp, Influenza C virus
ttaggagaattgggaataat

SEQ ID NO: 48898 - DNA, 20 bp, Influenza C virus
caaccattccccctcttgac

SEQ ID NO: 48899 - DNA, 20 bp, Influenza C virus
cccctcttgacacaaaaatt

SEQ ID NO: 48900 - DNA, 20 bp, Influenza C virus
acacaaaaattgatctgcaa

SEQ ID NO: 48901 - DNA, 20 bp, Influenza C virus
atctgcaatcagatcctttt

SEQ ID NO: 48902 - DNA, 20 bp, Influenza C virus
ttactggggaagcagcttgg

SEQ ID NO: 48903 - DNA, 20 bp, Influenza A virus
catggggccaaggaggtgtc

SEQ ID NO: 48904 - DNA, 20 bp, Influenza A virus
aactggtgcacttgccagtt

SEQ ID NO: 48905 - DNA, 20 bp, Influenza A virus
ccagttgcatgggcctcata

SEQ ID NO: 48906 - DNA, 20 bp, Influenza A virus
catgggcctcatatacaaca

SEQ ID NO: 48907 - DNA, 20 bp, Influenza A virus
ccatcctgttgtatatgagg

SEQ ID NO: 48908 - DNA, 20 bp, Influenza A virus
ctaatcagactaggcagatg

SEQ ID NO: 48909 - DNA, 20 bp, Influenza A virus
ggactcatcctagctccagt

SEQ ID NO: 48910 - DNA, 20 bp, Influenza A virus
tcaagaaggtcatctttcag

SEQ ID NO: 48911 - DNA, 20 bp, Influenza A virus
caagaaggtcatctttcaga

SEQ ID NO: 48912 - DNA, 20 bp, Influenza A virus
aagaaggtcatctttcagac

SEQ ID NO: 48913 - DNA, 20 bp, Human papillomavirus type 92
taatacaaacagctagtata

SEQ ID NO: 48914 - DNA, 20 bp, Human papillomavirus type 92
ccatcacaatggcaaaacct

SEQ ID NO: 48915 - DNA, 20 bp, Human papillomavirus type 92
taagttcctgcaccgaagga

SEQ ID NO: 48916 - DNA, 20 bp, Human papillomavirus type 92
ctgcaccgaaggaggttttg

SEQ ID NO: 48917 - DNA, 20 bp, Human papillomavirus type 92
tgccattgtgatgggaacac

SEQ ID NO: 48918 - DNA, 20 bp, Human papillomavirus type 92
tgctggatctgcaagacctt

SEQ ID NO: 48919 - DNA, 20 bp, Human papillomavirus type 92
tccagcccattgacctgcat

SEQ ID NO: 48920 - DNA, 20 bp, Human papillomavirus type 92
acctgcattgtgacgaagac

SEQ ID NO: 48921 - DNA, 20 bp, Human papillomavirus type 92
tgacgaagacttgtcagaaa

SEQ ID NO: 48922 - DNA, 20 bp, Human papillomavirus type 92
tcagaaaatcaggaggagga

SEQ ID NO: 48923 - DNA, 20 bp, Human papillomavirus type 92
gtgtttaatagaagctgatt

SEQ ID NO: 48924 - DNA, 20 bp, Human papillomavirus type 92
aatagaagctgattgtagtg

SEQ ID NO: 48925 - DNA, 20 bp, Human papillomavirus type 92
atagaagctgattgtagtga

SEQ ID NO: 48926 - DNA, 20 bp, Human papillomavirus type 92
tagtgatgtagatggggatt

SEQ ID NO: 48927 - DNA, 20 bp, Human papillomavirus type 92
tgaaaagttatttgacaaag

SEQ ID NO: 48928 - DNA, 20 bp, Human papillomavirus type 92
tacagcttagtccacaattg

SEQ ID NO: 48929 - DNA, 20 bp, Human papillomavirus type 92
acagcttagtccacaattgg

SEQ ID NO: 48930 - DNA, 20 bp, Human papillomavirus type 92
cagcttagtccacaattgga

SEQ ID NO: 48931 - DNA, 20 bp, Human papillomavirus type 92
gtccacaattggaatctatt

SEQ ID NO: 48932 - DNA, 20 bp, Human papillomavirus type 92
gaatctattactatttcgcc

SEQ ID NO: 48933 - DNA, 20 bp, Human papillomavirus type 92
tagctgatccaccccagatt

SEQ ID NO: 48934 - DNA, 20 bp, Human papillomavirus type 92
gcagcgtagtagcagctttg

SEQ ID NO: 48935 - DNA, 20 bp, Human papillomavirus type 92
gttttggtacaaagaatcta

SEQ ID NO: 48936 - DNA, 20 bp, Human papillomavirus type 92
ttttggtacaaagaatctat

SEQ ID NO: 48937 - DNA, 20 bp, Human papillomavirus type 92
tggtacaaagaatctatgaa

SEQ ID NO: 48938 - DNA, 20 bp, Human papillomavirus type 92
caatgcactgcaagacaagt

SEQ ID NO: 48939 - DNA, 20 bp, Human papillomavirus type 92
aatgcactgcaagacaagtt

SEQ ID NO: 48940 - DNA, 20 bp, Human papillomavirus type 92
atgacaatttatgaaagagc

SEQ ID NO: 48941 - DNA, 20 bp, Human papillomavirus type 92
atgaaagagctagtgaatcc

SEQ ID NO: 48942 - DNA, 20 bp, Human papillomavirus type 92
tgaaagagctagtgaatcct

SEQ ID NO: 48943 - DNA, 20 bp, Human papillomavirus type 92
aataaacaatactatatcag

SEQ ID NO: 48944 - DNA, 20 bp, Human papillomavirus type 92
gctcaagacgcacgcagatt

SEQ ID NO: 48945 - DNA, 20 bp, Human papillomavirus type 92
ctcaagacgcacgcagattt

SEQ ID NO: 48946 - DNA, 20 bp, Human papillomavirus type 92
agtgaaactggagaatggga

SEQ ID NO: 48947 - DNA, 20 bp, Human papillomavirus type 92
gtgaaactggagaatgggaa

SEQ ID NO: 48948 - DNA, 20 bp, Human papillomavirus type 92
cggtcgtctttggatccccc

SEQ ID NO: 48949 - DNA, 20 bp, Human papillomavirus type 92
ggtcgtctttggatccccct

SEQ ID NO: 48950 - DNA, 20 bp, Human papillomavirus type 92
ggatccccctggaggcggtt

SEQ ID NO: 48951 - DNA, 20 bp, Human papillomavirus type 92
gatccccctggaggcggttg

SEQ ID NO: 48952 - DNA, 20 bp, Human papillomavirus type 92
tagcaccagagtcttttcgc

SEQ ID NO: 48953 - DNA, 20 bp, Human papillomavirus type 92
ggatcttgacctcctgttgc

SEQ ID NO: 48954 - DNA, 20 bp, Human papillomavirus type 92
gatcttgacctcctgttgct

SEQ ID NO: 48955 - DNA, 20 bp, Human papillomavirus type 92
acctcctgttgctgtaccct

SEQ ID NO: 48956 - DNA, 20 bp, Human papillomavirus type 92
ctgtaccctctacggcctct

SEQ ID NO: 48957 - DNA, 20 bp, Human papillomavirus type 92
ccttccgttcctgctcctgc

SEQ ID NO: 48958 - DNA, 20 bp, Human papillomavirus type 92
tgattgcttcagtactacat

SEQ ID NO: 48959 - DNA, 20 bp, Human papillomavirus type 92
cttcagtactacatggtcat

SEQ ID NO: 48960 - DNA, 20 bp, Human papillomavirus type 92
agtactacatggtcatgggt

SEQ ID NO: 48961 - DNA, 20 bp, Human papillomavirus type 92
tagagcgtcctattctatcg

SEQ ID NO: 48962 - DNA, 20 bp, Human papillomavirus type 92
tatcgttgctacctgcactg

SEQ ID NO: 48963 - DNA, 20 bp, Human papillomavirus type 92
gaaatacacccacagttatt

SEQ ID NO: 48964 - DNA, 20 bp, Human papillomavirus type 92
ttaggcctgctttggtgcct

SEQ ID NO: 48965 - DNA, 20 bp, Human papillomavirus type 92
ggcctgctttggtgcctgag

SEQ ID NO: 48966 - DNA, 20 bp, Human papillomavirus type 92
ggtgcctgaggctataggac

SEQ ID NO: 48967 - DNA, 20 bp, Human papillomavirus type 92
gtgcctgaggctataggacc

SEQ ID NO: 48968 - DNA, 20 bp, Human papillomavirus type 92
gcagacttggcaaacgagct

SEQ ID NO: 48969 - DNA, 20 bp, Human papillomavirus type 92
gcaaacgagctactataagg

SEQ ID NO: 48970 - DNA, 20 bp, Human papillomavirus type 92
tagttccagacctggtcctt

SEQ ID NO: 48971 - DNA, 20 bp, Human papillomavirus type 92
cagacctggtccttatagta

SEQ ID NO: 48972 - DNA, 20 bp, Human papillomavirus type 92
tagtagctcgtttgccaagt

SEQ ID NO: 48973 - DNA, 20 bp, Human papillomavirus type 92
acacagaagattttagtggt

SEQ ID NO: 48974 - DNA, 20 bp, Human papillomavirus type 92
tagtggtgattattatctac

SEQ ID NO: 48975 - DNA, 20 bp, Human papillomavirus type 92
agtggtgattattatctaca

SEQ ID NO: 48976 - DNA, 20 bp, Human papillomavirus type 92
gtggtgattattatctacat

SEQ ID NO: 48977 - DNA, 20 bp, Human papillomavirus type 92
ttatctacatcctagcttaa

SEQ ID NO: 48978 - DNA, 20 bp, Human papillomavirus type 92
atccacatgatgtattagtg

SEQ ID NO: 48979 - DNA, 20 bp, Human papillomavirus type 92
gtgcctaaggtgtcagggaa

SEQ ID NO: 48980 - DNA, 20 bp, Human papillomavirus type 92
agagcttttcgactgaaatt

SEQ ID NO: 48981 - DNA, 20 bp, Human papillomavirus type 92
gagcttttcgactgaaatta

SEQ ID NO: 48982 - DNA, 20 bp, Human papillomavirus type 92
tcgactgaaattaccagatc

SEQ ID NO: 48983 - DNA, 20 bp, Human papillomavirus type 92
tgatccaaagcaaattcagt

SEQ ID NO: 48984 - DNA, 20 bp, Human papillomavirus type 92
gatccaaagcaaattcagtt

SEQ ID NO: 48985 - DNA, 20 bp, Human papillomavirus type 92
atccaaagcaaattcagtta

SEQ ID NO: 48986 - DNA, 20 bp, Human papillomavirus type 92
agttatttgttttaggatgt

SEQ ID NO: 48987 - DNA, 20 bp, Human papillomavirus type 92
tttgttttaggatgtacacc

SEQ ID NO: 48988 - DNA, 20 bp, Human papillomavirus type 92
ttaaagatgtcaaatgatgt

SEQ ID NO: 48989 - DNA, 20 bp, Human papillomavirus type 92
taaagatgtcaaatgatgta

SEQ ID NO: 48990 - DNA, 20 bp, Human papillomavirus type 92
aaagatgtcaaatgatgtat

SEQ ID NO: 48991 - DNA, 20 bp, Human papillomavirus type 92
aagatgtcaaatgatgtata

SEQ ID NO: 48992 - DNA, 20 bp, Human papillomavirus type 92
tttctatggacgacgagaac

SEQ ID NO: 48993 - DNA, 20 bp, Human papillomavirus type 92
cctactgttagtgggtcttt

SEQ ID NO: 48994 - DNA, 20 bp, Human papillomavirus type 92
gtgggtctttggtatccact

SEQ ID NO: 48995 - DNA, 20 bp, Human papillomavirus type 92
ggtatccactgatgcacaat

SEQ ID NO: 48996 - DNA, 20 bp, Human papillomavirus type 92
gtatccactgatgcacaatt

SEQ ID NO: 48997 - DNA, 20 bp, Human papillomavirus type 92
tttaatcggccatattggtt

SEQ ID NO: 48998 - DNA, 20 bp, Human coronavirus
tgggcgtagatttttcatag

SEQ ID NO: 48999 - DNA, 20 bp, Human coronavirus
ttcatagtggtgtttatatt

SEQ ID NO: 49000 - DNA, 20 bp, Human coronavirus
tcatagtggtgtttatattc

SEQ ID NO: 49001 - DNA, 20 bp, Human coronavirus
catagtggtgtttatattca

SEQ ID NO: 49002 - DNA, 20 bp, Human coronavirus
atagtggtgtttatattcat

SEQ ID NO: 49003 - DNA, 20 bp, Human coronavirus
tcgccgacttcttaaacaag

SEQ ID NO: 49004 - DNA, 20 bp, Human coronavirus
ttaaacaagagtgttgtgtg

SEQ ID NO: 49005 - DNA, 20 bp, Human coronavirus
aacaagagtgttgtgtgcag

SEQ ID NO: 49006 - DNA, 20 bp, Human coronavirus
tgtgcagtctagcctaatac

SEQ ID NO: 49007 - DNA, 20 bp, Human coronavirus
ttatgaatgcaagtccatat

SEQ ID NO: 49008 - DNA, 20 bp, Human coronavirus
gtgggttgggtcataccctt

SEQ ID NO: 49009 - DNA, 20 bp, Human coronavirus
ggtcatacccttagccttta

SEQ ID NO: 49010 - DNA, 20 bp, Human coronavirus
gcctttatgcctgtgcaatc

SEQ ID NO: 49011 - DNA, 20 bp, Human coronavirus
atgcctgtgcaatcccggaa

SEQ ID NO: 49012 - DNA, 20 bp, Human coronavirus
tgcctgtgcaatcccggaaa

SEQ ID NO: 49013 - DNA, 20 bp, Human coronavirus
ttgatgtaattgtggcatgg

SEQ ID NO: 49014 - DNA, 20 bp, Human coronavirus
tgatgtaattgtggcatggc

SEQ ID NO: 49015 - DNA, 20 bp, Human coronavirus
gatgtaattgtggcatggca

SEQ ID NO: 49016 - DNA, 20 bp, Human coronavirus
atgtaattgtggcatggcat

SEQ ID NO: 49017 - DNA, 20 bp, Human coronavirus
tggcatggcatgttgtgcgt

SEQ ID NO: 49018 - DNA, 20 bp, Human coronavirus
gttacattgattgcgaacaa

SEQ ID NO: 49019 - DNA, 20 bp, Human coronavirus
cattgattgcgaacaagact

SEQ ID NO: 49020 - DNA, 20 bp, Human coronavirus
attgcgaacaagactcgtgt

SEQ ID NO: 49021 - DNA, 20 bp, Human coronavirus
cgaacaagactcgtgtgatt

SEQ ID NO: 49022 - DNA, 20 bp, Human coronavirus
taaaggttggattcctggta

SEQ ID NO: 49023 - DNA, 20 bp, Human coronavirus
taaaggaaacaaatctcatt

SEQ ID NO: 49024 - DNA, 20 bp, Human coronavirus
gcaaagctttgtaccttgat

SEQ ID NO: 49025 - DNA, 20 bp, Human coronavirus
caaagctttgtaccttgatt

SEQ ID NO: 49026 - DNA, 20 bp, Human coronavirus
gtaccttgattatgttcaac

SEQ ID NO: 49027 - DNA, 20 bp, Human coronavirus
taccttgattatgttcaaca

SEQ ID NO: 49028 - DNA, 20 bp, Human coronavirus
ctaaagttgtactggactct

SEQ ID NO: 49029 - DNA, 20 bp, Human coronavirus
tactggactctttaagagtt

SEQ ID NO: 49030 - DNA, 20 bp, Human coronavirus
aagagttacttttattgatg

SEQ ID NO: 49031 - DNA, 20 bp, Human coronavirus
agagttacttttattgatgg

SEQ ID NO: 49032 - DNA, 20 bp, Human coronavirus
cttttattgatggcctttct

SEQ ID NO: 49033 - DNA, 20 bp, Human coronavirus
cagctaaaatttgcattgtg

SEQ ID NO: 49034 - DNA, 20 bp, Human coronavirus
gcattgtggataatgtttat

SEQ ID NO: 49035 - DNA, 20 bp, Human coronavirus
cattgtggataatgtttata

SEQ ID NO: 49036 - DNA, 20 bp, Human coronavirus
tggataatgtttatatggcc

SEQ ID NO: 49037 - DNA, 20 bp, Human coronavirus
atatggccaaggctggtgac

SEQ ID NO: 49038 - DNA, 20 bp, Human coronavirus
aggaaagtgatgttgaagaa

SEQ ID NO: 49039 - DNA, 20 bp, Human coronavirus
aagaagatgatgtagaaggt

SEQ ID NO: 49040 - DNA, 20 bp, Human coronavirus
aactgtcacaagtgctggac

SEQ ID NO: 49041 - DNA, 20 bp, Human coronavirus
actgtcacaagtgctggaca

SEQ ID NO: 49042 - DNA, 20 bp, Human coronavirus
actagcaacacaaggctgtc

SEQ ID NO: 49043 - DNA, 20 bp, Human coronavirus
ggtgttatacaagcaacagt

SEQ ID NO: 49044 - DNA, 20 bp, Human coronavirus
tacaagcaacagtatagtca

SEQ ID NO: 49045 - DNA, 20 bp, Human coronavirus
tttgttgataccttggttaa

SEQ ID NO: 49046 - DNA, 20 bp, Human coronavirus
gttgataccttggttaataa

SEQ ID NO: 49047 - DNA, 20 bp, Human coronavirus
ttgataccttggttaataag

SEQ ID NO: 49048 - DNA, 20 bp, Human coronavirus
gtgctactggagattgttat

SEQ ID NO: 49049 - DNA, 20 bp, Human coronavirus
tgctactggagattgttatg

SEQ ID NO: 49050 - DNA, 20 bp, Human coronavirus
ttatgtctctacagggggca

SEQ ID NO: 49051 - DNA, 20 bp, Human coronavirus
tgtctctacagggggcaaat

SEQ ID NO: 49052 - DNA, 20 bp, Human coronavirus
tgtaaaactgtgcttaatgt

SEQ ID NO: 49053 - DNA, 20 bp, Human coronavirus
cttttaatgttggacgttcc

SEQ ID NO: 49054 - DNA, 20 bp, Human coronavirus
ttttaatgttggacgttcca

SEQ ID NO: 49055 - DNA, 20 bp, Human coronavirus
taatgttggacgttccattg

SEQ ID NO: 49056 - DNA, 20 bp, Human coronavirus
aatgttggacgttccattgt

SEQ ID NO: 49057 - DNA, 20 bp, Human coronavirus
atgttggacgttccattgtt

SEQ ID NO: 49058 - DNA, 20 bp, Human coronavirus
ctaactgttgatggtgttaa

SEQ ID NO: 49059 - DNA, 20 bp, Human coronavirus
atggtgttaatttcactaat

SEQ ID NO: 49060 - DNA, 20 bp, Human coronavirus
atttcactaataggtttgtg

SEQ ID NO: 49061 - DNA, 20 bp, Human coronavirus
cactaataggtttgtgcctg

SEQ ID NO: 49062 - DNA, 20 bp, Human coronavirus
actaataggtttgtgcctgt

SEQ ID NO: 49063 - DNA, 20 bp, Human coronavirus
cacttttaagcaagctaata

SEQ ID NO: 49064 - DNA, 20 bp, Human coronavirus
acttttaagcaagctaataa

SEQ ID NO: 49065 - DNA, 20 bp, Human coronavirus
taagcaagctaataacaatt

SEQ ID NO: 49066 - DNA, 20 bp, Human coronavirus
aagcaagctaataacaattg

SEQ ID NO: 49067 - DNA, 20 bp, Human coronavirus
agcaagctaataacaattgt

SEQ ID NO: 49068 - DNA, 20 bp, Human coronavirus
tgcattttggtacattgagt

SEQ ID NO: 49069 - DNA, 20 bp, Human coronavirus
tggtacattgagtcgtgaag

SEQ ID NO: 49070 - DNA, 20 bp, Human coronavirus
ggtacattgagtcgtgaaga

SEQ ID NO: 49071 - DNA, 20 bp, Human coronavirus
gtacattgagtcgtgaagat

SEQ ID NO: 49072 - DNA, 20 bp, Human coronavirus
agtcgtgaagatcttgagat

SEQ ID NO: 49073 - DNA, 20 bp, Human coronavirus
tactcagcgtattattaaag

SEQ ID NO: 49074 - DNA, 20 bp, Human coronavirus
ttaaagcccaatttaaaaca

SEQ ID NO: 49075 - DNA, 20 bp, Human coronavirus
aagcccaatttaaaacattc

SEQ ID NO: 49076 - DNA, 20 bp, Human coronavirus
aaaacattcgagaaagtaga

SEQ ID NO: 49077 - DNA, 20 bp, Human coronavirus
aaacattcgagaaagtagat

SEQ ID NO: 49078 - DNA, 20 bp, Human coronavirus
gatgttttaaaagtggatga

SEQ ID NO: 49079 - DNA, 20 bp, Human coronavirus
atgttttaaaagtggatgat

SEQ ID NO: 49080 - DNA, 20 bp, Human coronavirus
taaaagtggatgatgttgac

SEQ ID NO: 49081 - DNA, 20 bp, Human coronavirus
aaaagtggatgatgttgacg

SEQ ID NO: 49082 - DNA, 20 bp, Human coronavirus
aaagtggatgatgttgacga

SEQ ID NO: 49083 - DNA, 20 bp, Human coronavirus
accacttggctgcctgagct

SEQ ID NO: 49084 - DNA, 20 bp, Human coronavirus
gctgcctgagctttttatgc

SEQ ID NO: 49085 - DNA, 20 bp, Human coronavirus
ttatgcttagtacattacat

SEQ ID NO: 49086 - DNA, 20 bp, Human coronavirus
tatgcttagtacattacatt

SEQ ID NO: 49087 - DNA, 20 bp, Human coronavirus
atgcttagtacattacattg

SEQ ID NO: 49088 - DNA, 20 bp, Human coronavirus
cattgattgtgattcttata

SEQ ID NO: 49089 - DNA, 20 bp, Human coronavirus
attgtgattcttataaacca

SEQ ID NO: 49090 - DNA, 20 bp, Human coronavirus
tgattcttataaaccaggta

SEQ ID NO: 49091 - DNA, 20 bp, Human coronavirus
ttataaaccaggtaatactt

SEQ ID NO: 49092 - DNA, 20 bp, Human coronavirus
taaaccaggtaatactttta

SEQ ID NO: 49093 - DNA, 20 bp, Human coronavirus
ctaaaatagctggtgtttcc

SEQ ID NO: 49094 - DNA, 20 bp, Human coronavirus
cctgtatatggtctgtggat

SEQ ID NO: 49095 - DNA, 20 bp, Human coronavirus
ctgtatatggtctgtggatg

SEQ ID NO: 49096 - DNA, 20 bp, Human coronavirus
taatcagtttagttctgatt

SEQ ID NO: 49097 - DNA, 20 bp, Human coronavirus
aatcagtttagttctgattt

SEQ ID NO: 49098 - DNA, 20 bp, Human coronavirus
gctctacagtgtttaatgtc

SEQ ID NO: 49099 - DNA, 20 bp, Human coronavirus
aatgtccctaccaaagtgtt

SEQ ID NO: 49100 - DNA, 20 bp, Human coronavirus
atgtccctaccaaagtgtta

SEQ ID NO: 49101 - DNA, 20 bp, Human coronavirus
cgatatggttatcatgtgtt

SEQ ID NO: 49102 - DNA, 20 bp, Human coronavirus
tcatgtgttgcactttatta

SEQ ID NO: 49103 - DNA, 20 bp, Human coronavirus
tccagaagtgttgcgagaag

SEQ ID NO: 49104 - DNA, 20 bp, Human coronavirus
ccagaagtgttgcgagaagg

SEQ ID NO: 49105 - DNA, 20 bp, Human coronavirus
cagaagtgttgcgagaaggg

SEQ ID NO: 49106 - DNA, 20 bp, Human coronavirus
cgagaagggcttgtacgtat

SEQ ID NO: 49107 - DNA, 20 bp, Human coronavirus
tacgtatcgtgcgtactcgt

SEQ ID NO: 49108 - DNA, 20 bp, Human coronavirus
actgctagttccattgctgg

SEQ ID NO: 49109 - DNA, 20 bp, Human coronavirus
cattgctggtgctatactcg

SEQ ID NO: 49110 - DNA, 20 bp, Human coronavirus
ctggtgctatactcgctgta

SEQ ID NO: 49111 - DNA, 20 bp, Human coronavirus
ttgttttggtgttttattac

SEQ ID NO: 49112 - DNA, 20 bp, Human coronavirus
ttttggtgttttattaccta

SEQ ID NO: 49113 - DNA, 20 bp, Human coronavirus
ctctcagttggctaaagcaa

SEQ ID NO: 49114 - DNA, 20 bp, Human coronavirus
gctaaagcaatggacacatt

SEQ ID NO: 49115 - DNA, 20 bp, Human coronavirus
accaataataatggtagtga

SEQ ID NO: 49116 - DNA, 20 bp, Human coronavirus
ccaataataatggtagtgat

SEQ ID NO: 49117 - DNA, 20 bp, Human coronavirus
accaaccgcctactgcttcc

SEQ ID NO: 49118 - DNA, 20 bp, Human coronavirus
catgtaactatgcgtagtag

SEQ ID NO: 49119 - DNA, 20 bp, Human coronavirus
atgtaactatgcgtagtagt

SEQ ID NO: 49120 - DNA, 20 bp, Human coronavirus
taccattaagggttcctttt

SEQ ID NO: 49121 - DNA, 20 bp, Human coronavirus
agggttcctttttatgcgga

SEQ ID NO: 49122 - DNA, 20 bp, Human coronavirus
ctttttatgcggatcttgtg

SEQ ID NO: 49123 - DNA, 20 bp, Human coronavirus
agccaagttaaatctgacct

SEQ ID NO: 49124 - DNA, 20 bp, Human coronavirus
gccaagttaaatctgacctt

SEQ ID NO: 49125 - DNA, 20 bp, Human coronavirus
aatctgaccttgttatagat

SEQ ID NO: 49126 - DNA, 20 bp, Human coronavirus
ttatagatgctttagcttct

SEQ ID NO: 49127 - DNA, 20 bp, Human coronavirus
tagatgctttagcttctatg

SEQ ID NO: 49128 - DNA, 20 bp, Human coronavirus
ttggttaagcataagcatct

SEQ ID NO: 49129 - DNA, 20 bp, Human coronavirus
gttaagcataagcatcttta

SEQ ID NO: 49130 - DNA, 20 bp, Human coronavirus
agcataagcatctttatttg

SEQ ID NO: 49131 - DNA, 20 bp, Human coronavirus
atttgactatgtatataact

SEQ ID NO: 49132 - DNA, 20 bp, Human coronavirus
tttgactatgtatataactc

SEQ ID NO: 49133 - DNA, 20 bp, Human coronavirus
ttcttatgttggcttccctt

SEQ ID NO: 49134 - DNA, 20 bp, Human coronavirus
ttatgttggcttcccttttt

SEQ ID NO: 49135 - DNA, 20 bp, Human coronavirus
tgttggcttccctttttggt

SEQ ID NO: 49136 - DNA, 20 bp, Human coronavirus
gcttccctttttggtactta

SEQ ID NO: 49137 - DNA, 20 bp, Human coronavirus
cctttttggtacttacacat

SEQ ID NO: 49138 - DNA, 20 bp, Human coronavirus
tgcttaattttaagctgttg

SEQ ID NO: 49139 - DNA, 20 bp, Human coronavirus
attttaagctgttgggtatt

SEQ ID NO: 49140 - DNA, 20 bp, Human coronavirus
taagctgttgggtattggag

SEQ ID NO: 49141 - DNA, 20 bp, Human coronavirus
aagctgttgggtattggagg

SEQ ID NO: 49142 - DNA, 20 bp, Human coronavirus
agctgttgggtattggaggt

SEQ ID NO: 49143 - DNA, 20 bp, Human coronavirus
tgcaggctttacagagtgaa

SEQ ID NO: 49144 - DNA, 20 bp, Human coronavirus
gcaggctttacagagtgaat

SEQ ID NO: 49145 - DNA, 20 bp, Human coronavirus
caggctttacagagtgaatt

SEQ ID NO: 49146 - DNA, 20 bp, Human coronavirus
acagagtgaatttgttaata

SEQ ID NO: 49147 - DNA, 20 bp, Human coronavirus
cagagtgaatttgttaatat

SEQ ID NO: 49148 - DNA, 20 bp, Human coronavirus
taccagataaaagtgtttat

SEQ ID NO: 49149 - DNA, 20 bp, Human coronavirus
atgaccaggtagttgataat

SEQ ID NO: 49150 - DNA, 20 bp, Human coronavirus
tgaccaggtagttgataatg

SEQ ID NO: 49151 - DNA, 20 bp, Human coronavirus
ataatgtctatgttacctat

SEQ ID NO: 49152 - DNA, 20 bp, Human coronavirus
cctatgcgggtaatgtatgg

SEQ ID NO: 49153 - DNA, 20 bp, Human coronavirus
ttggtacaatttcttctaca

SEQ ID NO: 49154 - DNA, 20 bp, Human coronavirus
gtacaatttcttctacagtt

SEQ ID NO: 49155 - DNA, 20 bp, Human coronavirus
cttctacagttagattgcaa

SEQ ID NO: 49156 - DNA, 20 bp, Human coronavirus
ttctacagttagattgcaag

SEQ ID NO: 49157 - DNA, 20 bp, Human coronavirus
tacagttagattgcaagctg

SEQ ID NO: 49158 - DNA, 20 bp, Human coronavirus
aacacccagatgttgatggg

SEQ ID NO: 49159 - DNA, 20 bp, Human coronavirus
atgggttgtgcaaattacgc

SEQ ID NO: 49160 - DNA, 20 bp, Human coronavirus
tgcaaattacgcggcaagtt

SEQ ID NO: 49161 - DNA, 20 bp, Human coronavirus
cgcggcaagtttgtacaagt

SEQ ID NO: 49162 - DNA, 20 bp, Human coronavirus
gtacaagtgcctgtaggtat

SEQ ID NO: 49163 - DNA, 20 bp, Human coronavirus
ctggcattggtttacattta

SEQ ID NO: 49164 - DNA, 20 bp, Human coronavirus
gtttacatttaaaagttaat

SEQ ID NO: 49165 - DNA, 20 bp, Human coronavirus
acatttaaaagttaattgtt

SEQ ID NO: 49166 - DNA, 20 bp, Human coronavirus
catttaaaagttaattgttg

SEQ ID NO: 49167 - DNA, 20 bp, Human coronavirus
aaaagttaattgttgccgtt

SEQ ID NO: 49168 - DNA, 20 bp, Human coronavirus
gcggacaaattggtggaggt

SEQ ID NO: 49169 - DNA, 20 bp, Human coronavirus
cggacaaattggtggaggta

SEQ ID NO: 49170 - DNA, 20 bp, Human coronavirus
gtggaggtaggcttagtagg

SEQ ID NO: 49171 - DNA, 20 bp, Human coronavirus
gtaggcgttttaacacttga

SEQ ID NO: 49172 - DNA, 20 bp, Human coronavirus
taacacttgataatcaagat

SEQ ID NO: 49173 - DNA, 20 bp, Human coronavirus
tcgcttgtctttaaaagact

SEQ ID NO: 49174 - DNA, 20 bp, Human coronavirus
tctttaaaagacttgctttt

SEQ ID NO: 49175 - DNA, 20 bp, Human coronavirus
aaaagacttgcttttatatg

SEQ ID NO: 49176 - DNA, 20 bp, Human coronavirus
aaagacttgcttttatatgc

SEQ ID NO: 49177 - DNA, 20 bp, Human coronavirus
cttttatatgctgctgatcc

SEQ ID NO: 49178 - DNA, 20 bp, Human coronavirus
ttaataattatgataagagt

SEQ ID NO: 49179 - DNA, 20 bp, Human coronavirus
ataattatgataagagtgct

SEQ ID NO: 49180 - DNA, 20 bp, Human coronavirus
tgataagagtgctggctatc

SEQ ID NO: 49181 - DNA, 20 bp, Human coronavirus
aacaaatttggaaaagccag

SEQ ID NO: 49182 - DNA, 20 bp, Human coronavirus
acaaatttggaaaagccagg

SEQ ID NO: 49183 - DNA, 20 bp, Human coronavirus
ctgtagttataggcaccact

SEQ ID NO: 49184 - DNA, 20 bp, Human coronavirus
taggcaccactaaattttat

SEQ ID NO: 49185 - DNA, 20 bp, Human coronavirus
tatggtggctgggatgatat

SEQ ID NO: 49186 - DNA, 20 bp, Human coronavirus
atggtggctgggatgatatg

SEQ ID NO: 49187 - DNA, 20 bp, Human coronavirus
tggtggctgggatgatatgt

SEQ ID NO: 49188 - DNA, 20 bp, Human coronavirus
aagatcttagtatacgtgct

SEQ ID NO: 49189 - DNA, 20 bp, Human coronavirus
gtatacgtgctcttcagaag

SEQ ID NO: 49190 - DNA, 20 bp, Human coronavirus
agaagcgcttatactcacat

SEQ ID NO: 49191 - DNA, 20 bp, Human coronavirus
tactcacatgtgtatagaag

SEQ ID NO: 49192 - DNA, 20 bp, Human coronavirus
attcaacctttgtcacagaa

SEQ ID NO: 49193 - DNA, 20 bp, Human coronavirus
tgttcacaacacacaatgct

SEQ ID NO: 49194 - DNA, 20 bp, Human coronavirus
acaacacacaatgcttgtaa

SEQ ID NO: 49195 - DNA, 20 bp, Human coronavirus
taaagatggatggtgacgat

SEQ ID NO: 49196 - DNA, 20 bp, Human coronavirus
catatcctaatcctagtcgt

SEQ ID NO: 49197 - DNA, 20 bp, Human coronavirus
ggatatggaaggtagacatc

SEQ ID NO: 49198 - DNA, 20 bp, Human coronavirus
ttttaagtacttgtgatgga

SEQ ID NO: 49199 - DNA, 20 bp, Human coronavirus
taagtacttgtgatggacaa

SEQ ID NO: 49200 - DNA, 20 bp, Human coronavirus
aagtacttgtgatggacaaa

SEQ ID NO: 49201 - DNA, 20 bp, Human coronavirus
agtacttgtgatggacaaaa

SEQ ID NO: 49202 - DNA, 20 bp, Human coronavirus
tgatggacaaaagttcactg

SEQ ID NO: 49203 - DNA, 20 bp, Human coronavirus
catactagctaatgaatgta

SEQ ID NO: 49204 - DNA, 20 bp, Human coronavirus
aaattgtttgctgcagaaac

SEQ ID NO: 49205 - DNA, 20 bp, Human coronavirus
tttgctgcagaaacgcaaaa

SEQ ID NO: 49206 - DNA, 20 bp, Human coronavirus
gctgcagaaacgcaaaaggc

SEQ ID NO: 49207 - DNA, 20 bp, Human coronavirus
ctgcagaaacgcaaaaggca

SEQ ID NO: 49208 - DNA, 20 bp, Human coronavirus
ttccgcaggagaattatagt

SEQ ID NO: 49209 - DNA, 20 bp, Human coronavirus
cgcaggagaattatagtagt

SEQ ID NO: 49210 - DNA, 20 bp, Human coronavirus
tagtagtattagatttgcta

SEQ ID NO: 49211 - DNA, 20 bp, Human coronavirus
gatttgctagtgtttatagt

SEQ ID NO: 49212 - DNA, 20 bp, Human coronavirus
gctagtgtttatagtgtgct

SEQ ID NO: 49213 - DNA, 20 bp, Human coronavirus
aaaattaatgacaccactcg

SEQ ID NO: 49214 - DNA, 20 bp, Human coronavirus
aaattaatgacaccactcgt

SEQ ID NO: 49215 - DNA, 20 bp, Human coronavirus
atgacaccactcgtaagtat

SEQ ID NO: 49216 - DNA, 20 bp, Human coronavirus
actaccataaatgcattacc

SEQ ID NO: 49217 - DNA, 20 bp, Human coronavirus
ctaccataaatgcattacct

SEQ ID NO: 49218 - DNA, 20 bp, Human coronavirus
gtggcataaagctgttttta

SEQ ID NO: 49219 - DNA, 20 bp, Human coronavirus
tggcataaagctgtttttat

SEQ ID NO: 49220 - DNA, 20 bp, Human coronavirus
ttattagcccatataatagt

SEQ ID NO: 49221 - DNA, 20 bp, Human coronavirus
tattagcccatataatagtc

SEQ ID NO: 49222 - DNA, 20 bp, Human coronavirus
attagcccatataatagtca

SEQ ID NO: 49223 - DNA, 20 bp, Human coronavirus
aatgtagtactaatttattt

SEQ ID NO: 49224 - DNA, 20 bp, Human coronavirus
atttaaagattgtagcaaga

SEQ ID NO: 49225 - DNA, 20 bp, Human coronavirus
tttaaagattgtagcaagag

SEQ ID NO: 49226 - DNA, 20 bp, Human coronavirus
aaagattgtagcaagagtta

SEQ ID NO: 49227 - DNA, 20 bp, Human coronavirus
aagattgtagcaagagttat

SEQ ID NO: 49228 - DNA, 20 bp, Human coronavirus
cccacttcaattaggatttt

SEQ ID NO: 49229 - DNA, 20 bp, Human coronavirus
ccacttcaattaggattttc

SEQ ID NO: 49230 - DNA, 20 bp, Human coronavirus
aattaggattttccacagga

SEQ ID NO: 49231 - DNA, 20 bp, Human coronavirus
ggattttccacaggaattga

SEQ ID NO: 49232 - DNA, 20 bp, Human coronavirus
tccacaggaattgattttgt

SEQ ID NO: 49233 - DNA, 20 bp, Human coronavirus
gagctcacttgtctccgcta

SEQ ID NO: 49234 - DNA, 20 bp, Human coronavirus
agctcacttgtctccgctac

SEQ ID NO: 49235 - DNA, 20 bp, Human coronavirus
tctccgctactttgcaaaag

SEQ ID NO: 49236 - DNA, 20 bp, Human coronavirus
gcaaaagtagggcgtgagat

SEQ ID NO: 49237 - DNA, 20 bp, Human coronavirus
caaaagtagggcgtgagatt

SEQ ID NO: 49238 - DNA, 20 bp, Human coronavirus
cctgtgtcaaagattttgat

SEQ ID NO: 49239 - DNA, 20 bp, Human coronavirus
tgattttaagttctatgatg

SEQ ID NO: 49240 - DNA, 20 bp, Human coronavirus
gattttaagttctatgatgc

SEQ ID NO: 49241 - DNA, 20 bp, Human coronavirus
attttaagttctatgatgcc

SEQ ID NO: 49242 - DNA, 20 bp, Human coronavirus
taagttctatgatgcccaac

SEQ ID NO: 49243 - DNA, 20 bp, Human coronavirus
gaagcctatgccattcttct

SEQ ID NO: 49244 - DNA, 20 bp, Human coronavirus
aagcctatgccattcttcta

SEQ ID NO: 49245 - DNA, 20 bp, Human coronavirus
ttctattattcagatacgcc

SEQ ID NO: 49246 - DNA, 20 bp, Human coronavirus
tattattcagatacgccttg

SEQ ID NO: 49247 - DNA, 20 bp, Human coronavirus
ttcagatacgccttgtgtgt

SEQ ID NO: 49248 - DNA, 20 bp, Human coronavirus
tgccattataaatgataaag

SEQ ID NO: 49249 - DNA, 20 bp, Human coronavirus
taaatgataaagttgtggct

SEQ ID NO: 49250 - DNA, 20 bp, Human coronavirus
tggctaagatcgataaggag

SEQ ID NO: 49251 - DNA, 20 bp, Human coronavirus
tcatttttattaataataca

SEQ ID NO: 49252 - DNA, 20 bp, Human coronavirus
ttattaataatacaacatac

SEQ ID NO: 49253 - DNA, 20 bp, Human coronavirus
aagcttttaaacgttctaat

SEQ ID NO: 49254 - DNA, 20 bp, Human coronavirus
taaacgttctaataatggcg

SEQ ID NO: 49255 - DNA, 20 bp, Human coronavirus
aaacgttctaataatggcgt

SEQ ID NO: 49256 - DNA, 20 bp, Human coronavirus
aacgttctaataatggcgtt

SEQ ID NO: 49257 - DNA, 20 bp, Human coronavirus
taataatggcgtttacattt

SEQ ID NO: 49258 - DNA, 20 bp, Human coronavirus
gaacacattgtttatggtaa

SEQ ID NO: 49259 - DNA, 20 bp, Human coronavirus
aacacattgtttatggtaac

SEQ ID NO: 49260 - DNA, 20 bp, Human coronavirus
tttatggtaacttcaaccag

SEQ ID NO: 49261 - DNA, 20 bp, Human coronavirus
atggtaacttcaaccagaag

SEQ ID NO: 49262 - DNA, 20 bp, Human coronavirus
tggtaacttcaaccagaaga

SEQ ID NO: 49263 - DNA, 20 bp, Human coronavirus
ctatcctcgtttgcaagctg

SEQ ID NO: 49264 - DNA, 20 bp, Human coronavirus
tatcctcgtttgcaagctgc

SEQ ID NO: 49265 - DNA, 20 bp, Human coronavirus
gcaagctgcatctgactgga

SEQ ID NO: 49266 - DNA, 20 bp, Human coronavirus
caagctgcatctgactggaa

SEQ ID NO: 49267 - DNA, 20 bp, Human coronavirus
ttctatgcctgtattatata

SEQ ID NO: 49268 - DNA, 20 bp, Human coronavirus
gctctgggtggcagtgttgc

SEQ ID NO: 49269 - DNA, 20 bp, Human coronavirus
ctataaaaataacagagttt

SEQ ID NO: 49270 - DNA, 20 bp, Human coronavirus
tcttggaatgcagaattata

SEQ ID NO: 49271 - DNA, 20 bp, Human coronavirus
cttggaatgcagaattatat

SEQ ID NO: 49272 - DNA, 20 bp, Human coronavirus
ttggaatgcagaattatata

SEQ ID NO: 49273 - DNA, 20 bp, Human coronavirus
taaaatacaaacagcgccac

SEQ ID NO: 49274 - DNA, 20 bp, Human coronavirus
gtcttactatgctggacata

SEQ ID NO: 49275 - DNA, 20 bp, Human coronavirus
ctatgctggacatacagcct

SEQ ID NO: 49276 - DNA, 20 bp, Human coronavirus
atgtcgctattcaagaagtt

SEQ ID NO: 49277 - DNA, 20 bp, Human coronavirus
ttgaatagcgacatcaacac

SEQ ID NO: 49278 - DNA, 20 bp, Human coronavirus
aggaaaatgttgattttata

SEQ ID NO: 49279 - DNA, 20 bp, Human coronavirus
attttataaacagcatgcaa

SEQ ID NO: 49280 - DNA, 20 bp, Human coronavirus
tataaacagcatgcaattca

SEQ ID NO: 49281 - DNA, 20 bp, Human coronavirus
ataaacagcatgcaattcaa

SEQ ID NO: 49282 - DNA, 20 bp, Human coronavirus
taaacagcatgcaattcaat

SEQ ID NO: 49283 - DNA, 20 bp, Human coronavirus
ttataattacacaggcgaag

SEQ ID NO: 49284 - DNA, 20 bp, Human coronavirus
tataattacacaggcgaagg

SEQ ID NO: 49285 - DNA, 20 bp, Human coronavirus
ataattacacaggcgaaggt

SEQ ID NO: 49286 - DNA, 20 bp, Human coronavirus
taattacacaggcgaaggtc

SEQ ID NO: 49287 - DNA, 20 bp, Human coronavirus
cacaggcgaaggtcaacaaa

SEQ ID NO: 49288 - DNA, 20 bp, Human coronavirus
caaatgagctattgttaact

SEQ ID NO: 49289 - DNA, 20 bp, Human coronavirus
aaatgagctattgttaactg

SEQ ID NO: 49290 - DNA, 20 bp, Human coronavirus
ttaactgttcctacgaaagc

SEQ ID NO: 49291 - DNA, 20 bp, Human coronavirus
actgttcctacgaaagcaat

SEQ ID NO: 49292 - DNA, 20 bp, Human coronavirus
ctacgaaagcaatctgtctt

SEQ ID NO: 49293 - DNA, 20 bp, Human coronavirus
tgtaaatacatcctatagtg

SEQ ID NO: 49294 - DNA, 20 bp, Human coronavirus
gtaaatacatcctatagtgt

SEQ ID NO: 49295 - DNA, 20 bp, Human coronavirus
taaatacatcctatagtgtg

SEQ ID NO: 49296 - DNA, 20 bp, Human coronavirus
aacacaggatggtgataata

SEQ ID NO: 49297 - DNA, 20 bp, Human coronavirus
caaggtcttttagaggtctc

SEQ ID NO: 49298 - DNA, 20 bp, Human coronavirus
cacactattatgtcatgcct

SEQ ID NO: 49299 - DNA, 20 bp, Human coronavirus
acactattatgtcatgcctc

SEQ ID NO: 49300 - DNA, 20 bp, Human coronavirus
tgtcatgcctctgacttgta

SEQ ID NO: 49301 - DNA, 20 bp, Human coronavirus
taatagtaagcttactttag

SEQ ID NO: 49302 - DNA, 20 bp, Human coronavirus
ctttagaatattgggttaca

SEQ ID NO: 49303 - DNA, 20 bp, Human coronavirus
caatatagaagcttggctta

SEQ ID NO: 49304 - DNA, 20 bp, Human coronavirus
gcttaatgataagtcggtgc

SEQ ID NO: 49305 - DNA, 20 bp, Human coronavirus
atgataagtcggtgccctct

SEQ ID NO: 49306 - DNA, 20 bp, Human coronavirus
aattgggaacgtaagacatt

SEQ ID NO: 49307 - DNA, 20 bp, Human coronavirus
ggaacgtaagacattttcaa

SEQ ID NO: 49308 - DNA, 20 bp, Human coronavirus
aatccttctacttggaataa

SEQ ID NO: 49309 - DNA, 20 bp, Human coronavirus
atccttctacttggaataag

SEQ ID NO: 49310 - DNA, 20 bp, Human coronavirus
tacttggaataagagatttg

SEQ ID NO: 49311 - DNA, 20 bp, Human coronavirus
gaataagagatttggtttta

SEQ ID NO: 49312 - DNA, 20 bp, Human coronavirus
ggttttatagaagattctgt

SEQ ID NO: 49313 - DNA, 20 bp, Human coronavirus
agttggcataggtgagcact

SEQ ID NO: 49314 - DNA, 20 bp, Human coronavirus
gttggcataggtgagcactg

SEQ ID NO: 49315 - DNA, 20 bp, Human coronavirus
gcataggtgagcactgttcg

SEQ ID NO: 49316 - DNA, 20 bp, Human coronavirus
gggtcttgctgttaaaagtg

SEQ ID NO: 49317 - DNA, 20 bp, Human coronavirus
ctgttaaaagtgattattgt

SEQ ID NO: 49318 - DNA, 20 bp, Human coronavirus
ctatagcggtcgtgtttctg

SEQ ID NO: 49319 - DNA, 20 bp, Human coronavirus
ctgcggcctttcacgctaac

SEQ ID NO: 49320 - DNA, 20 bp, Human coronavirus
tgcggcctttcacgctaact

SEQ ID NO: 49321 - DNA, 20 bp, Human coronavirus
cacgctaactcttccgaacc

SEQ ID NO: 49322 - DNA, 20 bp, Human coronavirus
acgctaactcttccgaacca

SEQ ID NO: 49323 - DNA, 20 bp, Human coronavirus
attcaaacaagctctcctaa

SEQ ID NO: 49324 - DNA, 20 bp, Human coronavirus
ttcaaacaagctctcctaaa

SEQ ID NO: 49325 - DNA, 20 bp, Human coronavirus
aaacaagctctcctaaagtt

SEQ ID NO: 49326 - DNA, 20 bp, Human coronavirus
ctattgattgtgctgcattt

SEQ ID NO: 49327 - DNA, 20 bp, Human coronavirus
attgtgctgcatttgtctgt

SEQ ID NO: 49328 - DNA, 20 bp, Human coronavirus
gggacctcatttgtgtgcaa

SEQ ID NO: 49329 - DNA, 20 bp, Human coronavirus
gtgtgcaaagttataaaggc

SEQ ID NO: 49330 - DNA, 20 bp, Human coronavirus
tgtgcaaagttataaaggca

SEQ ID NO: 49331 - DNA, 20 bp, Human coronavirus
taaaggcatcaaagtgttgc

SEQ ID NO: 49332 - DNA, 20 bp, Human coronavirus
cctccactgctctcagaaaa

SEQ ID NO: 49333 - DNA, 20 bp, Human coronavirus
aagcggaagctcagatagat

SEQ ID NO: 49334 - DNA, 20 bp, Human coronavirus
ttaatggtcgtcttaccgct

SEQ ID NO: 49335 - DNA, 20 bp, Human coronavirus
atggtcgtcttaccgctctt

SEQ ID NO: 49336 - DNA, 20 bp, Human coronavirus
ccgctcttaatgcttatgtt

SEQ ID NO: 49337 - DNA, 20 bp, Human coronavirus
atgcttatgtttctcaacag

SEQ ID NO: 49338 - DNA, 20 bp, Human coronavirus
gtcctggtctgtgcattgct

SEQ ID NO: 49339 - DNA, 20 bp, Human coronavirus
ctggtgatagaggtatagct

SEQ ID NO: 49340 - DNA, 20 bp, Human coronavirus
ttttgttaatgtaaataata

SEQ ID NO: 49341 - DNA, 20 bp, Human coronavirus
tgttaatgtaaataatactt

SEQ ID NO: 49342 - DNA, 20 bp, Human coronavirus
gttaatgtaaataatacttg

SEQ ID NO: 49343 - DNA, 20 bp, Human coronavirus
aaatgaataggttacaggag

SEQ ID NO: 49344 - DNA, 20 bp, Human coronavirus
caggaggcaataaaagtctt

SEQ ID NO: 49345 - DNA, 20 bp, Human coronavirus
aatcagagctacatcaatct

SEQ ID NO: 49346 - DNA, 20 bp, Human coronavirus
gtacatatgaatattatgta

SEQ ID NO: 49347 - DNA, 20 bp, Human coronavirus
tgtaaaatggccttggtatg

SEQ ID NO: 49348 - DNA, 20 bp, Human coronavirus
tattaacggttttaatgtct

SEQ ID NO: 49349 - DNA, 20 bp, Human coronavirus
acggttttaatgtctcagaa

SEQ ID NO: 49350 - DNA, 20 bp, Human coronavirus
taatgtctcagaattagaag

SEQ ID NO: 49351 - DNA, 20 bp, Human coronavirus
aatgtctcagaattagaaga

SEQ ID NO: 49352 - DNA, 20 bp, Human coronavirus
atgtctcagaattagaagat

SEQ ID NO: 49353 - DNA, 20 bp, Human coronavirus
caacccagaaacaaacaact

SEQ ID NO: 49354 - DNA, 20 bp, Human coronavirus
aacccagaaacaaacaactt

SEQ ID NO: 49355 - DNA, 20 bp, Human coronavirus
atgtgtatagatatgaaagg

SEQ ID NO: 49356 - DNA, 20 bp, Human coronavirus
ggccgataattgaggactat

SEQ ID NO: 49357 - DNA, 20 bp, Human coronavirus
aggactatcatactctgacg

SEQ ID NO: 49358 - DNA, 20 bp, Human coronavirus
ttgagaaataatatctaaat

SEQ ID NO: 49359 - DNA, 20 bp, Human coronavirus
agaaataatatctaaatttt

SEQ ID NO: 49360 - DNA, 20 bp, Human coronavirus
taaggatgtcttttactcct

SEQ ID NO: 49361 - DNA, 20 bp, Human coronavirus
aaggatgtcttttactcctg

SEQ ID NO: 49362 - DNA, 20 bp, Human coronavirus
aggatgtcttttactcctgg

SEQ ID NO: 49363 - DNA, 20 bp, Human coronavirus
acggagtctactgggtcgct

SEQ ID NO: 49364 - DNA, 20 bp, Human coronavirus
ggtcccgatcgacaatgtca

SEQ ID NO: 49365 - DNA, 20 bp, Human coronavirus
acatcagcctggttgctagc

SEQ ID NO: 49366 - DNA, 20 bp, Human coronavirus
ctagcgacccagtagactcc

SEQ ID NO: 49367 - DNA, 20 bp, Human coronavirus
tggcaatagaacccctacct

SEQ ID NO: 49368 - DNA, 20 bp, Human coronavirus
ctagtcttgttctggcaaaa

SEQ ID NO: 49369 - DNA, 20 bp, Human coronavirus
ttctggcaaaacttggcaag

SEQ ID NO: 49370 - DNA, 20 bp, Human coronavirus
tggcaaaacttggcaaggat

SEQ ID NO: 49371 - DNA, 20 bp, Human coronavirus
gcaaggatgccactaaacct

SEQ ID NO: 49372 - DNA, 20 bp, Human coronavirus
atgaattgcgctataacggc

SEQ ID NO: 49373 - DNA, 20 bp, Human coronavirus
tgaattgcgctataacggcg

SEQ ID NO: 49374 - DNA, 20 bp, Human coronavirus
cgctataacggcgcaattag

SEQ ID NO: 49375 - DNA, 20 bp, Human coronavirus
ggtttgacagtacactttca

SEQ ID NO: 49376 - DNA, 20 bp, Human coronavirus
gacagtacactttcaggttt

SEQ ID NO: 49377 - DNA, 20 bp, Human coronavirus
tgtcggcatctggtggtaac

SEQ ID NO: 49378 - DNA, 20 bp, Human coronavirus
tagcagcaagacatccattc

SEQ ID NO: 49379 - DNA, 20 bp, Human coronavirus
tgatagagagtgccttatct

SEQ ID NO: 49380 - DNA, 20 bp, Human coronavirus
tctcgacttttctgcgaggg

SEQ ID NO: 49381 - DNA, 20 bp, Human coronavirus
tctgcgaggggttaccacca

SEQ ID NO: 49382 - DNA, 20 bp, Influenza A virus
tcaagaaactggttcatgct

SEQ ID NO: 49383 - DNA, 20 bp, Influenza A virus
atgctaatgcccaagcagaa

SEQ ID NO: 49384 - DNA, 20 bp, Influenza A virus
gcatcagaatggaccaggca

SEQ ID NO: 49385 - DNA, 20 bp, Influenza A virus
catcagaatggaccaggcaa

SEQ ID NO: 49386 - DNA, 20 bp, Influenza A virus
ttctccatgattgcctggtc

SEQ ID NO: 49387 - DNA, 20 bp, Influenza A virus
gggtcctcatcggaggactt

SEQ ID NO: 49388 - DNA, 20 bp, Influenza A virus
aatggaatgataacacagtt

SEQ ID NO: 49389 - DNA, 20 bp, Influenza A virus
gagtctctaaaaatctacag

SEQ ID NO: 49390 - DNA, 20 bp, Influenza A virus
gcttggagaagcagtaatga

SEQ ID NO: 49391 - DNA, 20 bp, Influenza A virus
gagaagcagtaatgagaatg

SEQ ID NO: 49392 - DNA, 20 bp, Influenza A virus
gcagaccaagaactgggtga

SEQ ID NO: 49393 - DNA, 20 bp, Influenza A virus
cagaccaagaactgggtgat

SEQ ID NO: 49394 - DNA, 20 bp, Influenza A virus
cttgaccggcttcgccgaga

SEQ ID NO: 49395 - DNA, 20 bp, Influenza A virus
accggcttcgccgagatcag

SEQ ID NO: 49396 - DNA, 20 bp, Influenza A virus
gccgagatcagaagtcccta

SEQ ID NO: 49397 - DNA, 20 bp, Influenza A virus
aggaaatgtcaagggattgg

SEQ ID NO: 49398 - DNA, 20 bp, Influenza A virus
gttaatgctcattcccaagc

SEQ ID NO: 49399 - DNA, 20 bp, Influenza A virus
atgctcattcccaagcagaa

SEQ ID NO: 49400 - DNA, 20 bp, Influenza A virus
ccaagcagaaagtgacaggg

SEQ ID NO: 49401 - DNA, 20 bp, Influenza A virus
gcattagaatggaccaggca

SEQ ID NO: 49402 - DNA, 20 bp, Influenza A virus
gggtcctcatcggaggactt

SEQ ID NO: 49403 - DNA, 20 bp, Influenza A virus
aatggaatgataacacagtt

SEQ ID NO: 49404 - DNA, 20 bp, Influenza A virus
gagtctctgaaactctacag

SEQ ID NO: 49405 - DNA, 20 bp, Influenza A virus
tccaagtgaatctctgtaga

SEQ ID NO: 49406 - DNA, 20 bp, Influenza A virus
cagagactcgaactgtgtta

SEQ ID NO: 49407 - DNA, 20 bp, Hepatitis C virus
tgtcttcacgcggaaagcgc

SEQ ID NO: 49408 - DNA, 20 bp, Hepatitis C virus
acgcggaaagcgcctagcca

SEQ ID NO: 49409 - DNA, 20 bp, Hepatitis C virus
gtacgagtgtcgtgcagcct

SEQ ID NO: 49410 - DNA, 20 bp, Hepatitis C virus
cgcagaccactatggctctc

SEQ ID NO: 49411 - DNA, 20 bp, Hepatitis C virus
ccgcgtgaagacagaagttc

SEQ ID NO: 49412 - DNA, 20 bp, Hepatitis C virus
ccgggtggcggacagatcgt

SEQ ID NO: 49413 - DNA, 20 bp, Hepatitis C virus
gtggagtatacgtgttgccg

SEQ ID NO: 49414 - DNA, 20 bp, Hepatitis C virus
ccgcgcaggggcccacgatt

SEQ ID NO: 49415 - DNA, 20 bp, Hepatitis C virus
ggtaaagtcatcgataccct

SEQ ID NO: 49416 - DNA, 20 bp, Hepatitis C virus
gccgacctcatggggtacat

SEQ ID NO: 49417 - DNA, 20 bp, Hepatitis C virus
cgacgcctcctacaggagcg

SEQ ID NO: 49418 - DNA, 20 bp, Hepatitis C virus
gggtatcgatgactttaccc

SEQ ID NO: 49419 - DNA, 20 bp, Hepatitis C virus
tgtccaggacggcaatacat

SEQ ID NO: 49420 - DNA, 20 bp, Hepatitis C virus
ctccgacgtacctgactgcc

SEQ ID NO: 49421 - DNA, 20 bp, Hepatitis C virus
ccgtcctggacacaaggtac

SEQ ID NO: 49422 - DNA, 20 bp, Hepatitis C virus
gtcccccgctgtgggtatgg

SEQ ID NO: 49423 - DNA, 20 bp, Hepatitis C virus
accccagaccttgttcgaca

SEQ ID NO: 49424 - DNA, 20 bp, Hepatitis C virus
ccccagaccttgttcgacat

SEQ ID NO: 49425 - DNA, 20 bp, Hepatitis C virus
ttcgacataatggccggggc

SEQ ID NO: 49426 - DNA, 20 bp, Hepatitis C virus
gacataatggccggggccca

SEQ ID NO: 49427 - DNA, 20 bp, Hepatitis C virus
cttcaggcagggatggggcc

SEQ ID NO: 49428 - DNA, 20 bp, Hepatitis C virus
ttcaggcagggatggggccc

SEQ ID NO: 49429 - DNA, 20 bp, Hepatitis C virus
aggcagggatggggcccctt

SEQ ID NO: 49430 - DNA, 20 bp, Hepatitis C virus
acagatgctaacatcaccgg

SEQ ID NO: 49431 - DNA, 20 bp, Hepatitis C virus
tgatgacagaccatactgct

SEQ ID NO: 49432 - DNA, 20 bp, Hepatitis C virus
ctgctgaagtcccagcggcc

SEQ ID NO: 49433 - DNA, 20 bp, Hepatitis C virus
gggtgctcgtggatgaactc

SEQ ID NO: 49434 - DNA, 20 bp, Hepatitis C virus
ggtgctcgtggatgaactcc

SEQ ID NO: 49435 - DNA, 20 bp, Hepatitis C virus
atccacgagcacccaaacca

SEQ ID NO: 49436 - DNA, 20 bp, Hepatitis C virus
agcaggaacacatctttctc

SEQ ID NO: 49437 - DNA, 20 bp, Hepatitis C virus
caactggaccaggggggagc

SEQ ID NO: 49438 - DNA, 20 bp, Hepatitis C virus
ttgaatgcagcagcggatgt

SEQ ID NO: 49439 - DNA, 20 bp, Hepatitis C virus
aatgcagcagcggatgttgc

SEQ ID NO: 49440 - DNA, 20 bp, Hepatitis C virus
ctcactgcggtcacgatcct

SEQ ID NO: 49441 - DNA, 20 bp, Hepatitis C virus
gagaacctggtcacgctgaa

SEQ ID NO: 49442 - DNA, 20 bp, Hepatitis C virus
agcgtgaccaggttctccaa

SEQ ID NO: 49443 - DNA, 20 bp, Hepatitis C virus
tccaaggctgcttctgtctg

SEQ ID NO: 49444 - DNA, 20 bp, Hepatitis C virus
agtcccatggaaatcaaggt

SEQ ID NO: 49445 - DNA, 20 bp, Hepatitis C virus
gtcccatggaaatcaaggtc

SEQ ID NO: 49446 - DNA, 20 bp, Hepatitis C virus
cggagatattctttgcgggc

SEQ ID NO: 49447 - DNA, 20 bp, Hepatitis C virus
atttccatgggactaaatat

SEQ ID NO: 49448 - DNA, 20 bp, Hepatitis C virus
ccatgggactaaatattaca

SEQ ID NO: 49449 - DNA, 20 bp, Hepatitis C virus
ctacggctacccagaccttc

SEQ ID NO: 49450 - DNA, 20 bp, Hepatitis C virus
tacggctacccagaccttcc

SEQ ID NO: 49451 - DNA, 20 bp, Hepatitis C virus
ctaggtacaacagtaggggg

SEQ ID NO: 49452 - DNA, 20 bp, Hepatitis C virus
tatggactgtttatcatgga

SEQ ID NO: 49453 - DNA, 20 bp, Hepatitis C virus
atcatggagcaggttcgaga

SEQ ID NO: 49454 - DNA, 20 bp, Hepatitis C virus
ctctggaggtcccgttatgt

SEQ ID NO: 49455 - DNA, 20 bp, Hepatitis C virus
tgtgcccttcggggcatgtt

SEQ ID NO: 49456 - DNA, 20 bp, Hepatitis C virus
ggggcatgttgcggggatct

SEQ ID NO: 49457 - DNA, 20 bp, Hepatitis C virus
cggggatctttagggctgct

SEQ ID NO: 49458 - DNA, 20 bp, Hepatitis C virus
agggctgctgtgtgcaccag

SEQ ID NO: 49459 - DNA, 20 bp, Hepatitis C virus
atgtcgcgtgcctatgggat

SEQ ID NO: 49460 - DNA, 20 bp, Hepatitis C virus
caactggtgctaaactgacc

SEQ ID NO: 49461 - DNA, 20 bp, Hepatitis C virus
agcaccagttgtaacggtgc

SEQ ID NO: 49462 - DNA, 20 bp, Hepatitis C virus
gcaccagttgtaacggtgcg

SEQ ID NO: 49463 - DNA, 20 bp, Hepatitis C virus
taacggtgcggttcccagtg

SEQ ID NO: 49464 - DNA, 20 bp, Hepatitis C virus
cccgcagccaacgtcgcggc

SEQ ID NO: 49465 - DNA, 20 bp, Hepatitis C virus
ccgcagccaacgtcgcggcc

SEQ ID NO: 49466 - DNA, 20 bp, Hepatitis C virus
cagacggtctttcaccggag

SEQ ID NO: 49467 - DNA, 20 bp, Hepatitis C virus
caccggaggcgacatatcgg

SEQ ID NO: 49468 - DNA, 20 bp, Hepatitis C virus
accggaggcgacatatcggt

SEQ ID NO: 49469 - DNA, 20 bp, Hepatitis C virus
acttctcgtacctaactgcc

SEQ ID NO: 49470 - DNA, 20 bp, Hepatitis C virus
tcgtacctaactgcctacca

SEQ ID NO: 49471 - DNA, 20 bp, Hepatitis C virus
ggacgagatgtggaagtgtc

SEQ ID NO: 49472 - DNA, 20 bp, Hepatitis C virus
agccgcacgagacacttcca

SEQ ID NO: 49473 - DNA, 20 bp, Hepatitis C virus
cacatctcgtcccaacttgg

SEQ ID NO: 49474 - DNA, 20 bp, Hepatitis C virus
tgggtcatattgagctggag

SEQ ID NO: 49475 - DNA, 20 bp, Hepatitis C virus
agctggagggcaagccagca

SEQ ID NO: 49476 - DNA, 20 bp, Hepatitis C virus
cagacaaagaggtgttgtat

SEQ ID NO: 49477 - DNA, 20 bp, Hepatitis C virus
tatcaacaatacgatgagat

SEQ ID NO: 49478 - DNA, 20 bp, Hepatitis C virus
cctgagcttgttcgatatat

SEQ ID NO: 49479 - DNA, 20 bp, Hepatitis C virus
tggcgttcactgcttcagtc

SEQ ID NO: 49480 - DNA, 20 bp, Hepatitis C virus
actgcttcagtcaccagtcc

SEQ ID NO: 49481 - DNA, 20 bp, Hepatitis C virus
agtcaccagtcccctgacga

SEQ ID NO: 49482 - DNA, 20 bp, Hepatitis C virus
tttaacatactcggggggtg

SEQ ID NO: 49483 - DNA, 20 bp, Hepatitis C virus
ttaacatactcggggggtgg

SEQ ID NO: 49484 - DNA, 20 bp, Hepatitis C virus
atccactgtaccgctccctc

SEQ ID NO: 49485 - DNA, 20 bp, Hepatitis C virus
tgccagcgctccctgggctg

SEQ ID NO: 49486 - DNA, 20 bp, Hepatitis C virus
atttcctgtcaaaagggata

SEQ ID NO: 49487 - DNA, 20 bp, Hepatitis C virus
cctgtcaaaagggatacaag

SEQ ID NO: 49488 - DNA, 20 bp, Hepatitis C virus
ctgtcaaaagggatacaagg

SEQ ID NO: 49489 - DNA, 20 bp, Hepatitis C virus
acatcacaccgtccccccgc

SEQ ID NO: 49490 - DNA, 20 bp, Hepatitis C virus
catcacgggggccacagaag

SEQ ID NO: 49491 - DNA, 20 bp, Hepatitis C virus
tttactgaagtggatggagt

SEQ ID NO: 49492 - DNA, 20 bp, Hepatitis C virus
actgaagtggatggagtgag

SEQ ID NO: 49493 - DNA, 20 bp, Hepatitis C virus
ctgaagtggatggagtgaga

SEQ ID NO: 49494 - DNA, 20 bp, Hepatitis C virus
agtaaagaactcagcagccg

SEQ ID NO: 49495 - DNA, 20 bp, Hepatitis C virus
aaggccacttgccagacgca

SEQ ID NO: 49496 - DNA, 20 bp, Hepatitis C virus
ccagacgcataggcctcatc

SEQ ID NO: 49497 - DNA, 20 bp, Hepatitis C virus
ccgccataacaagttggcgt

SEQ ID NO: 49498 - DNA, 20 bp, Hepatitis C virus
gcgtccactagctcagcgtc

SEQ ID NO: 49499 - DNA, 20 bp, Hepatitis C virus
ccaccacggggcgctccacc

SEQ ID NO: 49500 - DNA, 20 bp, Hepatitis C virus
agctggacggctctaatgtg

SEQ ID NO: 49501 - DNA, 20 bp, Hepatitis C virus
ttcagctagcgcggctagcg

SEQ ID NO: 49502 - DNA, 20 bp, Hepatitis C virus
tcagctagcgcggctagcgc

SEQ ID NO: 49503 - DNA, 20 bp, Hepatitis C virus
cagctagcgcggctagcgcc

SEQ ID NO: 49504 - DNA, 20 bp, Hepatitis C virus
ttggaccggcgccctgataa

SEQ ID NO: 49505 - DNA, 20 bp, Hepatitis C virus
gaccggcgccctgataacac

SEQ ID NO: 49506 - DNA, 20 bp, Hepatitis C virus
agacatcataacctagtcta

SEQ ID NO: 49507 - DNA, 20 bp, Hepatitis C virus
tgatgtctcaacagggagtt

SEQ ID NO: 49508 - DNA, 20 bp, Hepatitis C virus
ctgagtgggctgatgggcag

SEQ ID NO: 49509 - DNA, 20 bp, Hepatitis C virus
gggtatagtgcgaaggacgt

SEQ ID NO: 49510 - DNA, 20 bp, Hepatitis C virus
gctccttgtccagcagggcc

SEQ ID NO: 49511 - DNA, 20 bp, Hepatitis C virus
tccagcagggccattaacca

SEQ ID NO: 49512 - DNA, 20 bp, Hepatitis C virus
accagatccgctccgtctgg

SEQ ID NO: 49513 - DNA, 20 bp, Hepatitis C virus
ctggaagacaccacaactcc

SEQ ID NO: 49514 - DNA, 20 bp, Hepatitis C virus
aaccggaggccaggaaagtg

SEQ ID NO: 49515 - DNA, 20 bp, Hepatitis C virus
actgcggaggccctatgttc

SEQ ID NO: 49516 - DNA, 20 bp, Hepatitis C virus
ctgcggaggccctatgttca

SEQ ID NO: 49517 - DNA, 20 bp, Hepatitis C virus
ctgttgaacatagggcctcc

SEQ ID NO: 49518 - DNA, 20 bp, Hepatitis C virus
aacatagggcctccgcagta

SEQ ID NO: 49519 - DNA, 20 bp, Hepatitis C virus
cttgtctgcggagatgattt

SEQ ID NO: 49520 - DNA, 20 bp, Hepatitis C virus
ttgtctgcggagatgatttg

SEQ ID NO: 49521 - DNA, 20 bp, Hepatitis C virus
tctgcggagatgatttggtc

SEQ ID NO: 49522 - DNA, 20 bp, Hepatitis C virus
ggtcgtggtggctgagagtg

SEQ ID NO: 49523 - DNA, 20 bp, Hepatitis C virus
gtcgtggtggctgagagtga

SEQ ID NO: 49524 - DNA, 20 bp, Influenza A virus
catcctaagtgctgggttct

SEQ ID NO: 49525 - DNA, 20 bp, Influenza A virus
atcctaagtgctgggttctt

SEQ ID NO: 49526 - DNA, 20 bp, Influenza A virus
ttctcctgtcttcctgatgt

SEQ ID NO: 49527 - DNA, 20 bp, Influenza A virus
tcctgtcttcctgatgtgta

SEQ ID NO: 49528 - DNA, 20 bp, Influenza A virus
ctgatgtgtacttcttgatt

SEQ ID NO: 49529 - DNA, 20 bp, Influenza A virus
attatccaaaaatctacaaa

SEQ ID NO: 49530 - DNA, 20 bp, Influenza A virus
tccaaaaatctacaaaactt

SEQ ID NO: 49531 - DNA, 20 bp, Influenza A virus
ttttgaaagagtcgaaaggc

SEQ ID NO: 49532 - DNA, 20 bp, Influenza A virus
tgaaagagtcgaaaggctaa

SEQ ID NO: 49533 - DNA, 20 bp, Influenza A virus
gaaagagtcgaaaggctaaa

SEQ ID NO: 49534 - DNA, 20 bp, Influenza A virus
caaaatttctcctttgatgg

SEQ ID NO: 49535 - DNA, 20 bp, Influenza A virus
tgcaatcctggagttcttct

SEQ ID NO: 49536 - DNA, 20 bp, Influenza A virus
gcaatcctggagttcttctt

SEQ ID NO: 49537 - DNA, 20 bp, Influenza A virus
caatcctggagttcttcttt

SEQ ID NO: 49538 - DNA, 20 bp, Influenza A virus
ttctttcttctctttggtta

SEQ ID NO: 49539 - DNA, 20 bp, Influenza A virus
attattgctgctaggaacat

SEQ ID NO: 49540 - DNA, 20 bp, Influenza A virus
ttgctgctaggaacatagtg

SEQ ID NO: 49541 - DNA, 20 bp, Influenza A virus
ctgctaggaacatagtgaga

SEQ ID NO: 49542 - DNA, 20 bp, Influenza A virus
attggagatgtgccacagca

SEQ ID NO: 49543 - DNA, 20 bp, Influenza A virus
ttggagatgtgccacagcac

SEQ ID NO: 49544 - DNA, 20 bp, Influenza A virus
cgggcaatcttcaaacattg

SEQ ID NO: 49545 - DNA, 20 bp, Influenza A virus
aaacattgaagataagagtg

SEQ ID NO: 49546 - DNA, 20 bp, Influenza A virus
aagataagagtgcatgaggg

SEQ ID NO: 49547 - DNA, 20 bp, Influenza A virus
acaatggttgggagaagagc

SEQ ID NO: 49548 - DNA, 20 bp, Influenza A virus
ggagaagagcaacagccata

SEQ ID NO: 49549 - DNA, 20 bp, Influenza A virus
taagacattttcagaaggat

SEQ ID NO: 49550 - DNA, 20 bp, Influenza A virus
aagacattttcagaaggatg

SEQ ID NO: 49551 - DNA, 20 bp, Influenza A virus
agacattttcagaaggatgc

SEQ ID NO: 49552 - DNA, 20 bp, Influenza A virus
tcagaaggatgcgaaagtgc

SEQ ID NO: 49553 - DNA, 20 bp, Influenza A virus
cagaaggatgcgaaagtgct

SEQ ID NO: 49554 - DNA, 20 bp, Influenza A virus
ctcatcgtcaatgatgtggg

SEQ ID NO: 49555 - DNA, 20 bp, Influenza A virus
atctcccacatcattgacga

SEQ ID NO: 49556 - DNA, 20 bp, Influenza A virus
acgatgagtaagttattgtc

SEQ ID NO: 49557 - DNA, 20 bp, Influenza A virus
ttgtcagtttctctgttccc

SEQ ID NO: 49558 - DNA, 20 bp, Influenza A virus
tcagtttctctgttccctgt

SEQ ID NO: 49559 - DNA, 20 bp, Influenza A virus
gtgagaactctgttccaaca

SEQ ID NO: 49560 - DNA, 20 bp, Influenza A virus
tgagaactctgttccaacaa

SEQ ID NO: 49561 - DNA, 20 bp, Influenza A virus
caacaaatgagggatgtgct

SEQ ID NO: 49562 - DNA, 20 bp, Influenza A virus
ggacatttgataccgcacag

SEQ ID NO: 49563 - DNA, 20 bp, Influenza A virus
gataccgcacagataataaa

SEQ ID NO: 49564 - DNA, 20 bp, Influenza A virus
tgaggggattcctcattctg

SEQ ID NO: 49565 - DNA, 20 bp, Influenza A virus
ctcattctgggcaaagaaga

SEQ ID NO: 49566 - DNA, 20 bp, Influenza A virus
tgggcaaagaagacaggaga

SEQ ID NO: 49567 - DNA, 20 bp, Influenza A virus
agcatcaatgaactgagcaa

SEQ ID NO: 49568 - DNA, 20 bp, Influenza A virus
ctcagttcattgatgcttaa

SEQ ID NO: 49569 - DNA, 20 bp, Hepatitis C virus
gcagggctcttctatcagca

SEQ ID NO: 49570 - DNA, 20 bp, Hepatitis C virus
tatcagcacaaattcaactc

SEQ ID NO: 49571 - DNA, 20 bp, Hepatitis C virus
aactcttcaggctgtcctga

SEQ ID NO: 49572 - DNA, 20 bp, Hepatitis C virus
aggctgtcctgagaggttgg

SEQ ID NO: 49573 - DNA, 20 bp, Hepatitis C virus
gccagctgccgacgccttac

SEQ ID NO: 49574 - DNA, 20 bp, Hepatitis C virus
gttcggttgtacctggatga

SEQ ID NO: 49575 - DNA, 20 bp, Hepatitis C virus
ggttgtacctggatgaactc

SEQ ID NO: 49576 - DNA, 20 bp, Hepatitis C virus
tacctggatgaactcaactg

SEQ ID NO: 49577 - DNA, 20 bp, Hepatitis C virus
accaaagtgtgcggagcgcc

SEQ ID NO: 49578 - DNA, 20 bp, Hepatitis C virus
tgtcatcggaggggtgggca

SEQ ID NO: 49579 - DNA, 20 bp, Hepatitis C virus
ctgctgtccaccacacagtg

SEQ ID NO: 49580 - DNA, 20 bp, Hepatitis C virus
cagatcacagcgttcgcccc

SEQ ID NO: 49581 - DNA, 20 bp, Hepatitis C virus
tgtccttcctcgtgttcttc

SEQ ID NO: 49582 - DNA, 20 bp, Hepatitis C virus
ctcgtgttcttctgctttgc

SEQ ID NO: 49583 - DNA, 20 bp, Hepatitis C virus
ttctgctttgcgtggtatct

SEQ ID NO: 49584 - DNA, 20 bp, Hepatitis C virus
tgctttgcgtggtatctgaa

SEQ ID NO: 49585 - DNA, 20 bp, Hepatitis C virus
gcgtggtatctgaagggtag

SEQ ID NO: 49586 - DNA, 20 bp, Hepatitis C virus
gacatcaccaaactactcct

SEQ ID NO: 49587 - DNA, 20 bp, Hepatitis C virus
acatcaccaaactactcctg

SEQ ID NO: 49588 - DNA, 20 bp, Hepatitis C virus
ggacccctttggattcttca

SEQ ID NO: 49589 - DNA, 20 bp, Hepatitis C virus
ggattcttcaagccagtttg

SEQ ID NO: 49590 - DNA, 20 bp, Hepatitis C virus
gattcttcaagccagtttgc

SEQ ID NO: 49591 - DNA, 20 bp, Hepatitis C virus
tcccgaatggagaccaagct

SEQ ID NO: 49592 - DNA, 20 bp, Hepatitis C virus
atgatgtcaccgcacgcggc

SEQ ID NO: 49593 - DNA, 20 bp, Hepatitis C virus
gtctccattcgggagaagac

SEQ ID NO: 49594 - DNA, 20 bp, Hepatitis C virus
gggagaagacgactggttcc

SEQ ID NO: 49595 - DNA, 20 bp, Hepatitis C virus
tgggctggcccgctcctcaa

SEQ ID NO: 49596 - DNA, 20 bp, Hepatitis C virus
ccgctcattgacaccctgca

SEQ ID NO: 49597 - DNA, 20 bp, Hepatitis C virus
aggagcgggccagcccacaa

SEQ ID NO: 49598 - DNA, 20 bp, Hepatitis C virus
gtccacattggtatacatct

SEQ ID NO: 49599 - DNA, 20 bp, Hepatitis C virus
gtatacatctggatgacagg

SEQ ID NO: 49600 - DNA, 20 bp, Hepatitis C virus
atccctgtggagaacctaga

SEQ ID NO: 49601 - DNA, 20 bp, Hepatitis C virus
tccctgtggagaacctagag

SEQ ID NO: 49602 - DNA, 20 bp, Hepatitis C virus
acggacaactcctctccacc

SEQ ID NO: 49603 - DNA, 20 bp, Hepatitis C virus
tccgtgaacaccggggatct

SEQ ID NO: 49604 - DNA, 20 bp, Hepatitis C virus
tctctaggttctccacaggg

SEQ ID NO: 49605 - DNA, 20 bp, Hepatitis C virus
cttgccgacggcgggtgctc

SEQ ID NO: 49606 - DNA, 20 bp, Hepatitis C virus
ccgacggcgggtgctcagga

SEQ ID NO: 49607 - DNA, 20 bp, Hepatitis C virus
tgacataataatttgtgacg

SEQ ID NO: 49608 - DNA, 20 bp, Hepatitis C virus
gtgacgagtgccactccacg

SEQ ID NO: 49609 - DNA, 20 bp, Hepatitis C virus
tgacgagtgccactccacgg

SEQ ID NO: 49610 - DNA, 20 bp, Hepatitis C virus
ggcatcaatgccgtggccta

SEQ ID NO: 49611 - DNA, 20 bp, Hepatitis C virus
acgtgtctgtcatcccgacc

SEQ ID NO: 49612 - DNA, 20 bp, Hepatitis C virus
atgcccaatgcgaccagctt

SEQ ID NO: 49613 - DNA, 20 bp, Hepatitis C virus
gactcgtccgtcctctgtga

SEQ ID NO: 49614 - DNA, 20 bp, Hepatitis C virus
gtatgagctcacgcccgccg

SEQ ID NO: 49615 - DNA, 20 bp, Hepatitis C virus
agaatgaagtcaccctgacg

SEQ ID NO: 49616 - DNA, 20 bp, Hepatitis C virus
gcggcgtcctggctgctctg

SEQ ID NO: 49617 - DNA, 20 bp, Hepatitis C virus
ggtgattgggtgcgtcaggg

SEQ ID NO: 49618 - DNA, 20 bp, Hepatitis C virus
gtgattgggtgcgtcagggt

SEQ ID NO: 49619 - DNA, 20 bp, Hepatitis C virus
ggtgcgtcagggtgacttca

SEQ ID NO: 49620 - DNA, 20 bp, Hepatitis C virus
aagcagaaggccctcggcct

SEQ ID NO: 49621 - DNA, 20 bp, Hepatitis C virus
tcacccctgctgtccagacc

SEQ ID NO: 49622 - DNA, 20 bp, Hepatitis C virus
tgggcgaagcacatgtggaa

SEQ ID NO: 49623 - DNA, 20 bp, Hepatitis C virus
cacatgtgcttcgcccagaa

SEQ ID NO: 49624 - DNA, 20 bp, Hepatitis C virus
gcccagaagacctcgagttt

SEQ ID NO: 49625 - DNA, 20 bp, Hepatitis C virus
gactggggaaggtcctcgtg

SEQ ID NO: 49626 - DNA, 20 bp, Hepatitis C virus
ttgcagggtatggcgcgggc

SEQ ID NO: 49627 - DNA, 20 bp, Hepatitis C virus
cagggtatggcgcgggcgtg

SEQ ID NO: 49628 - DNA, 20 bp, Hepatitis C virus
tagcattcaagatcatgagc

SEQ ID NO: 49629 - DNA, 20 bp, Hepatitis C virus
aagatcatgagcggtgaggt

SEQ ID NO: 49630 - DNA, 20 bp, Hepatitis C virus
cagtgaggctgctgagtatg

SEQ ID NO: 49631 - DNA, 20 bp, Hepatitis C virus
cccattaacgcctacaccac

SEQ ID NO: 49632 - DNA, 20 bp, Hepatitis C virus
acgcctacaccacgggcccc

SEQ ID NO: 49633 - DNA, 20 bp, Hepatitis C virus
atggggaacgtcccactcca

SEQ ID NO: 49634 - DNA, 20 bp, Hepatitis C virus
ctgcaggtcctaggaccgac

SEQ ID NO: 49635 - DNA, 20 bp, Hepatitis C virus
agagtaggactccacgagta

SEQ ID NO: 49636 - DNA, 20 bp, Hepatitis C virus
ccttgcgagcccgaaccgga

SEQ ID NO: 49637 - DNA, 20 bp, Hepatitis C virus
cgagcccgaaccggacgtag

SEQ ID NO: 49638 - DNA, 20 bp, Hepatitis C virus
acgtccatgctcactgatcc

SEQ ID NO: 49639 - DNA, 20 bp, Hepatitis C virus
gggctcgcaaggtaattgcg

SEQ ID NO: 49640 - DNA, 20 bp, Hepatitis C virus
tgcggaagtctcggagattc

SEQ ID NO: 49641 - DNA, 20 bp, Hepatitis C virus
gcccgggccctgcccgtttg

SEQ ID NO: 49642 - DNA, 20 bp, Hepatitis C virus
gggcgcggccggactacaac

SEQ ID NO: 49643 - DNA, 20 bp, Hepatitis C virus
ggcgcggccggactacaacc

SEQ ID NO: 49644 - DNA, 20 bp, Hepatitis C virus
ttccacgtctctactagcgg

SEQ ID NO: 49645 - DNA, 20 bp, Hepatitis C virus
tggctgcccccccgactccg

SEQ ID NO: 49646 - DNA, 20 bp, Hepatitis C virus
agtcctattcttccatgccc

SEQ ID NO: 49647 - DNA, 20 bp, Hepatitis C virus
ttccatgccccccctggagg

SEQ ID NO: 49648 - DNA, 20 bp, Hepatitis C virus
catgccccccctggaggggg

SEQ ID NO: 49649 - DNA, 20 bp, Hepatitis C virus
ctatccgtagaggaagcttg

SEQ ID NO: 49650 - DNA, 20 bp, Hepatitis C virus
cagcctgacgcccccacatt

SEQ ID NO: 49651 - DNA, 20 bp, Hepatitis C virus
agccaaatccaagtttggct

SEQ ID NO: 49652 - DNA, 20 bp, Hepatitis C virus
tgccccatagccaaacttgg

SEQ ID NO: 49653 - DNA, 20 bp, Hepatitis C virus
gccccatagccaaacttgga

SEQ ID NO: 49654 - DNA, 20 bp, Hepatitis C virus
cccgacctgggcgtgcgcgt

SEQ ID NO: 49655 - DNA, 20 bp, Hepatitis C virus
gcaagctccccctggccgtg

SEQ ID NO: 49656 - DNA, 20 bp, Hepatitis C virus
gaatccgtaggagcttccca

SEQ ID NO: 49657 - DNA, 20 bp, Hepatitis C virus
ccatcacggccagggggagc

SEQ ID NO: 49658 - DNA, 20 bp, Hepatitis C virus
ctaaccacgtcgtacagggc

SEQ ID NO: 49659 - DNA, 20 bp, Hepatitis C virus
ccaattcaaggggggaaaac

SEQ ID NO: 49660 - DNA, 20 bp, Hepatitis C virus
aaggggggaaaactgcggct

SEQ ID NO: 49661 - DNA, 20 bp, Hepatitis C virus
ctacatcaaggcccgggcag

SEQ ID NO: 49662 - DNA, 20 bp, Hepatitis C virus
atgtagcaagtgagggtgtt

SEQ ID NO: 49663 - DNA, 20 bp, Hepatitis C virus
ccacagctagttgtcagtac

SEQ ID NO: 49664 - DNA, 20 bp, Hepatitis C virus
cccgtgaccctacaaccccc

SEQ ID NO: 49665 - DNA, 20 bp, Hepatitis C virus
ctggctaggcaacataatca

SEQ ID NO: 49666 - DNA, 20 bp, Hepatitis C virus
tgttgcctagccaggaattg

SEQ ID NO: 49667 - DNA, 20 bp, Hepatitis C virus
cctagccaggaattgactgg

SEQ ID NO: 49668 - DNA, 20 bp, Hepatitis C virus
actggagtgtgtcttgctgt

SEQ ID NO: 49669 - DNA, 20 bp, Hepatitis C virus
gggtcccgcccttgcgagct

SEQ ID NO: 49670 - DNA, 20 bp, Hepatitis C virus
cgagcttggagacaccgggc

SEQ ID NO: 49671 - DNA, 20 bp, Hepatitis C virus
gagacaccgggcccggagcg

SEQ ID NO: 49672 - DNA, 20 bp, Hepatitis C virus
tgtccagaggaggcagggct

SEQ ID NO: 49673 - DNA, 20 bp, Hepatitis C virus
ccacatatggcagccctgcc

SEQ ID NO: 49674 - DNA, 20 bp, Human papillomavirus type 10
cttttgtgtagaaattgtgg

SEQ ID NO: 49675 - DNA, 20 bp, Human papillomavirus type 10
tgtgtagaaattgtggaata

SEQ ID NO: 49676 - DNA, 20 bp, Human papillomavirus type 10
gtgtagaaattgtggaatac

SEQ ID NO: 49677 - DNA, 20 bp, Human papillomavirus type 10
tgtagaaattgtggaatacc

SEQ ID NO: 49678 - DNA, 20 bp, Human papillomavirus type 10
tggaatacctttggaggacc

SEQ ID NO: 49679 - DNA, 20 bp, Human papillomavirus type 10
gttacgatgtctgtcttttt

SEQ ID NO: 49680 - DNA, 20 bp, Human papillomavirus type 10
cgatgtctgtctttttcttc

SEQ ID NO: 49681 - DNA, 20 bp, Human papillomavirus type 10
ttcttcccttaccagcggtt

SEQ ID NO: 49682 - DNA, 20 bp, Human papillomavirus type 10
tcttcccttaccagcggttt

SEQ ID NO: 49683 - DNA, 20 bp, Human papillomavirus type 10
cttcccttaccagcggtttg

SEQ ID NO: 49684 - DNA, 20 bp, Human papillomavirus type 10
gatgaagaagattatacaga

SEQ ID NO: 49685 - DNA, 20 bp, Human papillomavirus type 10
tacagatgcggtggaaccag

SEQ ID NO: 49686 - DNA, 20 bp, Human papillomavirus type 10
gtacattctgttaccaccct

SEQ ID NO: 49687 - DNA, 20 bp, Human papillomavirus type 10
tacattctgttaccacccta

SEQ ID NO: 49688 - DNA, 20 bp, Human papillomavirus type 10
tgttaccaccctatacgctt

SEQ ID NO: 49689 - DNA, 20 bp, Human papillomavirus type 10
gagctaccggacagtggcta

SEQ ID NO: 49690 - DNA, 20 bp, Human papillomavirus type 10
ggcctttgctgactgtctcc

SEQ ID NO: 49691 - DNA, 20 bp, Human papillomavirus type 10
gcctttgctgactgtctccc

SEQ ID NO: 49692 - DNA, 20 bp, Human papillomavirus type 10
gctgactgtctccccagctt

SEQ ID NO: 49693 - DNA, 20 bp, Human papillomavirus type 10
ctgactgtctccccagcttt

SEQ ID NO: 49694 - DNA, 20 bp, Human papillomavirus type 10
tgtgattatgcacacataca

SEQ ID NO: 49695 - DNA, 20 bp, Human papillomavirus type 10
tgcacacatacaagtgctac

SEQ ID NO: 49696 - DNA, 20 bp, Human papillomavirus type 10
tgctggtacggtacaaacgt

SEQ ID NO: 49697 - DNA, 20 bp, Human papillomavirus type 10
ttggcacgtttgtaccgtac

SEQ ID NO: 49698 - DNA, 20 bp, Human papillomavirus type 10
tggcacgtttgtaccgtacc

SEQ ID NO: 49699 - DNA, 20 bp, Human papillomavirus type 10
tttagtgttttatggaccag

SEQ ID NO: 49700 - DNA, 20 bp, Human papillomavirus type 10
agtgttttatggaccagcag

SEQ ID NO: 49701 - DNA, 20 bp, Human papillomavirus type 10
gtgttttatggaccagcaga

SEQ ID NO: 49702 - DNA, 20 bp, Human papillomavirus type 10
tatggaccagcagacactgg

SEQ ID NO: 49703 - DNA, 20 bp, Human papillomavirus type 10
atggaccagcagacactggc

SEQ ID NO: 49704 - DNA, 20 bp, Human papillomavirus type 10
aatgatcaaaattggaaatg

SEQ ID NO: 49705 - DNA, 20 bp, Human papillomavirus type 10
gaaatgcttttttcgaaggt

SEQ ID NO: 49706 - DNA, 20 bp, Human papillomavirus type 10
tttcgaaggttatgggcacg

SEQ ID NO: 49707 - DNA, 20 bp, Human papillomavirus type 10
ttcgaaggttatgggcacgt

SEQ ID NO: 49708 - DNA, 20 bp, Human papillomavirus type 10
tcgaaggttatgggcacgtt

SEQ ID NO: 49709 - DNA, 20 bp, Human papillomavirus type 10
tacacatgaaaatatgaaca

SEQ ID NO: 49710 - DNA, 20 bp, Human papillomavirus type 10
tgtgaatttcaaggatgacg

SEQ ID NO: 49711 - DNA, 20 bp, Human papillomavirus type 10
caaggatgacgcttgtgtat

SEQ ID NO: 49712 - DNA, 20 bp, Human papillomavirus type 10
aaggatgacgcttgtgtata

SEQ ID NO: 49713 - DNA, 20 bp, Human papillomavirus type 10
tgtatatggggaaacaggca

SEQ ID NO: 49714 - DNA, 20 bp, Human papillomavirus type 10
cacccagaaggccgcggaac

SEQ ID NO: 49715 - DNA, 20 bp, Human papillomavirus type 10
tccacccgctcgttccgcgg

SEQ ID NO: 49716 - DNA, 20 bp, Human papillomavirus type 10
cgcggccttctgggtggaat

SEQ ID NO: 49717 - DNA, 20 bp, Human papillomavirus type 10
tgggtggaatctttggaccc

SEQ ID NO: 49718 - DNA, 20 bp, Human papillomavirus type 10
ggacccttgtcgctgctgct

SEQ ID NO: 49719 - DNA, 20 bp, Human papillomavirus type 10
ctgggctttttttgtgctgc

SEQ ID NO: 49720 - DNA, 20 bp, Human papillomavirus type 10
ttttgtgctgctgctgtgtt

SEQ ID NO: 49721 - DNA, 20 bp, Human papillomavirus type 10
tttgtgctgctgctgtgttt

SEQ ID NO: 49722 - DNA, 20 bp, Human papillomavirus type 10
ttgtgctgctgctgtgtttg

SEQ ID NO: 49723 - DNA, 20 bp, Human papillomavirus type 10
tgtgctgctgctgtgtttgt

SEQ ID NO: 49724 - DNA, 20 bp, Human papillomavirus type 10
ttcccaaagtagagggcacc

SEQ ID NO: 49725 - DNA, 20 bp, Human papillomavirus type 10
ccaaagtagagggcaccacc

SEQ ID NO: 49726 - DNA, 20 bp, Human papillomavirus type 10
gcagatcgcattttgcagtg

SEQ ID NO: 49727 - DNA, 20 bp, Human papillomavirus type 10
tgcagtggggtagccttggt

SEQ ID NO: 49728 - DNA, 20 bp, Human papillomavirus type 10
gcagtggggtagccttggtg

SEQ ID NO: 49729 - DNA, 20 bp, Human papillomavirus type 10
tctggtactagtggctttga

SEQ ID NO: 49730 - DNA, 20 bp, Human papillomavirus type 10
ctggtactagtggctttgaa

SEQ ID NO: 49731 - DNA, 20 bp, Human papillomavirus type 10
tggtactagtggctttgaag

SEQ ID NO: 49732 - DNA, 20 bp, Human papillomavirus type 10
gaagttacatcctctgccac

SEQ ID NO: 49733 - DNA, 20 bp, Human papillomavirus type 10
aagttacatcctctgccaca

SEQ ID NO: 49734 - DNA, 20 bp, Human papillomavirus type 10
gccctatagccccaatcgag

SEQ ID NO: 49735 - DNA, 20 bp, Human papillomavirus type 10
aaatggaacctttacttgct

SEQ ID NO: 49736 - DNA, 20 bp, Human papillomavirus type 10
acttgctccagctgcctctg

SEQ ID NO: 49737 - DNA, 20 bp, Human papillomavirus type 10
cttgctccagctgcctctga

SEQ ID NO: 49738 - DNA, 20 bp, Human papillomavirus type 10
ctccagctgcctctgacact

SEQ ID NO: 49739 - DNA, 20 bp, Human papillomavirus type 10
gtgtacctgcctcccactcc

SEQ ID NO: 49740 - DNA, 20 bp, Human papillomavirus type 10
tcagcacggacgactatgtg

SEQ ID NO: 49741 - DNA, 20 bp, Human papillomavirus type 10
actattatgcaggcacttca

SEQ ID NO: 49742 - DNA, 20 bp, Human papillomavirus type 10
ctattatgcaggcacttcac

SEQ ID NO: 49743 - DNA, 20 bp, Human papillomavirus type 10
gtgcgtgtcacatagtcgtc

SEQ ID NO: 49744 - DNA, 20 bp, Human papillomavirus type 10
actgctttacaattaaataa

SEQ ID NO: 49745 - DNA, 20 bp, Human papillomavirus type 10
ctgctttacaattaaataag

SEQ ID NO: 49746 - DNA, 20 bp, Human papillomavirus type 10
acaattaaataagtctgacg

SEQ ID NO: 49747 - DNA, 20 bp, Human papillomavirus type 10
caattaaataagtctgacgt

SEQ ID NO: 49748 - DNA, 20 bp, Human papillomavirus type 10
aataagtctgacgtgcctat

SEQ ID NO: 49749 - DNA, 20 bp, Human papillomavirus type 10
ttcagttgtgtaaggtaaca

SEQ ID NO: 49750 - DNA, 20 bp, Human papillomavirus type 10
tcagttgtgtaaggtaacat

SEQ ID NO: 49751 - DNA, 20 bp, Human papillomavirus type 10
cagttgtgtaaggtaacatt

SEQ ID NO: 49752 - DNA, 20 bp, Human papillomavirus type 10
agttgtgtaaggtaacattg

SEQ ID NO: 49753 - DNA, 20 bp, Human papillomavirus type 10
tgtaaggtaacattgacccc

SEQ ID NO: 49754 - DNA, 20 bp, Human papillomavirus type 10
gtcacatagttttatatttt

SEQ ID NO: 49755 - DNA, 20 bp, Human papillomavirus type 10
tcacatagttttatattttt

SEQ ID NO: 49756 - DNA, 20 bp, Human papillomavirus type 10
tatattttttaatttgtgta

SEQ ID NO: 49757 - DNA, 20 bp, Human papillomavirus type 10
atattttttaatttgtgtaa

SEQ ID NO: 49758 - DNA, 20 bp, Human papillomavirus type 10
tattttttaatttgtgtaat

SEQ ID NO: 49759 - DNA, 20 bp, Human papillomavirus type 184
ccatttagagttgaaacgag

SEQ ID NO: 49760 - DNA, 20 bp, Human papillomavirus type 184
agagttgaaacgagttgtaa

SEQ ID NO: 49761 - DNA, 20 bp, Human papillomavirus type 184
gagttgaaacgagttgtaag

SEQ ID NO: 49762 - DNA, 20 bp, Human papillomavirus type 184
aaacgagttgtaagtcctgt

SEQ ID NO: 49763 - DNA, 20 bp, Human papillomavirus type 184
taagtcctgtgggacaggtg

SEQ ID NO: 49764 - DNA, 20 bp, Human papillomavirus type 184
gaaaaaagctcagactctga

SEQ ID NO: 49765 - DNA, 20 bp, Human papillomavirus type 184
aaaaaagctcagactctgat

SEQ ID NO: 49766 - DNA, 20 bp, Human papillomavirus type 184
cctggcactgtacaacaaac

SEQ ID NO: 49767 - DNA, 20 bp, Human papillomavirus type 184
cctgtttgttgtacagtgcc

SEQ ID NO: 49768 - DNA, 20 bp, Human papillomavirus type 184
gttgtacagtgccagggaat

SEQ ID NO: 49769 - DNA, 20 bp, Human papillomavirus type 184
actttgatgaaaatcctgca

SEQ ID NO: 49770 - DNA, 20 bp, Human papillomavirus type 184
ctttgatgaaaatcctgcaa

SEQ ID NO: 49771 - DNA, 20 bp, Human papillomavirus type 184
gatgaaaatcctgcaaatgt

SEQ ID NO: 49772 - DNA, 20 bp, Human papillomavirus type 184
atgaaaatcctgcaaatgtg

SEQ ID NO: 49773 - DNA, 20 bp, Human papillomavirus type 184
ccttatacaaactgggactc

SEQ ID NO: 49774 - DNA, 20 bp, Human papillomavirus type 184
acgagccagccgaaaccacc

SEQ ID NO: 49775 - DNA, 20 bp, Human papillomavirus type 184
gcggtggggtagaggggtat

SEQ ID NO: 49776 - DNA, 20 bp, Human papillomavirus type 184
cggtggggtagaggggtatg

SEQ ID NO: 49777 - DNA, 20 bp, Human papillomavirus type 184
cggctggctcgtcaacaggc

SEQ ID NO: 49778 - DNA, 20 bp, Human papillomavirus type 184
ggctggctcgtcaacaggct

SEQ ID NO: 49779 - DNA, 20 bp, Human papillomavirus type 184
agcccggttggagtctgtcc

SEQ ID NO: 49780 - DNA, 20 bp, Human papillomavirus type 184
gagtctgtcccagctcctga

SEQ ID NO: 49781 - DNA, 20 bp, Human papillomavirus type 184
cgtcaacaggtttatcaaga

SEQ ID NO: 49782 - DNA, 20 bp, Human papillomavirus type 184
atcaagacttggaagacttc

SEQ ID NO: 49783 - DNA, 20 bp, Human papillomavirus type 184
tcaagacttggaagacttca

SEQ ID NO: 49784 - DNA, 20 bp, Human papillomavirus type 184
gaacgggtaaaggcactggt

SEQ ID NO: 49785 - DNA, 20 bp, Human papillomavirus type 184
ttcatcgttagctccatcta

SEQ ID NO: 49786 - DNA, 20 bp, Human papillomavirus type 184
atcgttagctccatctatta

SEQ ID NO: 49787 - DNA, 20 bp, Human papillomavirus type 184
gctccatctattacacgccc

SEQ ID NO: 49788 - DNA, 20 bp, Human papillomavirus type 184
cacgccctttgcctaaacca

SEQ ID NO: 49789 - DNA, 20 bp, Human papillomavirus type 184
gcaagaagaagtaggtgaaa

SEQ ID NO: 49790 - DNA, 20 bp, Human papillomavirus type 184
caagaagaagtaggtgaaac

SEQ ID NO: 49791 - DNA, 20 bp, Human papillomavirus type 184
tcactgctgatccaggaaca

SEQ ID NO: 49792 - DNA, 20 bp, Human papillomavirus type 184
ggtggtggggaggtagtcac

SEQ ID NO: 49793 - DNA, 20 bp, Human papillomavirus type 184
ctggatcagcagtgataact

SEQ ID NO: 49794 - DNA, 20 bp, Human papillomavirus type 184
aatttgaatttgaaaatccc

SEQ ID NO: 49795 - DNA, 20 bp, Human papillomavirus type 184
gaatttgaaaatcccgcctt

SEQ ID NO: 49796 - DNA, 20 bp, Human papillomavirus type 184
aatttgaaaatcccgccttt

SEQ ID NO: 49797 - DNA, 20 bp, Human papillomavirus type 184
gaaaatcccgcctttgatga

SEQ ID NO: 49798 - DNA, 20 bp, Human papillomavirus type 184
aaaatcccgcctttgatgat

SEQ ID NO: 49799 - DNA, 20 bp, Human papillomavirus type 184
gaaaccttttattccctata

SEQ ID NO: 49800 - DNA, 20 bp, Human papillomavirus type 184
aaaccttttattccctatat

SEQ ID NO: 49801 - DNA, 20 bp, Human papillomavirus type 184
tattccctatatacattttg

SEQ ID NO: 49802 - DNA, 20 bp, Human papillomavirus type 184
attccctatatacattttgg

SEQ ID NO: 49803 - DNA, 20 bp, Human papillomavirus type 184
ttccctatatacattttgga

SEQ ID NO: 49804 - DNA, 20 bp, Human papillomavirus type 184
agtacggatgaatatgtaga

SEQ ID NO: 49805 - DNA, 20 bp, Human papillomavirus type 184
atttttatgctggatctgaa

SEQ ID NO: 49806 - DNA, 20 bp, Human papillomavirus type 184
tttttatgctggatctgaaa

SEQ ID NO: 49807 - DNA, 20 bp, Human papillomavirus type 184
ttatgctggatctgaaaggc

SEQ ID NO: 49808 - DNA, 20 bp, Human papillomavirus type 184
tatgctggatctgaaaggct

SEQ ID NO: 49809 - DNA, 20 bp, Human papillomavirus type 184
caaattggaagaggcggtcc

SEQ ID NO: 49810 - DNA, 20 bp, Human papillomavirus type 184
gaagaggcggtccaataggt

SEQ ID NO: 49811 - DNA, 20 bp, Human papillomavirus type 184
gtacatcaggtcatcccttg

SEQ ID NO: 49812 - DNA, 20 bp, Human papillomavirus type 184
tttaataagtataatgatac

SEQ ID NO: 49813 - DNA, 20 bp, Human papillomavirus type 184
aataagtataatgatacaga

SEQ ID NO: 49814 - DNA, 20 bp, Human papillomavirus type 184
tcctcctatacaactagttc

SEQ ID NO: 49815 - DNA, 20 bp, Human papillomavirus type 184
atactactattcaggatggt

SEQ ID NO: 49816 - DNA, 20 bp, Human papillomavirus type 184
aggatggtgacatgtgtgat

SEQ ID NO: 49817 - DNA, 20 bp, Human papillomavirus type 184
ggagctgcaaattttaaaac

SEQ ID NO: 49818 - DNA, 20 bp, Human papillomavirus type 184
gagctgcaaattttaaaaca

SEQ ID NO: 49819 - DNA, 20 bp, Human papillomavirus type 184
atgttagaggaggtgttgat

SEQ ID NO: 49820 - DNA, 20 bp, Human papillomavirus type 184
tgttagaggaggtgttgatg

SEQ ID NO: 49821 - DNA, 20 bp, Human papillomavirus type 184
gaggaggtgttgatggcgat

SEQ ID NO: 49822 - DNA, 20 bp, Human papillomavirus type 184
atggcgatgcattgccatta

SEQ ID NO: 49823 - DNA, 20 bp, Human papillomavirus type 184
ccattaactaactttattta

SEQ ID NO: 49824 - DNA, 20 bp, Human papillomavirus type 184
cggtaagtttttggcgccag

SEQ ID NO: 49825 - DNA, 20 bp, Human papillomavirus type 184
ggtaagtttttggcgccaga

SEQ ID NO: 49826 - DNA, 20 bp, Human papillomavirus type 184
ttggcgccagaggcaaactt

SEQ ID NO: 49827 - DNA, 20 bp, Human papillomavirus type 184
tggcgccagaggcaaactta

SEQ ID NO: 49828 - DNA, 20 bp, Human papillomavirus type 184
ggcgccagaggcaaacttag

SEQ ID NO: 49829 - DNA, 20 bp, Influenza B virus
agacagacaacggtagacca

SEQ ID NO: 49830 - DNA, 20 bp, Influenza B virus
aatacatcaagaattgaaaa

SEQ ID NO: 49831 - DNA, 20 bp, Influenza B virus
aaaagaacccttcattaaga

SEQ ID NO: 49832 - DNA, 20 bp, Influenza B virus
attaagaatgaagtgggcca

SEQ ID NO: 49833 - DNA, 20 bp, Influenza B virus
agaatgaagtgggccatgtg

SEQ ID NO: 49834 - DNA, 20 bp, Influenza B virus
gaaaaggtctacgaaagctt

SEQ ID NO: 49835 - DNA, 20 bp, Influenza B virus
aaaaggtctacgaaagcttt

SEQ ID NO: 49836 - DNA, 20 bp, Influenza B virus
tttctcagaaagatgagact

SEQ ID NO: 49837 - DNA, 20 bp, Influenza B virus
ttctcagaaagatgagactt

SEQ ID NO: 49838 - DNA, 20 bp, Influenza B virus
tctcagaaagatgagacttg

SEQ ID NO: 49839 - DNA, 20 bp, Influenza B virus
aagggaacgatgataactcc

SEQ ID NO: 49840 - DNA, 20 bp, Influenza B virus
tactggcatacatgcttgag

SEQ ID NO: 49841 - DNA, 20 bp, Influenza B virus
agagagaactagttgcccga

SEQ ID NO: 49842 - DNA, 20 bp, Influenza B virus
ttcgggcaactagttctctc

SEQ ID NO: 49843 - DNA, 20 bp, Influenza B virus
gggcaactagttctctctca

SEQ ID NO: 49844 - DNA, 20 bp, Influenza B virus
catcaaacccactagagcta

SEQ ID NO: 49845 - DNA, 20 bp, Influenza B virus
caaataagactgtgatagac

SEQ ID NO: 49846 - DNA, 20 bp, Influenza B virus
aaaatcatgtctggcagccc

SEQ ID NO: 49847 - DNA, 20 bp, Influenza B virus
aaatcatgtctggcagccct

SEQ ID NO: 49848 - DNA, 20 bp, Influenza B virus
taaaggttcagtgtctatca

SEQ ID NO: 49849 - DNA, 20 bp, Influenza B virus
catgtaagatgtggcgaatg

SEQ ID NO: 49850 - DNA, 20 bp, Influenza B virus
aaaaaaagccaaatgagaat

SEQ ID NO: 49851 - DNA, 20 bp, Influenza B virus
agccaaaaaggaggacatga

SEQ ID NO: 49852 - DNA, 20 bp, Influenza B virus
ttaaatctttcatgtcctcc

SEQ ID NO: 49853 - DNA, 20 bp, Influenza B virus
aatctttcatgtcctccttt

SEQ ID NO: 49854 - DNA, 20 bp, Influenza B virus
ctgaataggagcaatgacct

SEQ ID NO: 49855 - DNA, 20 bp, Influenza B virus
tgaataggagcaatgacctt

SEQ ID NO: 49856 - DNA, 20 bp, Influenza B virus
ttgatcaatggggatatgag

SEQ ID NO: 49857 - DNA, 20 bp, Influenza B virus
tgatcaatggggatatgagg

SEQ ID NO: 49858 - DNA, 20 bp, Influenza B virus
gatcaatggggatatgagga

SEQ ID NO: 49859 - DNA, 20 bp, Influenza B virus
gaatcacaagcacagctaat

SEQ ID NO: 49860 - DNA, 20 bp, Influenza B virus
gtaagtgttttgtaccagtt

SEQ ID NO: 49861 - DNA, 20 bp, Influenza B virus
tgtaccagttctttggttgt

SEQ ID NO: 49862 - DNA, 20 bp, Influenza B virus
gtaccagttctttggttgtt

SEQ ID NO: 49863 - DNA, 20 bp, Influenza B virus
taccagttctttggttgttc

SEQ ID NO: 49864 - DNA, 20 bp, Influenza B virus
caagagcagtgctcaaacaa

SEQ ID NO: 49865 - DNA, 20 bp, Influenza B virus
tgaaaactgaccaattcata

SEQ ID NO: 49866 - DNA, 20 bp, Influenza B virus
ataaaattgttgcctttctg

SEQ ID NO: 49867 - DNA, 20 bp, Influenza B virus
ttgcctttctgtttttcgcc

SEQ ID NO: 49868 - DNA, 20 bp, Influenza B virus
cctttctgtttttcgccacc

SEQ ID NO: 49869 - DNA, 20 bp, Influenza B virus
cttgttagtggcaaatatga

SEQ ID NO: 49870 - DNA, 20 bp, Influenza B virus
ttgttagtggcaaatatgac

SEQ ID NO: 49871 - DNA, 20 bp, Influenza B virus
ttagtggcaaatatgaccct

SEQ ID NO: 49872 - DNA, 20 bp, Influenza B virus
gtggcaaatatgaccctgat

SEQ ID NO: 49873 - DNA, 20 bp, Influenza B virus
gagatttcaaaaccattgag

SEQ ID NO: 49874 - DNA, 20 bp, Human coronavirus
tcagatctcattaaatctaa

SEQ ID NO: 49875 - DNA, 20 bp, Human coronavirus
aatctaaactttttaaacaa

SEQ ID NO: 49876 - DNA, 20 bp, Human coronavirus
ttaaacaagattccctgtta

SEQ ID NO: 49877 - DNA, 20 bp, Human coronavirus
taaacaagattccctgttat

SEQ ID NO: 49878 - DNA, 20 bp, Human coronavirus
aaacaagattccctgttatc

SEQ ID NO: 49879 - DNA, 20 bp, Human coronavirus
gattcgtttatgataatcat

SEQ ID NO: 49880 - DNA, 20 bp, Human coronavirus
gtttatgataatcatgtgaa

SEQ ID NO: 49881 - DNA, 20 bp, Human coronavirus
atgataatcatgtgaagata

SEQ ID NO: 49882 - DNA, 20 bp, Human coronavirus
tgataatcatgtgaagatag

SEQ ID NO: 49883 - DNA, 20 bp, Human coronavirus
tcgctgcattcttggacaag

SEQ ID NO: 49884 - DNA, 20 bp, Human coronavirus
caggtaatatgatggatggt

SEQ ID NO: 49885 - DNA, 20 bp, Human coronavirus
aggtaatatgatggatggtt

SEQ ID NO: 49886 - DNA, 20 bp, Human coronavirus
ttcttgtccattgtgttgta

SEQ ID NO: 49887 - DNA, 20 bp, Human coronavirus
tcttgtccattgtgttgtac

SEQ ID NO: 49888 - DNA, 20 bp, Human coronavirus
cttgtccattgtgttgtaca

SEQ ID NO: 49889 - DNA, 20 bp, Human coronavirus
aacaaaatcatattcttggc

SEQ ID NO: 49890 - DNA, 20 bp, Human coronavirus
ttggcgttaataattcttgg

SEQ ID NO: 49891 - DNA, 20 bp, Human coronavirus
gcgttaataattcttggtgt

SEQ ID NO: 49892 - DNA, 20 bp, Human coronavirus
ataattcttggtgtaggcaa

SEQ ID NO: 49893 - DNA, 20 bp, Human coronavirus
ttggtgtaggcaactgttgc

SEQ ID NO: 49894 - DNA, 20 bp, Human coronavirus
gtattatagataatatgtac

SEQ ID NO: 49895 - DNA, 20 bp, Human coronavirus
tattatagataatatgtaca

SEQ ID NO: 49896 - DNA, 20 bp, Human coronavirus
tagataatatgtacatgggt

SEQ ID NO: 49897 - DNA, 20 bp, Human coronavirus
ttccctattgtcatgaatga

SEQ ID NO: 49898 - DNA, 20 bp, Human coronavirus
tccctattgtcatgaatgat

SEQ ID NO: 49899 - DNA, 20 bp, Human coronavirus
tgttaaaggtgatattataa

SEQ ID NO: 49900 - DNA, 20 bp, Human coronavirus
gttaaaggtgatattataaa

SEQ ID NO: 49901 - DNA, 20 bp, Human coronavirus
ttaaaggtgatattataaat

SEQ ID NO: 49902 - DNA, 20 bp, Human coronavirus
aaggtgatattataaatgtt

SEQ ID NO: 49903 - DNA, 20 bp, Human coronavirus
taaatgttgctagacttgtt

SEQ ID NO: 49904 - DNA, 20 bp, Human coronavirus
ttatgtgaatgtagcttgtc

SEQ ID NO: 49905 - DNA, 20 bp, Human coronavirus
tgtgaatgtagcttgtctta

SEQ ID NO: 49906 - DNA, 20 bp, Human coronavirus
tcttatgttgcagcatatta

SEQ ID NO: 49907 - DNA, 20 bp, Human coronavirus
tgttgcagcatattaatctt

SEQ ID NO: 49908 - DNA, 20 bp, Human coronavirus
cagcatattaatcttaaatt

SEQ ID NO: 49909 - DNA, 20 bp, Human coronavirus
ttaatggttataagattggc

SEQ ID NO: 49910 - DNA, 20 bp, Human coronavirus
taatggttataagattggct

SEQ ID NO: 49911 - DNA, 20 bp, Human coronavirus
aatggttataagattggctg

SEQ ID NO: 49912 - DNA, 20 bp, Human coronavirus
atggttataagattggctgt

SEQ ID NO: 49913 - DNA, 20 bp, Human coronavirus
taagattggctgtaattgtg

SEQ ID NO: 49914 - DNA, 20 bp, Human coronavirus
atactaactttaagttagtt

SEQ ID NO: 49915 - DNA, 20 bp, Human coronavirus
tactaactttaagttagttg

SEQ ID NO: 49916 - DNA, 20 bp, Human coronavirus
aagttagttggacatgatat

SEQ ID NO: 49917 - DNA, 20 bp, Human coronavirus
agttagttggacatgatatt

SEQ ID NO: 49918 - DNA, 20 bp, Human coronavirus
gttggacatgatatttgtgc

SEQ ID NO: 49919 - DNA, 20 bp, Human coronavirus
gttttattaggcatattgtc

SEQ ID NO: 49920 - DNA, 20 bp, Human coronavirus
tattaggcatattgtctatg

SEQ ID NO: 49921 - DNA, 20 bp, Human coronavirus
attaggcatattgtctatgg

SEQ ID NO: 49922 - DNA, 20 bp, Human coronavirus
ttaggcatattgtctatggt

SEQ ID NO: 49923 - DNA, 20 bp, Human coronavirus
ggcatattgtctatggttgt

SEQ ID NO: 49924 - DNA, 20 bp, Human coronavirus
tagatacttttgtgggatgt

SEQ ID NO: 49925 - DNA, 20 bp, Human coronavirus
agatacttttgtgggatgtg

SEQ ID NO: 49926 - DNA, 20 bp, Human coronavirus
gatacttttgtgggatgtgt

SEQ ID NO: 49927 - DNA, 20 bp, Human coronavirus
tgtgggatgtgtacgtaaat

SEQ ID NO: 49928 - DNA, 20 bp, Human coronavirus
gtgggatgtgtacgtaaatg

SEQ ID NO: 49929 - DNA, 20 bp, Human coronavirus
ttgttattcagatggtgtta

SEQ ID NO: 49930 - DNA, 20 bp, Human coronavirus
ttattcagatggtgttatga

SEQ ID NO: 49931 - DNA, 20 bp, Human coronavirus
ttcagatggtgttatgaaga

SEQ ID NO: 49932 - DNA, 20 bp, Human coronavirus
agatggtgttatgaagaatg

SEQ ID NO: 49933 - DNA, 20 bp, Human coronavirus
tgaagaatgcttctttgtat

SEQ ID NO: 49934 - DNA, 20 bp, Human coronavirus
aacagttgtgtcttaccaga

SEQ ID NO: 49935 - DNA, 20 bp, Human coronavirus
acagttgtgtcttaccagat

SEQ ID NO: 49936 - DNA, 20 bp, Human coronavirus
tgtcttaccagatgcagggc

SEQ ID NO: 49937 - DNA, 20 bp, Human coronavirus
ccagatgcagggctgtcaac

SEQ ID NO: 49938 - DNA, 20 bp, Human coronavirus
ttttgacagtctctttacaa

SEQ ID NO: 49939 - DNA, 20 bp, Human coronavirus
tacagttgccagttaaggac

SEQ ID NO: 49940 - DNA, 20 bp, Human coronavirus
ccagttaaggactacgtcca

SEQ ID NO: 49941 - DNA, 20 bp, Human coronavirus
aggactacgtccagactgtt

SEQ ID NO: 49942 - DNA, 20 bp, Human coronavirus
atgttattgcttggctctat

SEQ ID NO: 49943 - DNA, 20 bp, Human coronavirus
ttgcttggctctatgcagct

SEQ ID NO: 49944 - DNA, 20 bp, Human coronavirus
aacgtatggcagacctagca

SEQ ID NO: 49945 - DNA, 20 bp, Human coronavirus
ctaacatgtataaagaggct

SEQ ID NO: 49946 - DNA, 20 bp, Human coronavirus
atgataagaagagtaaagtt

SEQ ID NO: 49947 - DNA, 20 bp, Human coronavirus
tttccgctttgcagacaatg

SEQ ID NO: 49948 - DNA, 20 bp, Human coronavirus
ccgctttgcagacaatgctt

SEQ ID NO: 49949 - DNA, 20 bp, Human coronavirus
ctattaaacctgaggctact

SEQ ID NO: 49950 - DNA, 20 bp, Human coronavirus
aacctgaggctactattaac

SEQ ID NO: 49951 - DNA, 20 bp, Human coronavirus
accaagattcttatggtggt

SEQ ID NO: 49952 - DNA, 20 bp, Human coronavirus
ttatggtggtgcctcagttt

SEQ ID NO: 49953 - DNA, 20 bp, Human coronavirus
tggtggtgcctcagtttgta

SEQ ID NO: 49954 - DNA, 20 bp, Human coronavirus
gttgaagtaggtttagttgg

SEQ ID NO: 49955 - DNA, 20 bp, Human coronavirus
aagtaggtttagttggtgtt

SEQ ID NO: 49956 - DNA, 20 bp, Human coronavirus
agttggtgttttaactttag

SEQ ID NO: 49957 - DNA, 20 bp, Human coronavirus
gttggtgttttaactttaga

SEQ ID NO: 49958 - DNA, 20 bp, Human coronavirus
gtgttttaactttagataac

SEQ ID NO: 49959 - DNA, 20 bp, Human coronavirus
ccattacaaagagttaggtg

SEQ ID NO: 49960 - DNA, 20 bp, Human coronavirus
caaagagttaggtgtagtta

SEQ ID NO: 49961 - DNA, 20 bp, Human coronavirus
ggtgtagttatgaacttaga

SEQ ID NO: 49962 - DNA, 20 bp, Human coronavirus
tgaacttagatgttgacaca

SEQ ID NO: 49963 - DNA, 20 bp, Human coronavirus
gatgttgacacacaccgtta

SEQ ID NO: 49964 - DNA, 20 bp, Human coronavirus
tcatttgaggaacagaatga

SEQ ID NO: 49965 - DNA, 20 bp, Human coronavirus
gaggaacagaatgaaattta

SEQ ID NO: 49966 - DNA, 20 bp, Human coronavirus
aggaacagaatgaaatttat

SEQ ID NO: 49967 - DNA, 20 bp, Human coronavirus
atgcatatactaaacgtaat

SEQ ID NO: 49968 - DNA, 20 bp, Human coronavirus
tgcatatactaaacgtaatg

SEQ ID NO: 49969 - DNA, 20 bp, Human coronavirus
tcctaaatgtgatcgtgcta

SEQ ID NO: 49970 - DNA, 20 bp, Human coronavirus
tgcgtattgttagtagttta

SEQ ID NO: 49971 - DNA, 20 bp, Human coronavirus
gcgtattgttagtagtttag

SEQ ID NO: 49972 - DNA, 20 bp, Human coronavirus
cgtattgttagtagtttagt

SEQ ID NO: 49973 - DNA, 20 bp, Human coronavirus
ttagtagtttagttttggcc

SEQ ID NO: 49974 - DNA, 20 bp, Human coronavirus
ttttgttgatgatttattga

SEQ ID NO: 49975 - DNA, 20 bp, Human coronavirus
tgttgatgatttattgaaga

SEQ ID NO: 49976 - DNA, 20 bp, Human coronavirus
gttgatgatttattgaagac

SEQ ID NO: 49977 - DNA, 20 bp, Human coronavirus
ttgatgatttattgaagact

SEQ ID NO: 49978 - DNA, 20 bp, Human coronavirus
atgatttattgaagactgac

SEQ ID NO: 49979 - DNA, 20 bp, Human coronavirus
tatagatgattttaataaga

SEQ ID NO: 49980 - DNA, 20 bp, Human coronavirus
taataagatagctagttgta

SEQ ID NO: 49981 - DNA, 20 bp, Human coronavirus
aataagatagctagttgtaa

SEQ ID NO: 49982 - DNA, 20 bp, Human coronavirus
ataagatagctagttgtaaa

SEQ ID NO: 49983 - DNA, 20 bp, Human coronavirus
taaatggacagaagttgatg

SEQ ID NO: 49984 - DNA, 20 bp, Human coronavirus
tctagtgtttatagtgttcc

SEQ ID NO: 49985 - DNA, 20 bp, Human coronavirus
ctagtgtttatagtgttcca

SEQ ID NO: 49986 - DNA, 20 bp, Human coronavirus
tagtgtttatagtgttccat

SEQ ID NO: 49987 - DNA, 20 bp, Human coronavirus
atagtgttccattggtgttt

SEQ ID NO: 49988 - DNA, 20 bp, Human coronavirus
tagtgttccattggtgtttc

SEQ ID NO: 49989 - DNA, 20 bp, Human coronavirus
gttttgatgttgagggcgct

SEQ ID NO: 49990 - DNA, 20 bp, Human coronavirus
tgatgttgagggcgctcatg

SEQ ID NO: 49991 - DNA, 20 bp, Human coronavirus
gatgttgagggcgctcatgc

SEQ ID NO: 49992 - DNA, 20 bp, Human coronavirus
atgttgagggcgctcatgct

SEQ ID NO: 49993 - DNA, 20 bp, Human coronavirus
agggcgctcatgctactcgc

SEQ ID NO: 49994 - DNA, 20 bp, Human coronavirus
aagctgccatgctatgtaat

SEQ ID NO: 49995 - DNA, 20 bp, Human coronavirus
tgttatgacataggcaatcc

SEQ ID NO: 49996 - DNA, 20 bp, Human coronavirus
tgacataggcaatcctaaag

SEQ ID NO: 49997 - DNA, 20 bp, Human coronavirus
agcttgtgtcaaagattatg

SEQ ID NO: 49998 - DNA, 20 bp, Human coronavirus
gcttgtgtcaaagattatga

SEQ ID NO: 49999 - DNA, 20 bp, Human coronavirus
tgtgtacgtagatggtttag

SEQ ID NO: 50000 - DNA, 20 bp, Human coronavirus
agaatctaaacaagttgatt

SEQ ID NO: 50001 - DNA, 20 bp, Human coronavirus
gaatctaaacaagttgatta

SEQ ID NO: 50002 - DNA, 20 bp, Human coronavirus
attacgttcctttaagaagc

SEQ ID NO: 50003 - DNA, 20 bp, Human coronavirus
cgttcctttaagaagcgcca

SEQ ID NO: 50004 - DNA, 20 bp, Human coronavirus
aaatggtgtgattgtggata

SEQ ID NO: 50005 - DNA, 20 bp, Human coronavirus
aatggtgtgattgtggataa

SEQ ID NO: 50006 - DNA, 20 bp, Human coronavirus
tggataaagttggagaactc

SEQ ID NO: 50007 - DNA, 20 bp, Human coronavirus
gagaactcaaagttgagttt

SEQ ID NO: 50008 - DNA, 20 bp, Human coronavirus
agttttggttcgctatgaga

SEQ ID NO: 50009 - DNA, 20 bp, Human coronavirus
ctaagtacactcaattatgt

SEQ ID NO: 50010 - DNA, 20 bp, Human coronavirus
tgtcagtatttgaatactac

SEQ ID NO: 50011 - DNA, 20 bp, Human coronavirus
gaatactacaacattagctg

SEQ ID NO: 50012 - DNA, 20 bp, Human coronavirus
aatactacaacattagctgt

SEQ ID NO: 50013 - DNA, 20 bp, Human coronavirus
gctgttcctgttaatatgcg

SEQ ID NO: 50014 - DNA, 20 bp, Human coronavirus
caagagtcataaaccacctt

SEQ ID NO: 50015 - DNA, 20 bp, Human coronavirus
tgcttcctgtcctattggta

SEQ ID NO: 50016 - DNA, 20 bp, Human coronavirus
ctgtcctattggtactaatt

SEQ ID NO: 50017 - DNA, 20 bp, Human coronavirus
gtactaattatcgttcttgt

SEQ ID NO: 50018 - DNA, 20 bp, Human coronavirus
tcgttcttgtgagagtacta

SEQ ID NO: 50019 - DNA, 20 bp, Human coronavirus
gcatgggtagtggtttttgt

SEQ ID NO: 50020 - DNA, 20 bp, Human coronavirus
ttgtgttgattataactcac

SEQ ID NO: 50021 - DNA, 20 bp, Human coronavirus
tgtgttgattataactcacc

SEQ ID NO: 50022 - DNA, 20 bp, Human coronavirus
gtgttgattataactcacct

SEQ ID NO: 50023 - DNA, 20 bp, Human coronavirus
tgttgattataactcacctt

SEQ ID NO: 50024 - DNA, 20 bp, Human coronavirus
agaggctcaggttcagattg

SEQ ID NO: 50025 - DNA, 20 bp, Human coronavirus
gaggctcaggttcagattga

SEQ ID NO: 50026 - DNA, 20 bp, Human coronavirus
agattgataggcttattaat

SEQ ID NO: 50027 - DNA, 20 bp, Human coronavirus
ataggcttattaatggtcgt

SEQ ID NO: 50028 - DNA, 20 bp, Human coronavirus
ttaatggtcgtttaactgct

SEQ ID NO: 50029 - DNA, 20 bp, Human coronavirus
gttaggccagttattgagga

SEQ ID NO: 50030 - DNA, 20 bp, Human coronavirus
ttaggccagttattgaggac

SEQ ID NO: 50031 - DNA, 20 bp, Human coronavirus
ggccagttattgaggactat

SEQ ID NO: 50032 - DNA, 20 bp, Human coronavirus
ttgaggactatcacacatta

SEQ ID NO: 50033 - DNA, 20 bp, Human coronavirus
aggactatcacacattaact

SEQ ID NO: 50034 - DNA, 20 bp, Human coronavirus
aggaatcctcaagaaaactt

SEQ ID NO: 50035 - DNA, 20 bp, Human coronavirus
ttgggctgaccaatctgagc

SEQ ID NO: 50036 - DNA, 20 bp, Human coronavirus
ggctgaccaatctgagcgaa

SEQ ID NO: 50037 - DNA, 20 bp, Human coronavirus
ccaaacctttaatagaggca

SEQ ID NO: 50038 - DNA, 20 bp, Human coronavirus
aatagaggcagaaaaaccca

SEQ ID NO: 50039 - DNA, 20 bp, Human coronavirus
taacaaaacctcgccaaaag

SEQ ID NO: 50040 - DNA, 20 bp, Human coronavirus
aacaaaacctcgccaaaagc

SEQ ID NO: 50041 - DNA, 20 bp, Human coronavirus
acaaaacctcgccaaaagcg

SEQ ID NO: 50042 - DNA, 20 bp, Human coronavirus
taatgttcaacagtgttttg

SEQ ID NO: 50043 - DNA, 20 bp, Human coronavirus
aacagtgttttggtaaaaga

SEQ ID NO: 50044 - DNA, 20 bp, Human coronavirus
gttgagttctaaacctcagc

SEQ ID NO: 50045 - DNA, 20 bp, Human coronavirus
agttctaaacctcagcgtaa

SEQ ID NO: 50046 - DNA, 20 bp, Human coronavirus
taaacctcagcgtaaaagag

SEQ ID NO: 50047 - DNA, 20 bp, Human coronavirus
aacaattaccagaacagttt

SEQ ID NO: 50048 - DNA, 20 bp, Human coronavirus
ccagaacagtttgactctct

SEQ ID NO: 50049 - DNA, 20 bp, Influenza A virus
aacccgatgattgtcgaact

SEQ ID NO: 50050 - DNA, 20 bp, Influenza A virus
tcgaacttgcagaaaaagca

SEQ ID NO: 50051 - DNA, 20 bp, Influenza A virus
cagaaaaagcaatgaaagag

SEQ ID NO: 50052 - DNA, 20 bp, Influenza A virus
aaacaaacaaatttgcagca

SEQ ID NO: 50053 - DNA, 20 bp, Influenza A virus
gcagcaatatgcacccactt

SEQ ID NO: 50054 - DNA, 20 bp, Influenza A virus
aaaccaggctatttaccata

SEQ ID NO: 50055 - DNA, 20 bp, Influenza A virus
accataagacaagaaatggc

SEQ ID NO: 50056 - DNA, 20 bp, Influenza A virus
ccataagacaagaaatggcc

SEQ ID NO: 50057 - DNA, 20 bp, Influenza A virus
ctttcgtcagtccgaaagag

SEQ ID NO: 50058 - DNA, 20 bp, Influenza A virus
cgtcagtccgaaagaggcga

SEQ ID NO: 50059 - DNA, 20 bp, Influenza A virus
aaccttttctgaagacaaca

SEQ ID NO: 50060 - DNA, 20 bp, Influenza A virus
tctgaagacaacaccaagac

SEQ ID NO: 50061 - DNA, 20 bp, Influenza A virus
ctgaagacaacaccaagacc

SEQ ID NO: 50062 - DNA, 20 bp, Influenza A virus
tgaagacaacaccaagacca

SEQ ID NO: 50063 - DNA, 20 bp, Influenza A virus
ctaatggacctccttgttat

SEQ ID NO: 50064 - DNA, 20 bp, Influenza A virus
caggacattgaaaatgagga

SEQ ID NO: 50065 - DNA, 20 bp, Influenza A virus
aaaatgaggagaagatccca

SEQ ID NO: 50066 - DNA, 20 bp, Influenza A virus
tcaccaagagcccactttag

SEQ ID NO: 50067 - DNA, 20 bp, Influenza A virus
caccaagagcccactttagt

SEQ ID NO: 50068 - DNA, 20 bp, Influenza A virus
accaagagcccactttagtt

SEQ ID NO: 50069 - DNA, 20 bp, Influenza A virus
gagaggacgtagccccaatt

SEQ ID NO: 50070 - DNA, 20 bp, Influenza A virus
agtacattgcaagcatgagg

SEQ ID NO: 50071 - DNA, 20 bp, Influenza A virus
caagcatgaggaggaattat

SEQ ID NO: 50072 - DNA, 20 bp, Influenza A virus
tttcacagcagaggtgtccc

SEQ ID NO: 50073 - DNA, 20 bp, Influenza A virus
cacagcagaggtgtcccatt

SEQ ID NO: 50074 - DNA, 20 bp, Influenza A virus
tgagcatggagttttctctc

SEQ ID NO: 50075 - DNA, 20 bp, Influenza A virus
tctctcactgacccgagact

SEQ ID NO: 50076 - DNA, 20 bp, Influenza A virus
ctctcactgacccgagactt

SEQ ID NO: 50077 - DNA, 20 bp, Influenza A virus
tctcactgacccgagacttg

SEQ ID NO: 50078 - DNA, 20 bp, Influenza A virus
agccacataaatgggagaaa

SEQ ID NO: 50079 - DNA, 20 bp, Influenza A virus
aagagaaagacatgaccaaa

SEQ ID NO: 50080 - DNA, 20 bp, Influenza A virus
tttgagaataaatcagaagc

SEQ ID NO: 50081 - DNA, 20 bp, Influenza A virus
ttgagaataaatcagaagca

SEQ ID NO: 50082 - DNA, 20 bp, Influenza A virus
tgagaataaatcagaagcat

SEQ ID NO: 50083 - DNA, 20 bp, Influenza A virus
gagaataaatcagaagcatg

SEQ ID NO: 50084 - DNA, 20 bp, Influenza A virus
gaagaatggttggtggaatt

SEQ ID NO: 50085 - DNA, 20 bp, Influenza A virus
gtggaattgggaggttttac

SEQ ID NO: 50086 - DNA, 20 bp, Influenza A virus
ggaggttttacgtacagatg

SEQ ID NO: 50087 - DNA, 20 bp, Influenza A virus
tacgtacagatgtgcactga

SEQ ID NO: 50088 - DNA, 20 bp, Influenza A virus
acgtacagatgtgcactgaa

SEQ ID NO: 50089 - DNA, 20 bp, Influenza A virus
ggatgataaagcgaggcatt

SEQ ID NO: 50090 - DNA, 20 bp, Influenza A virus
atgaccggaacttctggaga

SEQ ID NO: 50091 - DNA, 20 bp, Influenza A virus
tggagaggcgataatggacg

SEQ ID NO: 50092 - DNA, 20 bp, Influenza A virus
cacattctctcatatgcaat

SEQ ID NO: 50093 - DNA, 20 bp, Influenza A virus
tctcatatgcaatccttgtt

SEQ ID NO: 50094 - DNA, 20 bp, Influenza A virus
aagatctcatctttctggca

SEQ ID NO: 50095 - DNA, 20 bp, Influenza A virus
ctggcacggtctgcactcat

SEQ ID NO: 50096 - DNA, 20 bp, Influenza A virus
tggcacggtctgcactcatc

SEQ ID NO: 50097 - DNA, 20 bp, Influenza A virus
cctgcttgtgtgtacgggct

SEQ ID NO: 50098 - DNA, 20 bp, Influenza A virus
tgggctacggatcctctcag

SEQ ID NO: 50099 - DNA, 20 bp, Influenza A virus
gaggacctgagagtctcaag

SEQ ID NO: 50100 - DNA, 20 bp, Influenza A virus
aggacctgagagtctcaagt

SEQ ID NO: 50101 - DNA, 20 bp, Influenza A virus
cattagaggaacaagagtga

SEQ ID NO: 50102 - DNA, 20 bp, Influenza A virus
attagaggaacaagagtgat

SEQ ID NO: 50103 - DNA, 20 bp, Influenza A virus
gaggaacaagagtgatccca

SEQ ID NO: 50104 - DNA, 20 bp, Human papillomavirus type 132
gattatatgttgtcgcgtcg

SEQ ID NO: 50105 - DNA, 20 bp, Human papillomavirus type 132
tatgttgtcgcgtcgtcctt

SEQ ID NO: 50106 - DNA, 20 bp, Human papillomavirus type 132
tcgcgtcgtcctttggaata

SEQ ID NO: 50107 - DNA, 20 bp, Human papillomavirus type 132
ggaataagaagctttcagca

SEQ ID NO: 50108 - DNA, 20 bp, Human papillomavirus type 132
gaataagaagctttcagcat

SEQ ID NO: 50109 - DNA, 20 bp, Human papillomavirus type 132
gaaagtctctggaaagagac

SEQ ID NO: 50110 - DNA, 20 bp, Human papillomavirus type 132
ccagagactttcgaagtgga

SEQ ID NO: 50111 - DNA, 20 bp, Human papillomavirus type 132
cagagactttcgaagtggat

SEQ ID NO: 50112 - DNA, 20 bp, Human papillomavirus type 132
cgaagtggatggggtgtccg

SEQ ID NO: 50113 - DNA, 20 bp, Human papillomavirus type 132
gaagtggatggggtgtccgg

SEQ ID NO: 50114 - DNA, 20 bp, Human papillomavirus type 132
caaaacacggtctgtcggga

SEQ ID NO: 50115 - DNA, 20 bp, Human papillomavirus type 132
gacgacttcaagaagaggct

SEQ ID NO: 50116 - DNA, 20 bp, Human papillomavirus type 132
aagaagaggctcgggatccg

SEQ ID NO: 50117 - DNA, 20 bp, Human papillomavirus type 132
attttattaaaaggtcatcc

SEQ ID NO: 50118 - DNA, 20 bp, Human papillomavirus type 132
tattaaaaggtcatcctaat

SEQ ID NO: 50119 - DNA, 20 bp, Human papillomavirus type 132
taggaaatttggacagctta

SEQ ID NO: 50120 - DNA, 20 bp, Human papillomavirus type 132
aggaaatttggacagcttat

SEQ ID NO: 50121 - DNA, 20 bp, Human papillomavirus type 132
ggaaatttggacagcttata

SEQ ID NO: 50122 - DNA, 20 bp, Human papillomavirus type 132
ggacagcttataacatgcct

SEQ ID NO: 50123 - DNA, 20 bp, Human papillomavirus type 132
gacagcttataacatgccta

SEQ ID NO: 50124 - DNA, 20 bp, Human papillomavirus type 132
ggagagggtggtactgggcg

SEQ ID NO: 50125 - DNA, 20 bp, Human papillomavirus type 132
tggtaatacacctgttaaac

SEQ ID NO: 50126 - DNA, 20 bp, Human papillomavirus type 132
ggtaatacacctgttaaacc

SEQ ID NO: 50127 - DNA, 20 bp, Human papillomavirus type 132
gtaatacacctgttaaacca

SEQ ID NO: 50128 - DNA, 20 bp, Human papillomavirus type 132
aaccaaatacagctgtagag

SEQ ID NO: 50129 - DNA, 20 bp, Human papillomavirus type 132
ggaaaggggtgtttctgctg

SEQ ID NO: 50130 - DNA, 20 bp, Human papillomavirus type 132
ctgctgtattggatgtgcag

SEQ ID NO: 50131 - DNA, 20 bp, Human papillomavirus type 132
tgctgtattggatgtgcagc

SEQ ID NO: 50132 - DNA, 20 bp, Human papillomavirus type 132
gatgtgcagcctatacctga

SEQ ID NO: 50133 - DNA, 20 bp, Human papillomavirus type 132
caggtataggctgcacatcc

SEQ ID NO: 50134 - DNA, 20 bp, Human papillomavirus type 132
gagaccactttagttagagc

SEQ ID NO: 50135 - DNA, 20 bp, Human papillomavirus type 132
agttagagccagggaactgt

SEQ ID NO: 50136 - DNA, 20 bp, Human papillomavirus type 132
gttagagccagggaactgta

SEQ ID NO: 50137 - DNA, 20 bp, Human papillomavirus type 132
gagccagggaactgtataat

SEQ ID NO: 50138 - DNA, 20 bp, Human papillomavirus type 132
attatacagttccctggctc

SEQ ID NO: 50139 - DNA, 20 bp, Human papillomavirus type 132
gcaggccacggttaactgag

SEQ ID NO: 50140 - DNA, 20 bp, Human papillomavirus type 132
actgagtatgctccaggggt

SEQ ID NO: 50141 - DNA, 20 bp, Human papillomavirus type 132
gagtgagcagattgggtgaa

SEQ ID NO: 50142 - DNA, 20 bp, Human papillomavirus type 132
ggtgaaactaacactataac

SEQ ID NO: 50143 - DNA, 20 bp, Human papillomavirus type 132
ttatagtgttagtttcaccc

SEQ ID NO: 50144 - DNA, 20 bp, Human papillomavirus type 132
ttccatggatcctaaacaag

SEQ ID NO: 50145 - DNA, 20 bp, Human papillomavirus type 132
tccatggatcctaaacaagt

SEQ ID NO: 50146 - DNA, 20 bp, Human papillomavirus type 132
ccatggatcctaaacaagtt

SEQ ID NO: 50147 - DNA, 20 bp, Human papillomavirus type 132
catggatcctaaacaagttc

SEQ ID NO: 50148 - DNA, 20 bp, Human papillomavirus type 132
agttatttattgtaggatgt

SEQ ID NO: 50149 - DNA, 20 bp, Human papillomavirus type 132
agatttagtggacactttca

SEQ ID NO: 50150 - DNA, 20 bp, Human papillomavirus type 132
gatttagtggacactttcag

SEQ ID NO: 50151 - DNA, 20 bp, Human papillomavirus type 132
agtggacactttcagtatat

SEQ ID NO: 50152 - DNA, 20 bp, Human papillomavirus type 132
gtggacactttcagtatatg

SEQ ID NO: 50153 - DNA, 20 bp, Human papillomavirus type 132
cagtatatggccagattatt

SEQ ID NO: 50154 - DNA, 20 bp, Human papillomavirus type 132
tagctcatatcaatgtaatg

SEQ ID NO: 50155 - DNA, 20 bp, Human papillomavirus type 132
agctcatatcaatgtaatga

SEQ ID NO: 50156 - DNA, 20 bp, Human papillomavirus type 132
gctcatatcaatgtaatgaa

SEQ ID NO: 50157 - DNA, 20 bp, Human papillomavirus type 132
atcaatggcaattagctttt

SEQ ID NO: 50158 - DNA, 20 bp, Human papillomavirus type 132
gcttttgtacctccccctca

SEQ ID NO: 50159 - DNA, 20 bp, Human papillomavirus type 132
aggtaggaaatttttgtatc

SEQ ID NO: 50160 - DNA, 20 bp, Human papillomavirus type 132
ggtaggaaatttttgtatca

SEQ ID NO: 50161 - DNA, 20 bp, Human papillomavirus type 132
ttgtatcagataggcctgct

SEQ ID NO: 50162 - DNA, 20 bp, Human papillomavirus type 132
tgtatcagataggcctgcta

SEQ ID NO: 50163 - DNA, 20 bp, Human papillomavirus type 132
gtatcagataggcctgctaa

SEQ ID NO: 50164 - DNA, 20 bp, Human papillomavirus type 132
actgtggtcagttcttcagt

SEQ ID NO: 50165 - DNA, 20 bp, Human papillomavirus type 132
ctgtggtcagttcttcagta

SEQ ID NO: 50166 - DNA, 20 bp, Human papillomavirus type 132
ttcagtaacagttggtgaaa

SEQ ID NO: 50167 - DNA, 20 bp, Human papillomavirus type 132
agtaacagttggtgaaaact

SEQ ID NO: 50168 - DNA, 20 bp, Human papillomavirus type 132
gtgaaaactaccacttttgg

SEQ ID NO: 50169 - DNA, 20 bp, Influenza A virus
gctgcaatatgcacacattt

SEQ ID NO: 50170 - DNA, 20 bp, Influenza A virus
ctgcaatatgcacacatttg

SEQ ID NO: 50171 - DNA, 20 bp, Influenza A virus
ggaagtttgtttcatgtatt

SEQ ID NO: 50172 - DNA, 20 bp, Influenza A virus
gaagtttgtttcatgtattc

SEQ ID NO: 50173 - DNA, 20 bp, Influenza A virus
gtttcatgtattcggatttc

SEQ ID NO: 50174 - DNA, 20 bp, Influenza A virus
cttcctgatttgtatgatta

SEQ ID NO: 50175 - DNA, 20 bp, Influenza A virus
ttcctgatttgtatgattac

SEQ ID NO: 50176 - DNA, 20 bp, Influenza A virus
ctgatttgtatgattacaaa

SEQ ID NO: 50177 - DNA, 20 bp, Influenza A virus
gtatgattacaaagagaacc

SEQ ID NO: 50178 - DNA, 20 bp, Influenza A virus
tatgattacaaagagaaccg

SEQ ID NO: 50179 - DNA, 20 bp, Influenza A virus
ctttcgtcagtccgaaagag

SEQ ID NO: 50180 - DNA, 20 bp, Influenza A virus
cgtcagtccgaaagaggcga

SEQ ID NO: 50181 - DNA, 20 bp, Influenza A virus
gtcagtccgaaagaggcgaa

SEQ ID NO: 50182 - DNA, 20 bp, Influenza A virus
aagaaaaatttgagattaca

SEQ ID NO: 50183 - DNA, 20 bp, Influenza A virus
gagattacaggaactatgcg

SEQ ID NO: 50184 - DNA, 20 bp, Influenza A virus
aagtgggcactcggtgaaaa

SEQ ID NO: 50185 - DNA, 20 bp, Influenza A virus
gatgactgcaaagatgttgg

SEQ ID NO: 50186 - DNA, 20 bp, Influenza A virus
atgactgcaaagatgttgga

SEQ ID NO: 50187 - DNA, 20 bp, Influenza A virus
gagaccttaaacagtatgac

SEQ ID NO: 50188 - DNA, 20 bp, Influenza A virus
aacagtatgacagtgatgag

SEQ ID NO: 50189 - DNA, 20 bp, Influenza A virus
ccccgattgaacatatcgca

SEQ ID NO: 50190 - DNA, 20 bp, Influenza A virus
aacatatcgcaagcatgagg

SEQ ID NO: 50191 - DNA, 20 bp, Influenza A virus
tacagcagaagtgtcccact

SEQ ID NO: 50192 - DNA, 20 bp, Influenza A virus
acagcagaagtgtcccactg

SEQ ID NO: 50193 - DNA, 20 bp, Influenza A virus
cagcagaagtgtcccactgc

SEQ ID NO: 50194 - DNA, 20 bp, Influenza A virus
tcactcactgacccgagact

SEQ ID NO: 50195 - DNA, 20 bp, Influenza A virus
ttgaaataggagacatgctc

SEQ ID NO: 50196 - DNA, 20 bp, Influenza A virus
aaataggagacatgctcttg

SEQ ID NO: 50197 - DNA, 20 bp, Influenza A virus
aggactgcgataggccaagt

SEQ ID NO: 50198 - DNA, 20 bp, Influenza A virus
gcctatcgcagtcctcaaga

SEQ ID NO: 50199 - DNA, 20 bp, Influenza A virus
tgtcaaagagaaagacatga

SEQ ID NO: 50200 - DNA, 20 bp, Influenza A virus
tttgaaaacaaatcggaaac

SEQ ID NO: 50201 - DNA, 20 bp, Influenza A virus
gaaaacaaatcggaaacatg

SEQ ID NO: 50202 - DNA, 20 bp, Influenza A virus
aaaacaaatcggaaacatgg

SEQ ID NO: 50203 - DNA, 20 bp, Influenza A virus
ggaaagtgtgcaggacctta

SEQ ID NO: 50204 - DNA, 20 bp, Influenza A virus
ttatctatggcacataagaa

SEQ ID NO: 50205 - DNA, 20 bp, Influenza A virus
tctatggcacataagaaagc

SEQ ID NO: 50206 - DNA, 20 bp, Influenza A virus
gatgacaggctccgaagaga

SEQ ID NO: 50207 - DNA, 20 bp, Influenza A virus
atgacaggctccgaagagac

SEQ ID NO: 50208 - DNA, 20 bp, Influenza A virus
cctttaatgccttttggtct

SEQ ID NO: 50209 - DNA, 20 bp, Influenza A virus
tggtgaaaatggaccaagcc

SEQ ID NO: 50210 - DNA, 20 bp, Influenza A virus
ttttatccattatggcttgg

SEQ ID NO: 50211 - DNA, 20 bp, Influenza A virus
tatccattatggcttggtcc

SEQ ID NO: 50212 - DNA, 20 bp, Influenza A virus
atccattatggcttggtcca

SEQ ID NO: 50213 - DNA, 20 bp, Influenza A virus
tccattatggcttggtccat

SEQ ID NO: 50214 - DNA, 20 bp, Influenza A virus
gaatcctcatcggtggactt

SEQ ID NO: 50215 - DNA, 20 bp, Influenza A virus
aatggaatgataactcaatt

SEQ ID NO: 50216 - DNA, 20 bp, Influenza A virus
gagcgtctgaaaatatacag

SEQ ID NO: 50217 - DNA, 20 bp, Influenza A virus
gcttggggaatccatgatga

SEQ ID NO: 50218 - DNA, 20 bp, Influenza A virus
gggaatccatgatgagaatg

SEQ ID NO: 50219 - DNA, 20 bp, Influenza A virus
ccagagaaagagaagagtga

SEQ ID NO: 50220 - DNA, 20 bp, Influenza A virus
cagagaaagagaagagtgag

SEQ ID NO: 50221 - DNA, 20 bp, Influenza A virus
tgcttcttcttccctattgt

SEQ ID NO: 50222 - DNA, 20 bp, Influenza A virus
gcttcttcttccctattgtt

SEQ ID NO: 50223 - DNA, 20 bp, Influenza A virus
cttcttcttccctattgttc

SEQ ID NO: 50224 - DNA, 20 bp, Influenza A virus
tcgaagcactagcaaggagc

SEQ ID NO: 50225 - DNA, 20 bp, Influenza A virus
agcaatctggactccccgtt

SEQ ID NO: 50226 - DNA, 20 bp, Influenza A virus
gagggaatgagaagaaggct

SEQ ID NO: 50227 - DNA, 20 bp, Influenza A virus
gccaatttagccttcttctc

SEQ ID NO: 50228 - DNA, 20 bp, Influenza A virus
ccaatttagccttcttctca

SEQ ID NO: 50229 - DNA, 20 bp, Influenza A virus
ggcagaagaggtacaccaaa

SEQ ID NO: 50230 - DNA, 20 bp, Influenza A virus
cgctctcatagtgaatgcac

SEQ ID NO: 50231 - DNA, 20 bp, Influenza A virus
gctctcatagtgaatgcacc

SEQ ID NO: 50232 - DNA, 20 bp, Influenza A virus
ggtgcattcactatgagagc

SEQ ID NO: 50233 - DNA, 20 bp, Influenza A virus
gtgcattcactatgagagcg

SEQ ID NO: 50234 - DNA, 20 bp, Influenza A virus
ggagtttccggaattaatga

SEQ ID NO: 50235 - DNA, 20 bp, Influenza A virus
gagtttccggaattaatgaa

SEQ ID NO: 50236 - DNA, 20 bp, Influenza A virus
ccggaattaatgaatcggct

SEQ ID NO: 50237 - DNA, 20 bp, Influenza A virus
cggaattaatgaatcggctg

SEQ ID NO: 50238 - DNA, 20 bp, Influenza A virus
atgaatcggctgacatgagc

SEQ ID NO: 50239 - DNA, 20 bp, Influenza A virus
tcaacactagccaaagggga

SEQ ID NO: 50240 - DNA, 20 bp, Influenza A virus
ttgaggatgaacaaatgtac

SEQ ID NO: 50241 - DNA, 20 bp, Influenza A virus
aggatgaacaaatgtaccag

SEQ ID NO: 50242 - DNA, 20 bp, Influenza A virus
gagaaattcttccctagcag

SEQ ID NO: 50243 - DNA, 20 bp, Influenza A virus
ttccctagcagttcatatcg

SEQ ID NO: 50244 - DNA, 20 bp, Human papillomavirus type 85
cagtacatgtaataggatgg

SEQ ID NO: 50245 - DNA, 20 bp, Human papillomavirus type 85
ggcaatccagctacccgacc

SEQ ID NO: 50246 - DNA, 20 bp, Human papillomavirus type 85
gcaatccagctacccgaccc

SEQ ID NO: 50247 - DNA, 20 bp, Human papillomavirus type 85
cataggtctggtagtttgta

SEQ ID NO: 50248 - DNA, 20 bp, Human papillomavirus type 85
gtagggtcgggtagctggat

SEQ ID NO: 50249 - DNA, 20 bp, Human papillomavirus type 85
tgttagatttggaaccatat

SEQ ID NO: 50250 - DNA, 20 bp, Human papillomavirus type 85
gatttggaaccatataatga

SEQ ID NO: 50251 - DNA, 20 bp, Human papillomavirus type 85
ggaaccatataatgaagtgc

SEQ ID NO: 50252 - DNA, 20 bp, Human papillomavirus type 85
gaaccatataatgaagtgca

SEQ ID NO: 50253 - DNA, 20 bp, Human papillomavirus type 85
cacttcattatatggttcca

SEQ ID NO: 50254 - DNA, 20 bp, Human papillomavirus type 85
catgcacaggaagtagaaac

SEQ ID NO: 50255 - DNA, 20 bp, Human papillomavirus type 85
catgccttaaaacgaaagta

SEQ ID NO: 50256 - DNA, 20 bp, Human papillomavirus type 85
aaacgaaagtatggagcaca

SEQ ID NO: 50257 - DNA, 20 bp, Human papillomavirus type 85
tctgtgctgtgtgctccata

SEQ ID NO: 50258 - DNA, 20 bp, Human papillomavirus type 85
ctgtgctgtgtgctccatac

SEQ ID NO: 50259 - DNA, 20 bp, Human papillomavirus type 85
gtgaagtaacaggagacaca

SEQ ID NO: 50260 - DNA, 20 bp, Human papillomavirus type 85
tacaacatggtatagatgac

SEQ ID NO: 50261 - DNA, 20 bp, Human papillomavirus type 85
gacctgtcagaaatgataca

SEQ ID NO: 50262 - DNA, 20 bp, Human papillomavirus type 85
acctgtcagaaatgatacag

SEQ ID NO: 50263 - DNA, 20 bp, Human papillomavirus type 85
tcaaacgcccactgtatcat

SEQ ID NO: 50264 - DNA, 20 bp, Human papillomavirus type 85
cacatacatttccatttgat

SEQ ID NO: 50265 - DNA, 20 bp, Human papillomavirus type 85
ccatttgatagcaatggcaa

SEQ ID NO: 50266 - DNA, 20 bp, Human papillomavirus type 85
catttgatagcaatggcaat

SEQ ID NO: 50267 - DNA, 20 bp, Human papillomavirus type 85
gatagcaatggcaatccagt

SEQ ID NO: 50268 - DNA, 20 bp, Human papillomavirus type 85
atagcaatggcaatccagtg

SEQ ID NO: 50269 - DNA, 20 bp, Human papillomavirus type 85
aaacaataaaccaccacgtg

SEQ ID NO: 50270 - DNA, 20 bp, Human papillomavirus type 85
caaatttcaaaaagcaaagc

SEQ ID NO: 50271 - DNA, 20 bp, Human papillomavirus type 85
aaatttcaaaaagcaaagca

SEQ ID NO: 50272 - DNA, 20 bp, Human papillomavirus type 85
caaaaagcaaagcacatgaa

SEQ ID NO: 50273 - DNA, 20 bp, Human papillomavirus type 85
aaaaagcaaagcacatgaag

SEQ ID NO: 50274 - DNA, 20 bp, Human papillomavirus type 85
ctagagaattacaacacccc

SEQ ID NO: 50275 - DNA, 20 bp, Human papillomavirus type 85
caacaccccaccacaccgta

SEQ ID NO: 50276 - DNA, 20 bp, Human papillomavirus type 85
ggtgcacacggtggtggctt

SEQ ID NO: 50277 - DNA, 20 bp, Human papillomavirus type 85
ggtatacggtgtggtggggt

SEQ ID NO: 50278 - DNA, 20 bp, Human papillomavirus type 85
taattctctagcaattgcag

SEQ ID NO: 50279 - DNA, 20 bp, Human papillomavirus type 85
ttgatgtgtctcctgcaagg

SEQ ID NO: 50280 - DNA, 20 bp, Human papillomavirus type 85
atgtgtctcctgcaaggcca

SEQ ID NO: 50281 - DNA, 20 bp, Human papillomavirus type 85
taattgaatctgtggggcct

SEQ ID NO: 50282 - DNA, 20 bp, Human papillomavirus type 85
aatctgtggggccttcagat

SEQ ID NO: 50283 - DNA, 20 bp, Human papillomavirus type 85
agatccatctattgttacat

SEQ ID NO: 50284 - DNA, 20 bp, Human papillomavirus type 85
ggttattgaggttcctcaaa

SEQ ID NO: 50285 - DNA, 20 bp, Human papillomavirus type 85
ttgaggttcctcaaacaggg

SEQ ID NO: 50286 - DNA, 20 bp, Human papillomavirus type 85
aggttcctcaaacaggggag

SEQ ID NO: 50287 - DNA, 20 bp, Human papillomavirus type 85
ctcaaacaggggaggtgtct

SEQ ID NO: 50288 - DNA, 20 bp, Human papillomavirus type 85
ttattactacccctacatct

SEQ ID NO: 50289 - DNA, 20 bp, Human papillomavirus type 85
tgcctgatcctgattttatg

SEQ ID NO: 50290 - DNA, 20 bp, Human papillomavirus type 85
tatggatattgttcgtttac

SEQ ID NO: 50291 - DNA, 20 bp, Human papillomavirus type 85
atggatattgttcgtttaca

SEQ ID NO: 50292 - DNA, 20 bp, Human papillomavirus type 85
tggatattgttcgtttacat

SEQ ID NO: 50293 - DNA, 20 bp, Human papillomavirus type 85
ttcgtttacataggcctgcc

SEQ ID NO: 50294 - DNA, 20 bp, Human papillomavirus type 85
cgggttacattacctgaccc

SEQ ID NO: 50295 - DNA, 20 bp, Human papillomavirus type 85
gggttacattacctgaccct

SEQ ID NO: 50296 - DNA, 20 bp, Human papillomavirus type 85
cattacctgaccctaataaa

SEQ ID NO: 50297 - DNA, 20 bp, Human papillomavirus type 85
cctgaccctaataaatttgg

SEQ ID NO: 50298 - DNA, 20 bp, Human papillomavirus type 85
ggtcttccagacactaatat

SEQ ID NO: 50299 - DNA, 20 bp, Human papillomavirus type 85
cacacgacactagagataat

SEQ ID NO: 50300 - DNA, 20 bp, Human papillomavirus type 85
taaacaaacccagttatgta

SEQ ID NO: 50301 - DNA, 20 bp, Human papillomavirus type 85
tgtattattggttgtgttcc

SEQ ID NO: 50302 - DNA, 20 bp, Human papillomavirus type 85
ttggttgtgttcctgctatt

SEQ ID NO: 50303 - DNA, 20 bp, Human papillomavirus type 85
gttgtgttcctgctattggg

SEQ ID NO: 50304 - DNA, 20 bp, Human papillomavirus type 85
gtaaatatccagactatttg

SEQ ID NO: 50305 - DNA, 20 bp, Human papillomavirus type 85
taaatatccagactatttgc

SEQ ID NO: 50306 - DNA, 20 bp, Human papillomavirus type 85
gcaaatgtctgcagatgcat

SEQ ID NO: 50307 - DNA, 20 bp, Human papillomavirus type 85
caaatgtctgcagatgcata

SEQ ID NO: 50308 - DNA, 20 bp, Human papillomavirus type 85
ttttgtttacgacgcgaaca

SEQ ID NO: 50309 - DNA, 20 bp, Influenza A virus
gagagagctcggatgtttta

SEQ ID NO: 50310 - DNA, 20 bp, Influenza A virus
tagtcacaagagaaccctat

SEQ ID NO: 50311 - DNA, 20 bp, Influenza A virus
agtcacaagagaaccctatg

SEQ ID NO: 50312 - DNA, 20 bp, Influenza A virus
gtcacaagagaaccctatgt

SEQ ID NO: 50313 - DNA, 20 bp, Influenza A virus
catgcgacccagatgaatgc

SEQ ID NO: 50314 - DNA, 20 bp, Influenza A virus
atttctgcaacaggccttct

SEQ ID NO: 50315 - DNA, 20 bp, Influenza A virus
ctgcaacaggccttctgttg

SEQ ID NO: 50316 - DNA, 20 bp, Influenza A virus
tgcaacaggccttctgttgt

SEQ ID NO: 50317 - DNA, 20 bp, Influenza A virus
tgttgtaccatactactgca

SEQ ID NO: 50318 - DNA, 20 bp, Influenza A virus
taccatactactgcagatgc

SEQ ID NO: 50319 - DNA, 20 bp, Influenza A virus
aagaatgctcatgttacggg

SEQ ID NO: 50320 - DNA, 20 bp, Influenza A virus
cggggaacgaacaggaatta

SEQ ID NO: 50321 - DNA, 20 bp, Influenza A virus
cctgcacatgcagggacaat

SEQ ID NO: 50322 - DNA, 20 bp, Influenza A virus
gcagggctcaaatagaccag

SEQ ID NO: 50323 - DNA, 20 bp, Influenza A virus
agatagacccagtagcaatg

SEQ ID NO: 50324 - DNA, 20 bp, Influenza A virus
gctagggaggacaataagca

SEQ ID NO: 50325 - DNA, 20 bp, Influenza A virus
aaagtgccaaatgcattgac

SEQ ID NO: 50326 - DNA, 20 bp, Influenza A virus
ggcacttttaacatctcgta

SEQ ID NO: 50327 - DNA, 20 bp, Influenza A virus
gcacttttaacatctcgtat

SEQ ID NO: 50328 - DNA, 20 bp, Influenza A virus
taacatctcgtatccagacc

SEQ ID NO: 50329 - DNA, 20 bp, Influenza A virus
attctgagtgcggggttctt

SEQ ID NO: 50330 - DNA, 20 bp, Influenza A virus
tgagtgcggggttcttctct

SEQ ID NO: 50331 - DNA, 20 bp, Influenza A virus
ttctcttgccttcctgatgt

SEQ ID NO: 50332 - DNA, 20 bp, Influenza A virus
tcttgccttcctgatgtgta

SEQ ID NO: 50333 - DNA, 20 bp, Influenza A virus
ccttcctgatgtgtactttt

SEQ ID NO: 50334 - DNA, 20 bp, Influenza A virus
attaccctaaggtatataaa

SEQ ID NO: 50335 - DNA, 20 bp, Influenza A virus
ccctaaggtatataaaactt

SEQ ID NO: 50336 - DNA, 20 bp, Influenza A virus
tttcgaaaaggtcgaaaggt

SEQ ID NO: 50337 - DNA, 20 bp, Influenza A virus
cgaaaaggtcgaaaggttga

SEQ ID NO: 50338 - DNA, 20 bp, Influenza A virus
gaaaaggtcgaaaggttgaa

SEQ ID NO: 50339 - DNA, 20 bp, Influenza A virus
taaaattgctcccttgatgg

SEQ ID NO: 50340 - DNA, 20 bp, Influenza A virus
ctcccttgatggtggcgtac

SEQ ID NO: 50341 - DNA, 20 bp, Influenza A virus
atggtggcgtacatgctaga

SEQ ID NO: 50342 - DNA, 20 bp, Influenza A virus
gtccgtaaaacaaggtttct

SEQ ID NO: 50343 - DNA, 20 bp, Influenza A virus
ttttacggaccaattctctt

SEQ ID NO: 50344 - DNA, 20 bp, Influenza A virus
gcatctctcttggaaatgtg

SEQ ID NO: 50345 - DNA, 20 bp, Influenza A virus
gaaatgtgccacagcacaca

SEQ ID NO: 50346 - DNA, 20 bp, Influenza A virus
ctcctccaatctgtgtgctg

SEQ ID NO: 50347 - DNA, 20 bp, Influenza A virus
ccaagagagatgctaatggg

SEQ ID NO: 50348 - DNA, 20 bp, Influenza A virus
caagagagatgctaatgggt

SEQ ID NO: 50349 - DNA, 20 bp, Influenza A virus
acaatggttgggagaagagc

SEQ ID NO: 50350 - DNA, 20 bp, Influenza A virus
ggagaagagcaacagctatt

SEQ ID NO: 50351 - DNA, 20 bp, Influenza A virus
tcagaaaggcaaccaggaga

SEQ ID NO: 50352 - DNA, 20 bp, Influenza A virus
cctttctgagaatagctgtt

SEQ ID NO: 50353 - DNA, 20 bp, Influenza A virus
ctgagaatagctgttgctct

SEQ ID NO: 50354 - DNA, 20 bp, Influenza A virus
acaataacttattcgtcatc

SEQ ID NO: 50355 - DNA, 20 bp, Influenza A virus
ttcgtcatcaatgatgtggg

SEQ ID NO: 50356 - DNA, 20 bp, Influenza A virus
gtcatcaatgatgtgggaga

SEQ ID NO: 50357 - DNA, 20 bp, Influenza A virus
tccattgataagtgttgact

SEQ ID NO: 50358 - DNA, 20 bp, Influenza A virus
ataagtgttgactagcactg

SEQ ID NO: 50359 - DNA, 20 bp, Influenza A virus
ggacatttgacactgtccaa

SEQ ID NO: 50360 - DNA, 20 bp, Influenza A virus
gacactgtccaaataataaa

SEQ ID NO: 50361 - DNA, 20 bp, Influenza A virus
acactgtccaaataataaaa

SEQ ID NO: 50362 - DNA, 20 bp, Influenza A virus
tcccctttgctgctgcccca

SEQ ID NO: 50363 - DNA, 20 bp, Influenza A virus
gctgctgccccaccagaaca

SEQ ID NO: 50364 - DNA, 20 bp, Influenza A virus
ctcattttgggcaaagaaga

SEQ ID NO: 50365 - DNA, 20 bp, Influenza A virus
tcattttgggcaaagaagac

SEQ ID NO: 50366 - DNA, 20 bp, Influenza A virus
tgggcaaagaagacaagaga

SEQ ID NO: 50367 - DNA, 20 bp, Influenza A virus
gggcaaagaagacaagagat

SEQ ID NO: 50368 - DNA, 20 bp, Influenza A virus
ggcaaagaagacaagagata

SEQ ID NO: 50369 - DNA, 20 bp, Human papillomavirus
ctgtgagcctcagtgtatta

SEQ ID NO: 50370 - DNA, 20 bp, Human papillomavirus
attctgatggaatccaaacc

SEQ ID NO: 50371 - DNA, 20 bp, Human papillomavirus
tgatggaatccaaaccaaga

SEQ ID NO: 50372 - DNA, 20 bp, Human papillomavirus
ggaggagtattgcaaacatt

SEQ ID NO: 50373 - DNA, 20 bp, Human papillomavirus
gaggagtattgcaaacatta

SEQ ID NO: 50374 - DNA, 20 bp, Human papillomavirus
tttagagttgacacgctttg

SEQ ID NO: 50375 - DNA, 20 bp, Human papillomavirus
agagttgacacgctttgcta

SEQ ID NO: 50376 - DNA, 20 bp, Human papillomavirus
gagttgacacgctttgctac

SEQ ID NO: 50377 - DNA, 20 bp, Human papillomavirus
acacgctttgctacttttgt

SEQ ID NO: 50378 - DNA, 20 bp, Human papillomavirus
gctacttttgtaaggttaga

SEQ ID NO: 50379 - DNA, 20 bp, Human papillomavirus
gagtccgaggctggaagctg

SEQ ID NO: 50380 - DNA, 20 bp, Human papillomavirus
agtccgaggctggaagctgt

SEQ ID NO: 50381 - DNA, 20 bp, Human papillomavirus
acatttctccacaaagagtg

SEQ ID NO: 50382 - DNA, 20 bp, Human papillomavirus
ctccacaaagagtgtcgaaa

SEQ ID NO: 50383 - DNA, 20 bp, Human papillomavirus
tccacaaagagtgtcgaaaa

SEQ ID NO: 50384 - DNA, 20 bp, Human papillomavirus
cccctccagaagacgaagaa

SEQ ID NO: 50385 - DNA, 20 bp, Human papillomavirus
tcagtggtgtcccatctcct

SEQ ID NO: 50386 - DNA, 20 bp, Human papillomavirus
aaagaaaaaatcttacacga

SEQ ID NO: 50387 - DNA, 20 bp, Human papillomavirus
cacgagttggaagattgcaa

SEQ ID NO: 50388 - DNA, 20 bp, Human papillomavirus
gaagattgcaagcagaagct

SEQ ID NO: 50389 - DNA, 20 bp, Human papillomavirus
ggttacagaccattaggtga

SEQ ID NO: 50390 - DNA, 20 bp, Human papillomavirus
cagaccattaggtgaagctg

SEQ ID NO: 50391 - DNA, 20 bp, Human papillomavirus
ggtgaagctggtggatcacg

SEQ ID NO: 50392 - DNA, 20 bp, Human papillomavirus
tggtagaccaataacatcaa

SEQ ID NO: 50393 - DNA, 20 bp, Human papillomavirus
caggagttgatgttattggt

SEQ ID NO: 50394 - DNA, 20 bp, Human papillomavirus
gggtggaagaattagaatta

SEQ ID NO: 50395 - DNA, 20 bp, Human papillomavirus
gaattatatacaatcactga

SEQ ID NO: 50396 - DNA, 20 bp, Human papillomavirus
tatacaatcactgactctac

SEQ ID NO: 50397 - DNA, 20 bp, Human papillomavirus
gttgtaacagtagtagattg

SEQ ID NO: 50398 - DNA, 20 bp, Human papillomavirus
taacagtagtagattgagtg

SEQ ID NO: 50399 - DNA, 20 bp, Human papillomavirus
gagcgggacttggcagaagt

SEQ ID NO: 50400 - DNA, 20 bp, Human papillomavirus
agcgggacttggcagaagta

SEQ ID NO: 50401 - DNA, 20 bp, Human papillomavirus
gcagaagtagcagcagcacc

SEQ ID NO: 50402 - DNA, 20 bp, Human papillomavirus
agagacgttactagattaca

SEQ ID NO: 50403 - DNA, 20 bp, Human papillomavirus
tctggtgctgctgctacttc

SEQ ID NO: 50404 - DNA, 20 bp, Human papillomavirus
acgacatactagctacaacg

SEQ ID NO: 50405 - DNA, 20 bp, Human papillomavirus
tacacaatgatgatatttta

SEQ ID NO: 50406 - DNA, 20 bp, Human papillomavirus
tgtataacatctgttgcatt

SEQ ID NO: 50407 - DNA, 20 bp, Human papillomavirus
catttatagggtctatcacc

SEQ ID NO: 50408 - DNA, 20 bp, Human papillomavirus
atagggtctatcaccgttgt

SEQ ID NO: 50409 - DNA, 20 bp, Human papillomavirus
aggaataggtactacaggcc

SEQ ID NO: 50410 - DNA, 20 bp, Human papillomavirus
ggaataggtactacaggcca

SEQ ID NO: 50411 - DNA, 20 bp, Human papillomavirus
ctttaacaaagtaggtgata

SEQ ID NO: 50412 - DNA, 20 bp, Human papillomavirus
aacaaagtaggtgatacaga

SEQ ID NO: 50413 - DNA, 20 bp, Human papillomavirus
acaaagtaggtgatacagag

SEQ ID NO: 50414 - DNA, 20 bp, Human papillomavirus
ggacatgctaattttagccg

SEQ ID NO: 50415 - DNA, 20 bp, Human papillomavirus
gacatgctaattttagccgt

SEQ ID NO: 50416 - DNA, 20 bp, Human papillomavirus
tagccgtttacaagaagata

SEQ ID NO: 50417 - DNA, 20 bp, Human papillomavirus
agccgtttacaagaagataa

SEQ ID NO: 50418 - DNA, 20 bp, Human papillomavirus
gccgtttacaagaagataaa

SEQ ID NO: 50419 - DNA, 20 bp, Human papillomavirus
tatttattactcatgggggt

SEQ ID NO: 50420 - DNA, 20 bp, Human papillomavirus
atttattactcatgggggtg

SEQ ID NO: 50421 - DNA, 20 bp, Human papillomavirus
tttattactcatgggggtgc

SEQ ID NO: 50422 - DNA, 20 bp, Human papillomavirus
attactcatgggggtgcatt

SEQ ID NO: 50423 - DNA, 20 bp, Human papillomavirus
ttactcatgggggtgcattc

SEQ ID NO: 50424 - DNA, 20 bp, Human papillomavirus type 103
tgagaagtcattgtgtatgt

SEQ ID NO: 50425 - DNA, 20 bp, Human papillomavirus type 103
tgtatgtatgtggtagccac

SEQ ID NO: 50426 - DNA, 20 bp, Human papillomavirus type 103
gaaactttgaacaacagctg

SEQ ID NO: 50427 - DNA, 20 bp, Human papillomavirus type 103
gaacaacagctgtgtggaaa

SEQ ID NO: 50428 - DNA, 20 bp, Human papillomavirus type 103
aacaacagctgtgtggaaac

SEQ ID NO: 50429 - DNA, 20 bp, Human papillomavirus type 103
actaattcagggacattgac

SEQ ID NO: 50430 - DNA, 20 bp, Human papillomavirus type 103
agggacattgactaatgggg

SEQ ID NO: 50431 - DNA, 20 bp, Human papillomavirus type 103
actaatggggatgaaaatgc

SEQ ID NO: 50432 - DNA, 20 bp, Human papillomavirus type 103
tacacagcagtaatagacaa

SEQ ID NO: 50433 - DNA, 20 bp, Human papillomavirus type 103
acacagcagtaatagacaag

SEQ ID NO: 50434 - DNA, 20 bp, Human papillomavirus type 103
gcaatgtgctaaacgtgcag

SEQ ID NO: 50435 - DNA, 20 bp, Human papillomavirus type 103
tttttttataaacaaagcat

SEQ ID NO: 50436 - DNA, 20 bp, Human papillomavirus type 103
ttttataaacaaagcatgtc

SEQ ID NO: 50437 - DNA, 20 bp, Human papillomavirus type 103
tttataaacaaagcatgtct

SEQ ID NO: 50438 - DNA, 20 bp, Human papillomavirus type 103
ttataaacaaagcatgtcta

SEQ ID NO: 50439 - DNA, 20 bp, Human papillomavirus type 103
gggcttatagacgatgctac

SEQ ID NO: 50440 - DNA, 20 bp, Human papillomavirus type 103
tagacgatgctacatttcca

SEQ ID NO: 50441 - DNA, 20 bp, Human papillomavirus type 103
ccatgtttccaatttatgga

SEQ ID NO: 50442 - DNA, 20 bp, Human papillomavirus type 103
catgtttccaatttatggat

SEQ ID NO: 50443 - DNA, 20 bp, Human papillomavirus type 103
ccaatttatggatgtgtata

SEQ ID NO: 50444 - DNA, 20 bp, Human papillomavirus type 103
taaggcaggagcatgtactg

SEQ ID NO: 50445 - DNA, 20 bp, Human papillomavirus type 103
ggcctacaaaaagtgccccc

SEQ ID NO: 50446 - DNA, 20 bp, Human papillomavirus type 103
gcagcatctgaaagcaaagc

SEQ ID NO: 50447 - DNA, 20 bp, Human papillomavirus type 103
tgatgcagttggtgctgaaa

SEQ ID NO: 50448 - DNA, 20 bp, Human papillomavirus type 103
tcagcaccaactgcatcata

SEQ ID NO: 50449 - DNA, 20 bp, Human papillomavirus type 103
atagacatggtaaagcaaaa

SEQ ID NO: 50450 - DNA, 20 bp, Human papillomavirus type 103
tagacatggtaaagcaaaaa

SEQ ID NO: 50451 - DNA, 20 bp, Human papillomavirus type 103
tgtgcattttaccaaggaag

SEQ ID NO: 50452 - DNA, 20 bp, Human papillomavirus type 103
taccaaggaagcagtaaaat

SEQ ID NO: 50453 - DNA, 20 bp, Human papillomavirus type 103
accaaggaagcagtaaaata

SEQ ID NO: 50454 - DNA, 20 bp, Human papillomavirus type 103
tttcagtgtattagcacagc

SEQ ID NO: 50455 - DNA, 20 bp, Human papillomavirus type 103
cagtgtattagcacagcttt

SEQ ID NO: 50456 - DNA, 20 bp, Human papillomavirus type 103
agtgtattagcacagctttt

SEQ ID NO: 50457 - DNA, 20 bp, Human papillomavirus type 103
gcacagcttttacatgggtg

SEQ ID NO: 50458 - DNA, 20 bp, Human papillomavirus type 103
tacatgggtggcggatgcgg

SEQ ID NO: 50459 - DNA, 20 bp, Human papillomavirus type 103
ccattgggtcggggtctgca

SEQ ID NO: 50460 - DNA, 20 bp, Human papillomavirus type 103
ggtcggggtctgcaggtggg

SEQ ID NO: 50461 - DNA, 20 bp, Human papillomavirus type 103
cccgacccccacctgcagac

SEQ ID NO: 50462 - DNA, 20 bp, Human papillomavirus type 103
cgccatcatacatctctgta

SEQ ID NO: 50463 - DNA, 20 bp, Human papillomavirus type 103
cacaatctgcagctgaggtg

SEQ ID NO: 50464 - DNA, 20 bp, Human papillomavirus type 103
tgtaacagggtctgtaggat

SEQ ID NO: 50465 - DNA, 20 bp, Human papillomavirus type 103
ggtcaacgtggcactattcg

SEQ ID NO: 50466 - DNA, 20 bp, Human papillomavirus type 103
gtacaagaagtggcctgcaa

SEQ ID NO: 50467 - DNA, 20 bp, Human papillomavirus type 103
ttattatgatttaagtagta

SEQ ID NO: 50468 - DNA, 20 bp, Human papillomavirus type 103
ttatgatttaagtagtatcc

SEQ ID NO: 50469 - DNA, 20 bp, Human papillomavirus type 103
tgatttaagtagtatccacc

SEQ ID NO: 50470 - DNA, 20 bp, Human papillomavirus type 103
gcatatgttttaatattttg

SEQ ID NO: 50471 - DNA, 20 bp, Human papillomavirus type 103
taatattttgcagatgtctt

SEQ ID NO: 50472 - DNA, 20 bp, Human papillomavirus type 103
aatattttgcagatgtcttt

SEQ ID NO: 50473 - DNA, 20 bp, Human papillomavirus type 103
atattttgcagatgtctttg

SEQ ID NO: 50474 - DNA, 20 bp, Human papillomavirus type 103
tgcagatgtctttgtggctg

SEQ ID NO: 50475 - DNA, 20 bp, Human papillomavirus type 103
gtagtaggctgtactccttg

SEQ ID NO: 50476 - DNA, 20 bp, Human papillomavirus type 103
tagtaggctgtactccttgt

SEQ ID NO: 50477 - DNA, 20 bp, Human papillomavirus type 103
tttgggggagcattgggatg

SEQ ID NO: 50478 - DNA, 20 bp, Human papillomavirus type 103
gggggagcattgggatgctg

SEQ ID NO: 50479 - DNA, 20 bp, Human papillomavirus type 103
ggggagcattgggatgctgc

SEQ ID NO: 50480 - DNA, 20 bp, Human papillomavirus type 103
tacaataaatgttaagtcag

SEQ ID NO: 50481 - DNA, 20 bp, Human papillomavirus type 103
acaataaatgttaagtcaga

SEQ ID NO: 50482 - DNA, 20 bp, Human papillomavirus type 103
caataaatgttaagtcagac

SEQ ID NO: 50483 - DNA, 20 bp, Human papillomavirus type 103
agtcagacgctggcgttgca

SEQ ID NO: 50484 - DNA, 20 bp, Human papillomavirus type 103
cacagcaatatgctgccacc

SEQ ID NO: 50485 - DNA, 20 bp, Human papillomavirus type 103
acagatatcctttgggtcgc

SEQ ID NO: 50486 - DNA, 20 bp, Human papillomavirus type 103
gggtcgcagatttttatctc

SEQ ID NO: 50487 - DNA, 20 bp, Human papillomavirus type 103
ggtcgcagatttttatctca

SEQ ID NO: 50488 - DNA, 20 bp, Human papillomavirus type 103
ttatctcaaactggggttag

SEQ ID NO: 50489 - DNA, 20 bp, Human papillomavirus type 103
tatctcaaactggggttagc

SEQ ID NO: 50490 - DNA, 20 bp, Human papillomavirus type 103
cagcaaccgaattagttatc

SEQ ID NO: 50491 - DNA, 20 bp, Human papillomavirus type 103
gttatctggccgttggccac

SEQ ID NO: 50492 - DNA, 20 bp, Human papillomavirus type 103
tctggccgttggccacgacc

SEQ ID NO: 50493 - DNA, 20 bp, Human papillomavirus type 103
gccacgaccggcagcgatgt

SEQ ID NO: 50494 - DNA, 20 bp, Human papillomavirus type 103
tgtaatattcttgatcctat

SEQ ID NO: 50495 - DNA, 20 bp, Human papillomavirus type 60
tcacccgatggtgatcctga

SEQ ID NO: 50496 - DNA, 20 bp, Human papillomavirus type 60
gcaacaggtgtctattgtat

SEQ ID NO: 50497 - DNA, 20 bp, Human papillomavirus type 60
caacaggtgtctattgtata

SEQ ID NO: 50498 - DNA, 20 bp, Human papillomavirus type 60
tatagggatagtgctcctcc

SEQ ID NO: 50499 - DNA, 20 bp, Human papillomavirus type 60
ttcgacatggcagatcctaa

SEQ ID NO: 50500 - DNA, 20 bp, Human papillomavirus type 60
tcgacatggcagatcctaat

SEQ ID NO: 50501 - DNA, 20 bp, Human papillomavirus type 60
cgacatggcagatcctaata

SEQ ID NO: 50502 - DNA, 20 bp, Human papillomavirus type 60
gacatggcagatcctaataa

SEQ ID NO: 50503 - DNA, 20 bp, Human papillomavirus type 60
attctcttgaattaaatgag

SEQ ID NO: 50504 - DNA, 20 bp, Human papillomavirus type 60
ctgacctaagtccaaggttg

SEQ ID NO: 50505 - DNA, 20 bp, Human papillomavirus type 60
gaagctgtcacaatttcacc

SEQ ID NO: 50506 - DNA, 20 bp, Human papillomavirus type 60
cacctcagagacaaagcaaa

SEQ ID NO: 50507 - DNA, 20 bp, Human papillomavirus type 60
acctcagagacaaagcaaaa

SEQ ID NO: 50508 - DNA, 20 bp, Human papillomavirus type 60
tgctttgtctctgaggtgaa

SEQ ID NO: 50509 - DNA, 20 bp, Human papillomavirus type 60
aacgcgaccgtttaaaagtg

SEQ ID NO: 50510 - DNA, 20 bp, Human papillomavirus type 60
acgcgaccgtttaaaagtga

SEQ ID NO: 50511 - DNA, 20 bp, Human papillomavirus type 60
aaaagtgatagatcatgttg

SEQ ID NO: 50512 - DNA, 20 bp, Human papillomavirus type 60
aaagtgatagatcatgttgt

SEQ ID NO: 50513 - DNA, 20 bp, Human papillomavirus type 60
tgaaaactgggttataagtg

SEQ ID NO: 50514 - DNA, 20 bp, Human papillomavirus type 60
gatagtgatgcacaaacata

SEQ ID NO: 50515 - DNA, 20 bp, Human papillomavirus type 60
atagtgatgcacaaacatat

SEQ ID NO: 50516 - DNA, 20 bp, Human papillomavirus type 60
acaaactgggacatggacag

SEQ ID NO: 50517 - DNA, 20 bp, Human papillomavirus type 60
taaaaaccaaattatttctg

SEQ ID NO: 50518 - DNA, 20 bp, Human papillomavirus type 60
tttctgctcctgttaccagc

SEQ ID NO: 50519 - DNA, 20 bp, Human papillomavirus type 60
gattacgacgccgaagatcc

SEQ ID NO: 50520 - DNA, 20 bp, Human papillomavirus type 60
cgacgccgaagatccaacga

SEQ ID NO: 50521 - DNA, 20 bp, Human papillomavirus type 60
gtcgggtactctgcgtcttt

SEQ ID NO: 50522 - DNA, 20 bp, Human papillomavirus type 60
tggtacggggcgactctctg

SEQ ID NO: 50523 - DNA, 20 bp, Human papillomavirus type 60
ggtacggggcgactctctgg

SEQ ID NO: 50524 - DNA, 20 bp, Human papillomavirus type 60
atactcaaccaacagtatat

SEQ ID NO: 50525 - DNA, 20 bp, Human papillomavirus type 60
ataatacagttgctacatta

SEQ ID NO: 50526 - DNA, 20 bp, Human papillomavirus type 60
ctacattagacattacacca

SEQ ID NO: 50527 - DNA, 20 bp, Human papillomavirus type 60
gacattacaccagctacacc

SEQ ID NO: 50528 - DNA, 20 bp, Human papillomavirus type 60
caccagctacaccaccagtg

SEQ ID NO: 50529 - DNA, 20 bp, Human papillomavirus type 60
gaaatagaagaacctccacg

SEQ ID NO: 50530 - DNA, 20 bp, Human papillomavirus type 60
aaatagaagaacctccacgt

SEQ ID NO: 50531 - DNA, 20 bp, Human papillomavirus type 60
caacgtgttacaacacgggc

SEQ ID NO: 50532 - DNA, 20 bp, Human papillomavirus type 60
aacgtgttacaacacgggca

SEQ ID NO: 50533 - DNA, 20 bp, Human papillomavirus type 60
caacacgggcaagggaatta

SEQ ID NO: 50534 - DNA, 20 bp, Human papillomavirus type 60
cagatgtcagggaattagga

SEQ ID NO: 50535 - DNA, 20 bp, Human papillomavirus type 60
ggacgagctcggttttcaga

SEQ ID NO: 50536 - DNA, 20 bp, Human papillomavirus type 60
tcagaaacatctgcaggaac

SEQ ID NO: 50537 - DNA, 20 bp, Human papillomavirus type 60
cagaaacatctgcaggaaca

SEQ ID NO: 50538 - DNA, 20 bp, Human papillomavirus type 60
agaaacatctgcaggaacaa

SEQ ID NO: 50539 - DNA, 20 bp, Human papillomavirus type 60
acagaaaactttaataatgc

SEQ ID NO: 50540 - DNA, 20 bp, Human papillomavirus type 60
cagaaaactttaataatgca

SEQ ID NO: 50541 - DNA, 20 bp, Human papillomavirus type 60
aataatgcacagctgatatt

SEQ ID NO: 50542 - DNA, 20 bp, Human papillomavirus type 60
ataatgcacagctgatattt

SEQ ID NO: 50543 - DNA, 20 bp, Human papillomavirus type 60
gcaacaatagatgaaggaga

SEQ ID NO: 50544 - DNA, 20 bp, Human papillomavirus type 60
tatttacatcctcatcttct

SEQ ID NO: 50545 - DNA, 20 bp, Human papillomavirus type 60
atttacatcctcatcttctt

SEQ ID NO: 50546 - DNA, 20 bp, Human papillomavirus type 60
tttacatcctcatcttctta

SEQ ID NO: 50547 - DNA, 20 bp, Human papillomavirus type 60
acatcctcatcttcttaggc

SEQ ID NO: 50548 - DNA, 20 bp, Human papillomavirus type 60
catcctcatcttcttaggcg

SEQ ID NO: 50549 - DNA, 20 bp, Human papillomavirus type 60
tgcgactactatttccagat

SEQ ID NO: 50550 - DNA, 20 bp, Human papillomavirus type 60
ccagatccaaacaaatttgc

SEQ ID NO: 50551 - DNA, 20 bp, Human papillomavirus type 60
cagatccaaacaaatttgca

SEQ ID NO: 50552 - DNA, 20 bp, Human papillomavirus type 60
gcaatgatagacagagctgt

SEQ ID NO: 50553 - DNA, 20 bp, Human papillomavirus type 60
caatgatagacagagctgtc

SEQ ID NO: 50554 - DNA, 20 bp, Human papillomavirus type 60
caatggatccaaaacaaatg

SEQ ID NO: 50555 - DNA, 20 bp, Human papillomavirus type 60
aatggatccaaaacaaatgc

SEQ ID NO: 50556 - DNA, 20 bp, Human papillomavirus type 60
tttattgtaggatgtaaacc

SEQ ID NO: 50557 - DNA, 20 bp, Human papillomavirus type 60
attgtaggatgtaaaccagc

SEQ ID NO: 50558 - DNA, 20 bp, Human papillomavirus type 60
ttgtaggatgtaaaccagcc

SEQ ID NO: 50559 - DNA, 20 bp, Human papillomavirus type 60
ataattatcttggcattgca

SEQ ID NO: 50560 - DNA, 20 bp, Human papillomavirus type 60
tcttggcattgcatatcgag

SEQ ID NO: 50561 - DNA, 20 bp, Human papillomavirus type 60
gcattgcatatcgagactat

SEQ ID NO: 50562 - DNA, 20 bp, Human papillomavirus type 60
catatcgagactataagaaa

SEQ ID NO: 50563 - DNA, 20 bp, Human papillomavirus type 60
gcacactctcggatttaaca

SEQ ID NO: 50564 - DNA, 20 bp, Human herpesvirus 4
ctgcgactcctgggcgccac

SEQ ID NO: 50565 - DNA, 20 bp, Human herpesvirus 4
gcgtggagatgggcaggcag

SEQ ID NO: 50566 - DNA, 20 bp, Human herpesvirus 4
ggcttcgaggtgcatagaag

SEQ ID NO: 50567 - DNA, 20 bp, Human herpesvirus 4
gcttcgaggtgcatagaagc

SEQ ID NO: 50568 - DNA, 20 bp, Human herpesvirus 4
gaggtgcatagaagccggcc

SEQ ID NO: 50569 - DNA, 20 bp, Human herpesvirus 4
gaggtgcagcacggcccaga

SEQ ID NO: 50570 - DNA, 20 bp, Human herpesvirus 4
aggtgcagcacggcccagag

SEQ ID NO: 50571 - DNA, 20 bp, Human herpesvirus 4
cgccagtcgctgcgcctgct

SEQ ID NO: 50572 - DNA, 20 bp, Human herpesvirus 4
ccagcagcaggcgcagcgac

SEQ ID NO: 50573 - DNA, 20 bp, Human herpesvirus 4
gatctggaccttgctcgccc

SEQ ID NO: 50574 - DNA, 20 bp, Human herpesvirus 4
ccaatcaattctgtgacggg

SEQ ID NO: 50575 - DNA, 20 bp, Human herpesvirus 4
tgtgacggggtttcctggac

SEQ ID NO: 50576 - DNA, 20 bp, Human herpesvirus 4
cctggacacccagtcttagt

SEQ ID NO: 50577 - DNA, 20 bp, Human herpesvirus 4
ctggacacccagtcttagtt

SEQ ID NO: 50578 - DNA, 20 bp, Human herpesvirus 4
gttcaggtagacacccagtt

SEQ ID NO: 50579 - DNA, 20 bp, Human herpesvirus 4
ggcctggctccccatagact

SEQ ID NO: 50580 - DNA, 20 bp, Human herpesvirus 4
tgcccccctggcggcccagc

SEQ ID NO: 50581 - DNA, 20 bp, Human herpesvirus 4
gcccccctggcggcccagcc

SEQ ID NO: 50582 - DNA, 20 bp, Human herpesvirus 4
cccccctggcggcccagccc

SEQ ID NO: 50583 - DNA, 20 bp, Human herpesvirus 4
catgggagtctatggggagc

SEQ ID NO: 50584 - DNA, 20 bp, Human herpesvirus 4
gcagaaaaaattaaagtcca

SEQ ID NO: 50585 - DNA, 20 bp, Human herpesvirus 4
aagtccacttacctctggcc

SEQ ID NO: 50586 - DNA, 20 bp, Human herpesvirus 4
cctctggcccgataccgggg

SEQ ID NO: 50587 - DNA, 20 bp, Human herpesvirus 4
acttcggtctcccctaggct

SEQ ID NO: 50588 - DNA, 20 bp, Human herpesvirus 4
ggtctcccctaggcttggat

SEQ ID NO: 50589 - DNA, 20 bp, Human herpesvirus 4
ctaactttttccccttccct

SEQ ID NO: 50590 - DNA, 20 bp, Human herpesvirus 4
taactttttccccttccctc

SEQ ID NO: 50591 - DNA, 20 bp, Human herpesvirus 4
ttccccttccctccctcgtc

SEQ ID NO: 50592 - DNA, 20 bp, Human herpesvirus 4
tccccttccctccctcgtct

SEQ ID NO: 50593 - DNA, 20 bp, Human herpesvirus 4
ccccttccctccctcgtctt

SEQ ID NO: 50594 - DNA, 20 bp, Human herpesvirus 4
tcccgtggacaatgtccctc

SEQ ID NO: 50595 - DNA, 20 bp, Human herpesvirus 4
gggatgcatcactttgagcc

SEQ ID NO: 50596 - DNA, 20 bp, Human herpesvirus 4
ggatgcatcactttgagcca

SEQ ID NO: 50597 - DNA, 20 bp, Human herpesvirus 4
gagccactaagcccccgttg

SEQ ID NO: 50598 - DNA, 20 bp, Human herpesvirus 4
agccactaagcccccgttgc

SEQ ID NO: 50599 - DNA, 20 bp, Human herpesvirus 4
taagagttaaaagcaactac

SEQ ID NO: 50600 - DNA, 20 bp, Human herpesvirus 4
aagagttaaaagcaactact

SEQ ID NO: 50601 - DNA, 20 bp, Human herpesvirus 4
agagttaaaagcaactactg

SEQ ID NO: 50602 - DNA, 20 bp, Human herpesvirus 4
aaagcaactactgtttattt

SEQ ID NO: 50603 - DNA, 20 bp, Human herpesvirus 4
attttccaaaatgagctggg

SEQ ID NO: 50604 - DNA, 20 bp, Human herpesvirus 4
gaggccgtgtagtttctgtg

SEQ ID NO: 50605 - DNA, 20 bp, Human herpesvirus 4
aggccgtgtagtttctgtgg

SEQ ID NO: 50606 - DNA, 20 bp, Human herpesvirus 4
ctgtggtgcggatgcattag

SEQ ID NO: 50607 - DNA, 20 bp, Human herpesvirus 4
tgtggtgcggatgcattagg

SEQ ID NO: 50608 - DNA, 20 bp, Human herpesvirus 4
ggcggcgcaatgcgggatct

SEQ ID NO: 50609 - DNA, 20 bp, Human herpesvirus 4
cttcttccacggcgccgcct

SEQ ID NO: 50610 - DNA, 20 bp, Human herpesvirus 4
ttccacggcgccgcctcgga

SEQ ID NO: 50611 - DNA, 20 bp, Human herpesvirus 4
cacggcgccgcctcggattc

SEQ ID NO: 50612 - DNA, 20 bp, Human herpesvirus 4
cgaccacgagtctttgtccc

SEQ ID NO: 50613 - DNA, 20 bp, Human herpesvirus 4
tcccgctgggcccagtctca

SEQ ID NO: 50614 - DNA, 20 bp, Human herpesvirus 4
gcgacagagttacaccagcg

SEQ ID NO: 50615 - DNA, 20 bp, Human herpesvirus 4
caccagcgactgcaccttcg

SEQ ID NO: 50616 - DNA, 20 bp, Human herpesvirus 4
tctcgtgtctgctgaacgtg

SEQ ID NO: 50617 - DNA, 20 bp, Human herpesvirus 4
cagatcccacgcctccagac

SEQ ID NO: 50618 - DNA, 20 bp, Human herpesvirus 4
agatcccacgcctccagacc

SEQ ID NO: 50619 - DNA, 20 bp, Human herpesvirus 4
taggcccggggacccgcggc

SEQ ID NO: 50620 - DNA, 20 bp, Human herpesvirus 4
aagacgctgctgatggtgtg

SEQ ID NO: 50621 - DNA, 20 bp, Human herpesvirus 4
aacgacttttgggctccagc

SEQ ID NO: 50622 - DNA, 20 bp, Human herpesvirus 4
acgacttttgggctccagcc

SEQ ID NO: 50623 - DNA, 20 bp, Human herpesvirus 4
tgggctccagccccaggaca

SEQ ID NO: 50624 - DNA, 20 bp, Human herpesvirus 4
gggctccagccccaggacac

SEQ ID NO: 50625 - DNA, 20 bp, Human herpesvirus 4
ccatcaatcgggggcctggg

SEQ ID NO: 50626 - DNA, 20 bp, Human herpesvirus 4
ccccgggattggccgccccc

SEQ ID NO: 50627 - DNA, 20 bp, Human herpesvirus 4
gccgcccccatcactctccc

SEQ ID NO: 50628 - DNA, 20 bp, Human herpesvirus 4
atggcaaggccctatttcgg

SEQ ID NO: 50629 - DNA, 20 bp, Human herpesvirus 4
ctgggcgccccatcgttcta

SEQ ID NO: 50630 - DNA, 20 bp, Human herpesvirus 4
tacgcaggactcggcctggt

SEQ ID NO: 50631 - DNA, 20 bp, Human herpesvirus 4
agggggtcgcagggagactc

SEQ ID NO: 50632 - DNA, 20 bp, Human herpesvirus 4
ccagccagagggtgccggcg

SEQ ID NO: 50633 - DNA, 20 bp, Human herpesvirus 4
cagccagagggtgccggcgt

SEQ ID NO: 50634 - DNA, 20 bp, Human herpesvirus 4
acccggcctacgtctccgca

SEQ ID NO: 50635 - DNA, 20 bp, Human herpesvirus 4
ccgccatctcgtgggccttc

SEQ ID NO: 50636 - DNA, 20 bp, Human herpesvirus 4
gccatcagggtctggctctc

SEQ ID NO: 50637 - DNA, 20 bp, Human herpesvirus 4
cacacggctctggaggccgt

SEQ ID NO: 50638 - DNA, 20 bp, Human herpesvirus 4
acacggctctggaggccgtc

SEQ ID NO: 50639 - DNA, 20 bp, Human herpesvirus 4
ctaattctggcccaggcctc

SEQ ID NO: 50640 - DNA, 20 bp, Human herpesvirus 4
tggcccaggcctcattcgcc

SEQ ID NO: 50641 - DNA, 20 bp, Human herpesvirus 4
gcctctcgcgctcgccgctc

SEQ ID NO: 50642 - DNA, 20 bp, Human herpesvirus 4
ggaaggcgctgggggcacgc

SEQ ID NO: 50643 - DNA, 20 bp, Human herpesvirus 4
gtggccagggacggcaggca

SEQ ID NO: 50644 - DNA, 20 bp, Human herpesvirus 4
gcggccaggtgctcatggaa

SEQ ID NO: 50645 - DNA, 20 bp, Human herpesvirus 4
cggccaggtgctcatggaac

SEQ ID NO: 50646 - DNA, 20 bp, Human herpesvirus 4
catgagcacctggccgcaaa

SEQ ID NO: 50647 - DNA, 20 bp, Human herpesvirus 4
cagtgggcctggttgcacga

SEQ ID NO: 50648 - DNA, 20 bp, Human herpesvirus 4
cacgaggccgtgcctaggat

SEQ ID NO: 50649 - DNA, 20 bp, Human herpesvirus 4
ggccgctttgccggcatcca

SEQ ID NO: 50650 - DNA, 20 bp, Human herpesvirus 4
gccgctttgccggcatccag

SEQ ID NO: 50651 - DNA, 20 bp, Human herpesvirus 4
gggccggcacgaggtggtgg

SEQ ID NO: 50652 - DNA, 20 bp, Human herpesvirus 4
tcgccgcctttgctcgcacg

SEQ ID NO: 50653 - DNA, 20 bp, Human herpesvirus 4
gctcgcacggcccgggtcca

SEQ ID NO: 50654 - DNA, 20 bp, Human herpesvirus 4
ctcgcacggcccgggtccag

SEQ ID NO: 50655 - DNA, 20 bp, Human herpesvirus 4
tccttcaccgctaccaccgc

SEQ ID NO: 50656 - DNA, 20 bp, Human herpesvirus 4
ccttcaccgctaccaccgcc

SEQ ID NO: 50657 - DNA, 20 bp, Human herpesvirus 4
cttcaccgctaccaccgcct

SEQ ID NO: 50658 - DNA, 20 bp, Human herpesvirus 4
accgctaccaccgcctcctc

SEQ ID NO: 50659 - DNA, 20 bp, Human herpesvirus 4
cgtcgccagagggatctgca

SEQ ID NO: 50660 - DNA, 20 bp, Human herpesvirus 4
atccttttgaaggaggcctg

SEQ ID NO: 50661 - DNA, 20 bp, Human herpesvirus 4
tgaaggaggcctgcaacgcc

SEQ ID NO: 50662 - DNA, 20 bp, Human herpesvirus 4
gaaggaggcctgcaacgccc

SEQ ID NO: 50663 - DNA, 20 bp, Human herpesvirus 4
aaggaggcctgcaacgccca

SEQ ID NO: 50664 - DNA, 20 bp, Human herpesvirus 4
tggcgcgacctgcagggcga

SEQ ID NO: 50665 - DNA, 20 bp, Human herpesvirus 4
atccccctgcgtgtcggccc

SEQ ID NO: 50666 - DNA, 20 bp, Human herpesvirus 4
cggggccggttgacatcatg

SEQ ID NO: 50667 - DNA, 20 bp, Human herpesvirus 4
acatcatgagcaagggccca

SEQ ID NO: 50668 - DNA, 20 bp, Human herpesvirus 4
ctcatgatgtcaaccggccc

SEQ ID NO: 50669 - DNA, 20 bp, Human herpesvirus 4
catgggacgaggcggcatct

SEQ ID NO: 50670 - DNA, 20 bp, Human herpesvirus 4
tctgctcggtagcagcggac

SEQ ID NO: 50671 - DNA, 20 bp, Human herpesvirus 4
gcctctgccgcattccggcc

SEQ ID NO: 50672 - DNA, 20 bp, Human herpesvirus 4
cggccgttagcgtgccaatc

SEQ ID NO: 50673 - DNA, 20 bp, Human herpesvirus 4
gcgtgccaatcttgaggttt

SEQ ID NO: 50674 - DNA, 20 bp, Human herpesvirus 4
gcacgctaacggccggaatg

SEQ ID NO: 50675 - DNA, 20 bp, Human herpesvirus 4
ccagccactccagcaacacc

SEQ ID NO: 50676 - DNA, 20 bp, Human herpesvirus 4
agctcgcgaggaaaaggaca

SEQ ID NO: 50677 - DNA, 20 bp, Human herpesvirus 4
tcctcgcgagctgaacagcc

SEQ ID NO: 50678 - DNA, 20 bp, Human herpesvirus 4
cctcgcgagctgaacagcca

SEQ ID NO: 50679 - DNA, 20 bp, Human herpesvirus 4
ctcgcgagctgaacagccag

SEQ ID NO: 50680 - DNA, 20 bp, Human herpesvirus 4
gtcggggtggagacgacctc

SEQ ID NO: 50681 - DNA, 20 bp, Human herpesvirus 4
caaagtagtgcctgtctgca

SEQ ID NO: 50682 - DNA, 20 bp, Human herpesvirus 4
tgcagacaggcactactttg

SEQ ID NO: 50683 - DNA, 20 bp, Human herpesvirus 4
gcagacaggcactactttgt

SEQ ID NO: 50684 - DNA, 20 bp, Human herpesvirus 4
cagacaggcactactttgta

SEQ ID NO: 50685 - DNA, 20 bp, Human herpesvirus 4
acttccgagtctggtcagag

SEQ ID NO: 50686 - DNA, 20 bp, Human herpesvirus 4
cttccgagtctggtcagagc

SEQ ID NO: 50687 - DNA, 20 bp, Human herpesvirus 4
cgagtctggtcagagcctgg

SEQ ID NO: 50688 - DNA, 20 bp, Human herpesvirus 4
ggctcctcggcatgggcgga

SEQ ID NO: 50689 - DNA, 20 bp, Human herpesvirus 4
gctcctcggcatgggcggag

SEQ ID NO: 50690 - DNA, 20 bp, Human herpesvirus 4
acgcggtagatgcggcgcag

SEQ ID NO: 50691 - DNA, 20 bp, Human herpesvirus 4
ggacgcagccacgccacgcg

SEQ ID NO: 50692 - DNA, 20 bp, Human herpesvirus 4
acatctcggccaggtggttc

SEQ ID NO: 50693 - DNA, 20 bp, Human herpesvirus 4
tggcacaaacaaaacaggcg

SEQ ID NO: 50694 - DNA, 20 bp, Human herpesvirus 4
cggaggccatcctcgatgcc

SEQ ID NO: 50695 - DNA, 20 bp, Human herpesvirus 4
cgcctgttttgtttgtgcca

SEQ ID NO: 50696 - DNA, 20 bp, Human herpesvirus 4
tgtttgtgccacaacgcctc

SEQ ID NO: 50697 - DNA, 20 bp, Human herpesvirus 4
gtttgtgccacaacgcctcg

SEQ ID NO: 50698 - DNA, 20 bp, Human herpesvirus 4
catcaactccgcctttgagc

SEQ ID NO: 50699 - DNA, 20 bp, Human herpesvirus 4
atcaactccgcctttgagcc

SEQ ID NO: 50700 - DNA, 20 bp, Human herpesvirus 4
gagcccgaggtgcccacccc

SEQ ID NO: 50701 - DNA, 20 bp, Human herpesvirus 4
agcccgaggtgcccaccccc

SEQ ID NO: 50702 - DNA, 20 bp, Human herpesvirus 4
caccgcctcccgtggtgcgg

SEQ ID NO: 50703 - DNA, 20 bp, Human herpesvirus 4
tgagctccgatggacgcagc

SEQ ID NO: 50704 - DNA, 20 bp, Human herpesvirus 4
gagctccgatggacgcagcg

SEQ ID NO: 50705 - DNA, 20 bp, Human herpesvirus 4
agctccgatggacgcagcgt

SEQ ID NO: 50706 - DNA, 20 bp, Human herpesvirus 4
tagcgccgctgattctggag

SEQ ID NO: 50707 - DNA, 20 bp, Human herpesvirus 4
tggaggattagccggagttc

SEQ ID NO: 50708 - DNA, 20 bp, Human herpesvirus 4
cttctgctccagtgcctccg

SEQ ID NO: 50709 - DNA, 20 bp, Human herpesvirus 4
tgctccagtgcctccgcctg

SEQ ID NO: 50710 - DNA, 20 bp, Human herpesvirus 4
cttcagagccttattctcag

SEQ ID NO: 50711 - DNA, 20 bp, Human herpesvirus 4
agagccttattctcagactc

SEQ ID NO: 50712 - DNA, 20 bp, Human herpesvirus 4
ctttctgtgccgttgtcccg

SEQ ID NO: 50713 - DNA, 20 bp, Human herpesvirus 4
ctgtgccgttgtcccgtgga

SEQ ID NO: 50714 - DNA, 20 bp, Human herpesvirus 4
tgtgccgttgtcccgtggag

SEQ ID NO: 50715 - DNA, 20 bp, Human herpesvirus 4
tcccgtggagatggacttgg

SEQ ID NO: 50716 - DNA, 20 bp, Human herpesvirus 4
gtgtcaccggtgatgcgcct

SEQ ID NO: 50717 - DNA, 20 bp, Human herpesvirus 4
attccttgagcaaaacctga

SEQ ID NO: 50718 - DNA, 20 bp, Human herpesvirus 4
ttccttgagcaaaacctgaa

SEQ ID NO: 50719 - DNA, 20 bp, Human herpesvirus 4
cttgagcaaaacctgaacat

SEQ ID NO: 50720 - DNA, 20 bp, Human herpesvirus 4
agcaaaacctgaacatcgaa

SEQ ID NO: 50721 - DNA, 20 bp, Human herpesvirus 4
atatggatgtgcatgacagt

SEQ ID NO: 50722 - DNA, 20 bp, Human herpesvirus 4
gacgtggacccttggttgta

SEQ ID NO: 50723 - DNA, 20 bp, Human herpesvirus 4
gttgtagagggaggtgttgg

SEQ ID NO: 50724 - DNA, 20 bp, Human herpesvirus 4
tagagggaggtgttggttgg

SEQ ID NO: 50725 - DNA, 20 bp, Human herpesvirus 4
gttggcgacattggcttctg

SEQ ID NO: 50726 - DNA, 20 bp, Human herpesvirus 4
gcgacattggcttctgacat

SEQ ID NO: 50727 - DNA, 20 bp, Human herpesvirus 4
cgagttcatctgtaaaagca

SEQ ID NO: 50728 - DNA, 20 bp, Human herpesvirus 4
gagttcatctgtaaaagcat

SEQ ID NO: 50729 - DNA, 20 bp, Human herpesvirus 4
atctgtaaaagcatgaaact

SEQ ID NO: 50730 - DNA, 20 bp, Human herpesvirus 4
catgcttttacagatgaact

SEQ ID NO: 50731 - DNA, 20 bp, Human herpesvirus 4
atgcttttacagatgaactc

SEQ ID NO: 50732 - DNA, 20 bp, Human herpesvirus 4
tgcgtggccgtcatggaggg

SEQ ID NO: 50733 - DNA, 20 bp, Human herpesvirus 4
ccttcctcatacctatggag

SEQ ID NO: 50734 - DNA, 20 bp, Human herpesvirus 4
ctcatacctatggagatgcc

SEQ ID NO: 50735 - DNA, 20 bp, Human herpesvirus 4
gcagccaatgcaacttggac

SEQ ID NO: 50736 - DNA, 20 bp, Human herpesvirus 4
cagccaatgcaacttggacg

SEQ ID NO: 50737 - DNA, 20 bp, Human herpesvirus 4
gacgtttttggggtctccgg

SEQ ID NO: 50738 - DNA, 20 bp, Human herpesvirus 4
ttggggtctccggacaccat

SEQ ID NO: 50739 - DNA, 20 bp, Human herpesvirus 4
tggggtctccggacaccatc

SEQ ID NO: 50740 - DNA, 20 bp, Human herpesvirus 4
cacgacttccccccctggct

SEQ ID NO: 50741 - DNA, 20 bp, Human herpesvirus 4
acgacttccccccctggctc

SEQ ID NO: 50742 - DNA, 20 bp, Human herpesvirus 4
cccccctggctctttcacgt

SEQ ID NO: 50743 - DNA, 20 bp, Human herpesvirus 4
cacgtcctctaccccggcgg

SEQ ID NO: 50744 - DNA, 20 bp, Human herpesvirus 4
acgtcctctaccccggcggc

SEQ ID NO: 50745 - DNA, 20 bp, Human herpesvirus 4
ttagtattgtgttccaggca

SEQ ID NO: 50746 - DNA, 20 bp, Human herpesvirus 4
gtattgtgttccaggcagca

SEQ ID NO: 50747 - DNA, 20 bp, Human herpesvirus 4
tgttccaggcagcacacgaa

SEQ ID NO: 50748 - DNA, 20 bp, Human herpesvirus 4
caggcagcacacgaagcctg

SEQ ID NO: 50749 - DNA, 20 bp, Human herpesvirus 4
accattagcctgggcatgcg

SEQ ID NO: 50750 - DNA, 20 bp, Human herpesvirus 4
gttcgcctgaactcggcggc

SEQ ID NO: 50751 - DNA, 20 bp, Human herpesvirus 4
gcctgaactcggcggcaatg

SEQ ID NO: 50752 - DNA, 20 bp, Human herpesvirus 4
ccgccgagttcaggcgaacc

SEQ ID NO: 50753 - DNA, 20 bp, Human herpesvirus 4
aggcgaaccaagcccagggg

SEQ ID NO: 50754 - DNA, 20 bp, Human herpesvirus 4
gaggtcctgagagacatgca

SEQ ID NO: 50755 - DNA, 20 bp, Human herpesvirus 4
atgtggcggctcttgaaccc

SEQ ID NO: 50756 - DNA, 20 bp, Human herpesvirus 4
tgtggcggctcttgaaccca

SEQ ID NO: 50757 - DNA, 20 bp, Human herpesvirus 4
aacccaaaggcgctatagac

SEQ ID NO: 50758 - DNA, 20 bp, Human herpesvirus 4
ggcagtaggctcggagtgtc

SEQ ID NO: 50759 - DNA, 20 bp, Human herpesvirus 4
gggttcaagagccgccacat

SEQ ID NO: 50760 - DNA, 20 bp, Human herpesvirus 4
accgccataacgccatctgc

SEQ ID NO: 50761 - DNA, 20 bp, Human herpesvirus 4
tggcggttaacttccagcac

SEQ ID NO: 50762 - DNA, 20 bp, Human herpesvirus 4
acttccagcaccaggcgggg

SEQ ID NO: 50763 - DNA, 20 bp, Human herpesvirus 4
cagcaccaggcggggggtca

SEQ ID NO: 50764 - DNA, 20 bp, Human herpesvirus 4
ctttttgcatggtcaggctc

SEQ ID NO: 50765 - DNA, 20 bp, Human herpesvirus 4
gggtgaaggctcgacgcggg

SEQ ID NO: 50766 - DNA, 20 bp, Human herpesvirus 4
cagggggatctttacgtggg

SEQ ID NO: 50767 - DNA, 20 bp, Human herpesvirus 4
agggggatctttacgtgggt

SEQ ID NO: 50768 - DNA, 20 bp, Human herpesvirus 4
acgtgggtggatgtagggag

SEQ ID NO: 50769 - DNA, 20 bp, Human herpesvirus 4
cgtgggtggatgtagggagc

SEQ ID NO: 50770 - DNA, 20 bp, Human herpesvirus 4
gtgccacaaagcccaggatg

SEQ ID NO: 50771 - DNA, 20 bp, Human herpesvirus 4
tcctacacgcggccgctgac

SEQ ID NO: 50772 - DNA, 20 bp, Human herpesvirus 4
tgcagacgagttcatcctgg

SEQ ID NO: 50773 - DNA, 20 bp, Human herpesvirus 4
atcctgggctttgtggcacc

SEQ ID NO: 50774 - DNA, 20 bp, Human herpesvirus 4
ttggtcccgcccatcatccc

SEQ ID NO: 50775 - DNA, 20 bp, Human herpesvirus 4
gtcccgcccatcatcccccg

SEQ ID NO: 50776 - DNA, 20 bp, Human herpesvirus 4
ggcagaccacctgtgctgga

SEQ ID NO: 50777 - DNA, 20 bp, Human herpesvirus 4
gcagaccacctgtgctggaa

SEQ ID NO: 50778 - DNA, 20 bp, Human herpesvirus 4
cagcctctctttccagcaca

SEQ ID NO: 50779 - DNA, 20 bp, Human herpesvirus 4
ccccgtgctgcagcgtaaac

SEQ ID NO: 50780 - DNA, 20 bp, Human herpesvirus 4
gcagtgggacctggggccgt

SEQ ID NO: 50781 - DNA, 20 bp, Human herpesvirus 4
gatgtgggccctcttctacg

SEQ ID NO: 50782 - DNA, 20 bp, Human herpesvirus 4
tacggccccaggtcccactg

SEQ ID NO: 50783 - DNA, 20 bp, Human herpesvirus 4
acgctgcagcacggggcaag

SEQ ID NO: 50784 - DNA, 20 bp, Human herpesvirus 4
accgcgttgaacatgctgta

SEQ ID NO: 50785 - DNA, 20 bp, Human herpesvirus 4
aacatgctgtatgcctcgca

SEQ ID NO: 50786 - DNA, 20 bp, Human herpesvirus 4
cttaggttctcggtcagacg

SEQ ID NO: 50787 - DNA, 20 bp, Human herpesvirus 4
ttaggttctcggtcagacgg

SEQ ID NO: 50788 - DNA, 20 bp, Human herpesvirus 4
ggttctcggtcagacggccg

SEQ ID NO: 50789 - DNA, 20 bp, Human herpesvirus 4
caagggctactagctgggaa

SEQ ID NO: 50790 - DNA, 20 bp, Human herpesvirus 4
ccccaggccgaggccccttc

SEQ ID NO: 50791 - DNA, 20 bp, Human herpesvirus 4
gggctgcttcccagctagta

SEQ ID NO: 50792 - DNA, 20 bp, Human herpesvirus 4
ccagctagtagcccttggaa

SEQ ID NO: 50793 - DNA, 20 bp, Human herpesvirus 4
ggcacgcgattggggcaaag

SEQ ID NO: 50794 - DNA, 20 bp, Human herpesvirus 4
gcacgcgattggggcaaagc

SEQ ID NO: 50795 - DNA, 20 bp, Human herpesvirus 4
gggcaaagctctgccataac

SEQ ID NO: 50796 - DNA, 20 bp, Human herpesvirus 4
gttcccgacacggttatggc

SEQ ID NO: 50797 - DNA, 20 bp, Human herpesvirus 4
ttcccgacacggttatggca

SEQ ID NO: 50798 - DNA, 20 bp, Human herpesvirus 4
cctgtaagggcgcacaccac

SEQ ID NO: 50799 - DNA, 20 bp, Human herpesvirus 4
agacccatgagggagtggtg

SEQ ID NO: 50800 - DNA, 20 bp, Human herpesvirus 4
caggcaactacatggggccg

SEQ ID NO: 50801 - DNA, 20 bp, Human herpesvirus 4
ccagccggcgctgaggccct

SEQ ID NO: 50802 - DNA, 20 bp, Human herpesvirus 4
cagccggcgctgaggccctg

SEQ ID NO: 50803 - DNA, 20 bp, Human herpesvirus 4
acaccctcaacccccgagta

SEQ ID NO: 50804 - DNA, 20 bp, Human herpesvirus 4
agggtgtcaacccggcagag

SEQ ID NO: 50805 - DNA, 20 bp, Human herpesvirus 4
atggcatcgtcacgcacagt

SEQ ID NO: 50806 - DNA, 20 bp, Human herpesvirus 4
ttcctcaaggacctaacagg

SEQ ID NO: 50807 - DNA, 20 bp, Human herpesvirus 4
ctcaaggacctaacagggga

SEQ ID NO: 50808 - DNA, 20 bp, Human herpesvirus 4
ggtccttgaggaagaagtgt

SEQ ID NO: 50809 - DNA, 20 bp, Human herpesvirus 4
aggaagaagtgttccaggcc

SEQ ID NO: 50810 - DNA, 20 bp, Human herpesvirus 4
cttccgtttcatgcctccag

SEQ ID NO: 50811 - DNA, 20 bp, Human herpesvirus 4
cgtttcatgcctccagctgc

SEQ ID NO: 50812 - DNA, 20 bp, Human herpesvirus 4
catgcctccagctgcccctg

SEQ ID NO: 50813 - DNA, 20 bp, Human herpesvirus 4
atgcctccagctgcccctga

SEQ ID NO: 50814 - DNA, 20 bp, Human herpesvirus 4
ggacccttgacggatgtctt

SEQ ID NO: 50815 - DNA, 20 bp, Human herpesvirus 4
tcggcgggattcggggccag

SEQ ID NO: 50816 - DNA, 20 bp, Human herpesvirus 4
ggggccagctgctgcgtaac

SEQ ID NO: 50817 - DNA, 20 bp, Human herpesvirus 4
tccaccgacacgcgcacggt

SEQ ID NO: 50818 - DNA, 20 bp, Human herpesvirus 4
cacccgcaccgtgcgcgtgt

SEQ ID NO: 50819 - DNA, 20 bp, Human herpesvirus 4
acccgcaccgtgcgcgtgtc

SEQ ID NO: 50820 - DNA, 20 bp, Human herpesvirus 4
gcggtcgtgtaggtactgac

SEQ ID NO: 50821 - DNA, 20 bp, Human herpesvirus 4
agcacgctctccccggacac

SEQ ID NO: 50822 - DNA, 20 bp, Human herpesvirus 4
ccctcggtggtgtcctgcca

SEQ ID NO: 50823 - DNA, 20 bp, Human herpesvirus 4
cctcggtggtgtcctgccag

SEQ ID NO: 50824 - DNA, 20 bp, Human herpesvirus 4
aaggccgcaactgccaccat

SEQ ID NO: 50825 - DNA, 20 bp, Human herpesvirus 4
aggccgcaactgccaccata

SEQ ID NO: 50826 - DNA, 20 bp, Human herpesvirus 4
cggccttaaaccaggacacg

SEQ ID NO: 50827 - DNA, 20 bp, Human herpesvirus 4
cctcggcgctgggactgcct

SEQ ID NO: 50828 - DNA, 20 bp, Human herpesvirus 4
cgtgcctcgggcctcaacgt

SEQ ID NO: 50829 - DNA, 20 bp, Human herpesvirus 4
aggcccgaggcacggaagag

SEQ ID NO: 50830 - DNA, 20 bp, Human herpesvirus 4
tccccaggcagtcccagcgc

SEQ ID NO: 50831 - DNA, 20 bp, Human herpesvirus 4
ccccaggcagtcccagcgcc

SEQ ID NO: 50832 - DNA, 20 bp, Human herpesvirus 4
tccatggttgagtccgtaaa

SEQ ID NO: 50833 - DNA, 20 bp, Human herpesvirus 4
agtccgtaaaacgagtccgg

SEQ ID NO: 50834 - DNA, 20 bp, Human herpesvirus 4
gctccctcatcgacccggac

SEQ ID NO: 50835 - DNA, 20 bp, Human herpesvirus 4
ctccctcatcgacccggact

SEQ ID NO: 50836 - DNA, 20 bp, Human herpesvirus 4
tacggactcaaccatggaga

SEQ ID NO: 50837 - DNA, 20 bp, Human herpesvirus 4
cttcatacaggcccgcaatt

SEQ ID NO: 50838 - DNA, 20 bp, Human herpesvirus 4
ttcatacaggcccgcaattt

SEQ ID NO: 50839 - DNA, 20 bp, Human herpesvirus 4
atacaggcccgcaatttcca

SEQ ID NO: 50840 - DNA, 20 bp, Human herpesvirus 4
ccatgacagtcccgttggtg

SEQ ID NO: 50841 - DNA, 20 bp, Human herpesvirus 4
catgacagtcccgttggtgg

SEQ ID NO: 50842 - DNA, 20 bp, Human herpesvirus 4
gtatagggcaaggttgggcc

SEQ ID NO: 50843 - DNA, 20 bp, Human herpesvirus 4
ggcccctgggtagtcacgtt

SEQ ID NO: 50844 - DNA, 20 bp, Human herpesvirus 4
agccgcaactcgcgtagcac

SEQ ID NO: 50845 - DNA, 20 bp, Human herpesvirus 4
atcggcagccacgtggtgct

SEQ ID NO: 50846 - DNA, 20 bp, Human herpesvirus 4
tcggcagccacgtggtgcta

SEQ ID NO: 50847 - DNA, 20 bp, Human herpesvirus 4
atagaccccgcccgactgcc

SEQ ID NO: 50848 - DNA, 20 bp, Human herpesvirus 4
agcaggccggtggtggaggt

SEQ ID NO: 50849 - DNA, 20 bp, Human herpesvirus 4
ggcttgccgggcctctttgg

SEQ ID NO: 50850 - DNA, 20 bp, Human herpesvirus 4
gcttgccgggcctctttggc

SEQ ID NO: 50851 - DNA, 20 bp, Human herpesvirus 4
ccgggcctctttggcccccc

SEQ ID NO: 50852 - DNA, 20 bp, Human herpesvirus 4
ggcccccctccacccgtgcc

SEQ ID NO: 50853 - DNA, 20 bp, Human herpesvirus 4
gcccccctccacccgtgcct

SEQ ID NO: 50854 - DNA, 20 bp, Human herpesvirus 4
gactgagccactccggacgc

SEQ ID NO: 50855 - DNA, 20 bp, Human herpesvirus 4
ctttccgcggtggtggccct

SEQ ID NO: 50856 - DNA, 20 bp, Human herpesvirus 4
tttccgcggtggtggccctc

SEQ ID NO: 50857 - DNA, 20 bp, Human herpesvirus 4
ccgcggtggtggccctcggt

SEQ ID NO: 50858 - DNA, 20 bp, Human herpesvirus 4
cgcggtggtggccctcggtg

SEQ ID NO: 50859 - DNA, 20 bp, Human herpesvirus 4
ggacttaatcgctcctgtgc

SEQ ID NO: 50860 - DNA, 20 bp, Human herpesvirus 4
atcgctcctgtgccgctgga

SEQ ID NO: 50861 - DNA, 20 bp, Human herpesvirus 4
gtacatcctagctctggcca

SEQ ID NO: 50862 - DNA, 20 bp, Human herpesvirus 4
tacatcctagctctggccat

SEQ ID NO: 50863 - DNA, 20 bp, Human herpesvirus 4
gcgctccctcatccagcggc

SEQ ID NO: 50864 - DNA, 20 bp, Human herpesvirus 4
agtgcacgcatcttccgttg

SEQ ID NO: 50865 - DNA, 20 bp, Human herpesvirus 4
gtgcacgcatcttccgttgc

SEQ ID NO: 50866 - DNA, 20 bp, Human herpesvirus 4
cgttgcattgacggaagtca

SEQ ID NO: 50867 - DNA, 20 bp, Human herpesvirus 4
cattgacggaagtcatgttg

SEQ ID NO: 50868 - DNA, 20 bp, Human herpesvirus 4
acggaagtcatgttggccac

SEQ ID NO: 50869 - DNA, 20 bp, Human herpesvirus 4
ggctccacaaagacgtactg

SEQ ID NO: 50870 - DNA, 20 bp, Human herpesvirus 4
ctcgttgcgctcgacgaact

SEQ ID NO: 50871 - DNA, 20 bp, Human herpesvirus 4
cgctcgacgaacttctggta

SEQ ID NO: 50872 - DNA, 20 bp, Human herpesvirus 4
gtcgagcgcaacgaggaact

SEQ ID NO: 50873 - DNA, 20 bp, Human herpesvirus 4
gtggagcccaaggggggagt

SEQ ID NO: 50874 - DNA, 20 bp, Human herpesvirus 4
gtgttggcccgcaagaagcc

SEQ ID NO: 50875 - DNA, 20 bp, Human herpesvirus 4
gcccgcaagaagcccttgcc

SEQ ID NO: 50876 - DNA, 20 bp, Human herpesvirus 4
cccgcatcatggggtcgcct

SEQ ID NO: 50877 - DNA, 20 bp, Human herpesvirus 4
tgcccagagaggctgggttg

SEQ ID NO: 50878 - DNA, 20 bp, Human herpesvirus 4
gcccagagaggctgggttga

SEQ ID NO: 50879 - DNA, 20 bp, Human herpesvirus 4
ggcacgctggcgccaccaca

SEQ ID NO: 50880 - DNA, 20 bp, Human herpesvirus 4
ccatcctcgtcaccccccac

SEQ ID NO: 50881 - DNA, 20 bp, Human herpesvirus 4
catcctcgtcaccccccacc

SEQ ID NO: 50882 - DNA, 20 bp, Human herpesvirus 4
gtagaagcacagggggggct

SEQ ID NO: 50883 - DNA, 20 bp, Human herpesvirus 4
taccaagactccctgacggt

SEQ ID NO: 50884 - DNA, 20 bp, Human herpesvirus 4
tggtgaggcagcgtacctgc

SEQ ID NO: 50885 - DNA, 20 bp, Human herpesvirus 4
ctgggtgggggaaagagccc

SEQ ID NO: 50886 - DNA, 20 bp, Human herpesvirus 4
cccccacccagcaacgtggc

SEQ ID NO: 50887 - DNA, 20 bp, Human herpesvirus 4
ccccacccagcaacgtggcc

SEQ ID NO: 50888 - DNA, 20 bp, Human herpesvirus 4
tgatgtacttggaattctca

SEQ ID NO: 50889 - DNA, 20 bp, Human herpesvirus 4
gatgtacttggaattctcaa

SEQ ID NO: 50890 - DNA, 20 bp, Human herpesvirus 4
atgtacttggaattctcaaa

SEQ ID NO: 50891 - DNA, 20 bp, Human herpesvirus 4
gaattctcaaaggcggcacc

SEQ ID NO: 50892 - DNA, 20 bp, Human herpesvirus 4
tcaaaggcggcaccctcgcc

SEQ ID NO: 50893 - DNA, 20 bp, Human herpesvirus 4
attctcaaacagtcccgaga

SEQ ID NO: 50894 - DNA, 20 bp, Human herpesvirus 4
tcaaacagtcccgagaccgg

SEQ ID NO: 50895 - DNA, 20 bp, Human herpesvirus 4
accggcaccgccaggtggtt

SEQ ID NO: 50896 - DNA, 20 bp, Human herpesvirus 4
caggagacgtgggtcccctc

SEQ ID NO: 50897 - DNA, 20 bp, Human herpesvirus 4
cacggcagaggggacccacg

SEQ ID NO: 50898 - DNA, 20 bp, Human herpesvirus 4
aggctggccggggtctcgtg

SEQ ID NO: 50899 - DNA, 20 bp, Human herpesvirus 4
tggacagcgcggcctgcgag

SEQ ID NO: 50900 - DNA, 20 bp, Human herpesvirus 4
taacgatggaatggccacca

SEQ ID NO: 50901 - DNA, 20 bp, Human herpesvirus 4
aacgatggaatggccaccag

SEQ ID NO: 50902 - DNA, 20 bp, Human herpesvirus 4
acgatggaatggccaccagg

SEQ ID NO: 50903 - DNA, 20 bp, Human herpesvirus 4
ccgctgtagagtcgctcctt

SEQ ID NO: 50904 - DNA, 20 bp, Human herpesvirus 4
cgctgtagagtcgctccttg

SEQ ID NO: 50905 - DNA, 20 bp, Human herpesvirus 4
atgctgaagcccggctccac

SEQ ID NO: 50906 - DNA, 20 bp, Human herpesvirus 4
gtggcatcaccgtggagccg

SEQ ID NO: 50907 - DNA, 20 bp, Human herpesvirus 4
tggcatcaccgtggagccgg

SEQ ID NO: 50908 - DNA, 20 bp, Human herpesvirus 4
gcatgccgcccagcctcgca

SEQ ID NO: 50909 - DNA, 20 bp, Human herpesvirus 4
gtgctgggggcaatcgccca

SEQ ID NO: 50910 - DNA, 20 bp, Human herpesvirus 4
gcgaggctgggcggcatgcc

SEQ ID NO: 50911 - DNA, 20 bp, Human herpesvirus 4
cgaggctgggcggcatgcca

SEQ ID NO: 50912 - DNA, 20 bp, Human herpesvirus 4
tacactgcgcgcaggacgct

SEQ ID NO: 50913 - DNA, 20 bp, Human herpesvirus 4
gcccccgatgtcggctgtcc

SEQ ID NO: 50914 - DNA, 20 bp, Human herpesvirus 4
cccccgatgtcggctgtcct

SEQ ID NO: 50915 - DNA, 20 bp, Human herpesvirus 4
tcgtccggcggcgagggcgc

SEQ ID NO: 50916 - DNA, 20 bp, Human herpesvirus 4
agggccatgtacgcggtgtt

SEQ ID NO: 50917 - DNA, 20 bp, Human herpesvirus 4
cctggggggcctttgtcagg

SEQ ID NO: 50918 - DNA, 20 bp, Human herpesvirus 4
ctggggggcctttgtcaggg

SEQ ID NO: 50919 - DNA, 20 bp, Human herpesvirus 4
gtcagggttgtctgtgtcac

SEQ ID NO: 50920 - DNA, 20 bp, Human herpesvirus 4
tcagggttgtctgtgtcacc

SEQ ID NO: 50921 - DNA, 20 bp, Human herpesvirus 4
tctgtgtcacccagcggccc

SEQ ID NO: 50922 - DNA, 20 bp, Human papillomavirus type 71
ggaaatagctggaaaactaa

SEQ ID NO: 50923 - DNA, 20 bp, Human papillomavirus type 71
gaaatagctggaaaactaag

SEQ ID NO: 50924 - DNA, 20 bp, Human papillomavirus type 71
gatattggcaattttcaggc

SEQ ID NO: 50925 - DNA, 20 bp, Human papillomavirus type 71
gcaattttcaggctttgcaa

SEQ ID NO: 50926 - DNA, 20 bp, Human papillomavirus type 71
tcaggctttgcaaacacagt

SEQ ID NO: 50927 - DNA, 20 bp, Human papillomavirus type 71
ttgacctgtattgtcacgag

SEQ ID NO: 50928 - DNA, 20 bp, Human papillomavirus type 71
acctgtattgtcacgagcaa

SEQ ID NO: 50929 - DNA, 20 bp, Human papillomavirus type 71
tcacgagcaatttgccagct

SEQ ID NO: 50930 - DNA, 20 bp, Human papillomavirus type 71
gccagctcagacgaggaaga

SEQ ID NO: 50931 - DNA, 20 bp, Human papillomavirus type 71
ccagctcagacgaggaagat

SEQ ID NO: 50932 - DNA, 20 bp, Human papillomavirus type 71
aaagacttatatgggttatc

SEQ ID NO: 50933 - DNA, 20 bp, Human papillomavirus type 71
aagacttatatgggttatca

SEQ ID NO: 50934 - DNA, 20 bp, Human papillomavirus type 71
tatgggttatcatatatgga

SEQ ID NO: 50935 - DNA, 20 bp, Human papillomavirus type 71
tcatatatggaattggtacg

SEQ ID NO: 50936 - DNA, 20 bp, Human papillomavirus type 71
gtacggcaatttaaaagtaa

SEQ ID NO: 50937 - DNA, 20 bp, Human papillomavirus type 71
agcatgttattaaatatacc

SEQ ID NO: 50938 - DNA, 20 bp, Human papillomavirus type 71
ttaaatataccagaaacaaa

SEQ ID NO: 50939 - DNA, 20 bp, Human papillomavirus type 71
aatataccagaaacaaacat

SEQ ID NO: 50940 - DNA, 20 bp, Human papillomavirus type 71
tattggtttagggcgagcat

SEQ ID NO: 50941 - DNA, 20 bp, Human papillomavirus type 71
ttatttttggtggttctatt

SEQ ID NO: 50942 - DNA, 20 bp, Human papillomavirus type 71
ttagcaagcaattgtcaagc

SEQ ID NO: 50943 - DNA, 20 bp, Human papillomavirus type 71
tagcaagcaattgtcaagcc

SEQ ID NO: 50944 - DNA, 20 bp, Human papillomavirus type 71
agcaagcaattgtcaagcca

SEQ ID NO: 50945 - DNA, 20 bp, Human papillomavirus type 71
gcaagcaattgtcaagccaa

SEQ ID NO: 50946 - DNA, 20 bp, Human papillomavirus type 71
tcaagccaaatatgtgaaag

SEQ ID NO: 50947 - DNA, 20 bp, Human papillomavirus type 71
ttgcatgagcctattacggt

SEQ ID NO: 50948 - DNA, 20 bp, Human papillomavirus type 71
tgcatgagcctattacggtt

SEQ ID NO: 50949 - DNA, 20 bp, Human papillomavirus type 71
gcatgagcctattacggttt

SEQ ID NO: 50950 - DNA, 20 bp, Human papillomavirus type 71
catgagcctattacggtttt

SEQ ID NO: 50951 - DNA, 20 bp, Human papillomavirus type 71
cggtttttgggtggggttgt

SEQ ID NO: 50952 - DNA, 20 bp, Human papillomavirus type 71
aacactggcaacacgtgcga

SEQ ID NO: 50953 - DNA, 20 bp, Human papillomavirus type 71
ttatttaaggcaagggaagc

SEQ ID NO: 50954 - DNA, 20 bp, Human papillomavirus type 71
tttaaggcaagggaagcagg

SEQ ID NO: 50955 - DNA, 20 bp, Human papillomavirus type 71
aaggcaagggaagcaggaat

SEQ ID NO: 50956 - DNA, 20 bp, Human papillomavirus type 71
aggcaagggaagcaggaatt

SEQ ID NO: 50957 - DNA, 20 bp, Human papillomavirus type 71
cgtgacacgagccaggaaat

SEQ ID NO: 50958 - DNA, 20 bp, Human papillomavirus type 71
gcaatcgtatcgcacttcta

SEQ ID NO: 50959 - DNA, 20 bp, Human papillomavirus type 71
caatcgtatcgcacttctac

SEQ ID NO: 50960 - DNA, 20 bp, Human papillomavirus type 71
tacagtgtagcctttttttt

SEQ ID NO: 50961 - DNA, 20 bp, Human papillomavirus type 71
ttttttccagcattgcttag

SEQ ID NO: 50962 - DNA, 20 bp, Human papillomavirus type 71
atgatgcattcgactcctct

SEQ ID NO: 50963 - DNA, 20 bp, Human papillomavirus type 71
tgatgcattcgactcctctg

SEQ ID NO: 50964 - DNA, 20 bp, Human papillomavirus type 71
gactcctctgtgtctagcac

SEQ ID NO: 50965 - DNA, 20 bp, Human papillomavirus type 71
aacctactgaccacggaccc

SEQ ID NO: 50966 - DNA, 20 bp, Human papillomavirus type 71
ggtggtggtggaggcctgtt

SEQ ID NO: 50967 - DNA, 20 bp, Human papillomavirus type 71
ctagccactgtacatattcc

SEQ ID NO: 50968 - DNA, 20 bp, Human papillomavirus type 71
tagccactgtacatattcct

SEQ ID NO: 50969 - DNA, 20 bp, Human papillomavirus type 71
ctaagggcatagaggcctta

SEQ ID NO: 50970 - DNA, 20 bp, Human papillomavirus type 71
ccaggatatatgtcattgtt

SEQ ID NO: 50971 - DNA, 20 bp, Human papillomavirus type 71
tttgcataatctttgtaaat

SEQ ID NO: 50972 - DNA, 20 bp, Human papillomavirus type 71
cctaactgtgacttgtgact

SEQ ID NO: 50973 - DNA, 20 bp, Human papillomavirus type 71
tgactaccacacaaccagcc

SEQ ID NO: 50974 - DNA, 20 bp, Human papillomavirus type 71
tgtacacgtagtagcagtat

SEQ ID NO: 50975 - DNA, 20 bp, Human papillomavirus type 71
gctggttgtgtggtagtcac

SEQ ID NO: 50976 - DNA, 20 bp, Human papillomavirus type 71
tgtggtagtcacaagtcaca

SEQ ID NO: 50977 - DNA, 20 bp, Human papillomavirus type 71
gatggccctgacattgattt

SEQ ID NO: 50978 - DNA, 20 bp, Human papillomavirus type 71
atggccctgacattgatttt

SEQ ID NO: 50979 - DNA, 20 bp, Human papillomavirus type 71
atttttccacctcccatgcc

SEQ ID NO: 50980 - DNA, 20 bp, Human papillomavirus type 71
ttccacctcccatgccacta

SEQ ID NO: 50981 - DNA, 20 bp, Human papillomavirus type 71
tccacctcccatgccactac

SEQ ID NO: 50982 - DNA, 20 bp, Human papillomavirus type 71
ctgttggccatccatatttt

SEQ ID NO: 50983 - DNA, 20 bp, Human papillomavirus type 71
gccatccatattttcctatt

SEQ ID NO: 50984 - DNA, 20 bp, Human papillomavirus type 71
tcctattcgccaggcaagtg

SEQ ID NO: 50985 - DNA, 20 bp, Human papillomavirus type 71
cctattcgccaggcaagtgg

SEQ ID NO: 50986 - DNA, 20 bp, Human papillomavirus type 71
ctattcgccaggcaagtggt

SEQ ID NO: 50987 - DNA, 20 bp, Human papillomavirus type 71
gtggccatccattgtttaac

SEQ ID NO: 50988 - DNA, 20 bp, Human papillomavirus type 71
tttaacaagcttaatgacac

SEQ ID NO: 50989 - DNA, 20 bp, Human papillomavirus type 71
aacaagcttaatgacactga

SEQ ID NO: 50990 - DNA, 20 bp, Human papillomavirus type 71
acaagcttaatgacactgaa

SEQ ID NO: 50991 - DNA, 20 bp, Human papillomavirus type 71
atgacactgaaaatgccacg

SEQ ID NO: 50992 - DNA, 20 bp, Human papillomavirus type 71
tgcagccctgcaaacaaata

SEQ ID NO: 50993 - DNA, 20 bp, Human papillomavirus type 71
gcagccctgcaaacaaatag

SEQ ID NO: 50994 - DNA, 20 bp, Human papillomavirus type 71
cagccctgcaaacaaatagg

SEQ ID NO: 50995 - DNA, 20 bp, Human papillomavirus type 71
ccttggatattgttactaca

SEQ ID NO: 50996 - DNA, 20 bp, Human papillomavirus type 71
gatattgttactacaacatg

SEQ ID NO: 50997 - DNA, 20 bp, Human papillomavirus type 71
cctcagagtcacagttgttt

SEQ ID NO: 50998 - DNA, 20 bp, Human papillomavirus type 71
tttaacaagccttactggct

SEQ ID NO: 50999 - DNA, 20 bp, Human papillomavirus type 71
aacaagccttactggctaca

SEQ ID NO: 51000 - DNA, 20 bp, Human papillomavirus type 71
acaagccttactggctacaa

SEQ ID NO: 51001 - DNA, 20 bp, Human papillomavirus type 71
ctggctacaacgtgcacagg

SEQ ID NO: 51002 - DNA, 20 bp, Human papillomavirus type 71
tggttccttaccacctccta

SEQ ID NO: 51003 - DNA, 20 bp, Human papillomavirus type 71
ggttccttaccacctcctac

SEQ ID NO: 51004 - DNA, 20 bp, Human papillomavirus type 71
gttccttaccacctcctact

SEQ ID NO: 51005 - DNA, 20 bp, Human papillomavirus type 71
cttaccacctcctactgcta

SEQ ID NO: 51006 - DNA, 20 bp, Human papillomavirus type 71
ccacctcctactgctagtct

SEQ ID NO: 51007 - DNA, 20 bp, Human papillomavirus type 71
tttggttgcacccctgtgag

SEQ ID NO: 51008 - DNA, 20 bp, Human papillomavirus type 71
ggttgcacccctgtgagtaa

SEQ ID NO: 51009 - DNA, 20 bp, Human papillomavirus type 71
gttgcacccctgtgagtaag

SEQ ID NO: 51010 - DNA, 20 bp, Human papillomavirus type 71
cacccctgtgagtaagtgtg

SEQ ID NO: 51011 - DNA, 20 bp, Human papillomavirus type 71
ctgaccagtgaccatgccct

SEQ ID NO: 51012 - DNA, 20 bp, Human papillomavirus type 71
gcacactataaatgcatgtt

SEQ ID NO: 51013 - DNA, 20 bp, Human papillomavirus type 71
taattaactttaatacatgt

SEQ ID NO: 51014 - DNA, 20 bp, Human papillomavirus type 71
actttaatacatgtgttact

SEQ ID NO: 51015 - DNA, 20 bp, Human papillomavirus type 71
aatacatgtgttactcaccg

SEQ ID NO: 51016 - DNA, 20 bp, Human papillomavirus type 71
atacatgtgttactcaccgt

SEQ ID NO: 51017 - DNA, 20 bp, Human papillomavirus type 112
aaacagacaacaagtaaaga

SEQ ID NO: 51018 - DNA, 20 bp, Human papillomavirus type 112
ggctaataccacttctgtca

SEQ ID NO: 51019 - DNA, 20 bp, Human papillomavirus type 112
gctaataccacttctgtcac

SEQ ID NO: 51020 - DNA, 20 bp, Human papillomavirus type 112
tgtcactggctgtttgcctt

SEQ ID NO: 51021 - DNA, 20 bp, Human papillomavirus type 112
gcctttgtaccgggagtggt

SEQ ID NO: 51022 - DNA, 20 bp, Human papillomavirus type 112
gaaataaatttggaagaatt

SEQ ID NO: 51023 - DNA, 20 bp, Human papillomavirus type 112
ggaagaattagtattaccag

SEQ ID NO: 51024 - DNA, 20 bp, Human papillomavirus type 112
gaagaattagtattaccaga

SEQ ID NO: 51025 - DNA, 20 bp, Human papillomavirus type 112
gtattaccagaaaatctttt

SEQ ID NO: 51026 - DNA, 20 bp, Human papillomavirus type 112
ccagaaaatcttttagcaga

SEQ ID NO: 51027 - DNA, 20 bp, Human papillomavirus type 112
ccttgcatttttcaacagtc

SEQ ID NO: 51028 - DNA, 20 bp, Human papillomavirus type 112
catttttcaacagtcagtta

SEQ ID NO: 51029 - DNA, 20 bp, Human papillomavirus type 112
ttcaacagtcagttagcaga

SEQ ID NO: 51030 - DNA, 20 bp, Human papillomavirus type 112
tcaacagtcagttagcagag

SEQ ID NO: 51031 - DNA, 20 bp, Human papillomavirus type 112
caacagtcagttagcagagg

SEQ ID NO: 51032 - DNA, 20 bp, Human papillomavirus type 112
tagaatttaaaacaggaaaa

SEQ ID NO: 51033 - DNA, 20 bp, Human papillomavirus type 112
aaaacaggaaaaagtagaga

SEQ ID NO: 51034 - DNA, 20 bp, Human papillomavirus type 112
aaacaggaaaaagtagagaa

SEQ ID NO: 51035 - DNA, 20 bp, Human papillomavirus type 112
ccaacatgctttgtaaactt

SEQ ID NO: 51036 - DNA, 20 bp, Human papillomavirus type 112
gtaaacttttaaatataaaa

SEQ ID NO: 51037 - DNA, 20 bp, Human papillomavirus type 112
aagactgtgcaataatggta

SEQ ID NO: 51038 - DNA, 20 bp, Human papillomavirus type 112
taaaagatatgaaatgcgcc

SEQ ID NO: 51039 - DNA, 20 bp, Human papillomavirus type 112
cttagaatatgatgacactg

SEQ ID NO: 51040 - DNA, 20 bp, Human papillomavirus type 112
gaatatgatgacactgtaga

SEQ ID NO: 51041 - DNA, 20 bp, Human papillomavirus type 112
taagcaacatttatttatcc

SEQ ID NO: 51042 - DNA, 20 bp, Human papillomavirus type 112
caagactgtagtgctgaatt

SEQ ID NO: 51043 - DNA, 20 bp, Human papillomavirus type 112
ttaaatacccaacccaaaaa

SEQ ID NO: 51044 - DNA, 20 bp, Human papillomavirus type 112
aatacccaacccaaaaactg

SEQ ID NO: 51045 - DNA, 20 bp, Human papillomavirus type 112
caaaaaagctggctattccg

SEQ ID NO: 51046 - DNA, 20 bp, Human papillomavirus type 112
aaaaaagctggctattccgt

SEQ ID NO: 51047 - DNA, 20 bp, Human papillomavirus type 112
gtcttcgagctggaggacga

SEQ ID NO: 51048 - DNA, 20 bp, Human papillomavirus type 112
gagctggaggacgaagacaa

SEQ ID NO: 51049 - DNA, 20 bp, Human papillomavirus type 112
gtgcagcagatcgctgaggg

SEQ ID NO: 51050 - DNA, 20 bp, Human papillomavirus type 112
ttcttctcgttgatacggta

SEQ ID NO: 51051 - DNA, 20 bp, Human papillomavirus type 112
ttctcgttgatacggtagag

SEQ ID NO: 51052 - DNA, 20 bp, Human papillomavirus type 112
ggtggtttgggtatagggtc

SEQ ID NO: 51053 - DNA, 20 bp, Human papillomavirus type 112
gggtatagggtcgggttctg

SEQ ID NO: 51054 - DNA, 20 bp, Human papillomavirus type 112
ggtatagggtcgggttctgg

SEQ ID NO: 51055 - DNA, 20 bp, Human papillomavirus type 112
tggggcgggtgccactggat

SEQ ID NO: 51056 - DNA, 20 bp, Human papillomavirus type 112
cgtcccataacagaaaatat

SEQ ID NO: 51057 - DNA, 20 bp, Human papillomavirus type 112
atggtcaccctactgttcta

SEQ ID NO: 51058 - DNA, 20 bp, Human papillomavirus type 112
tacatggccaagaagacata

SEQ ID NO: 51059 - DNA, 20 bp, Human papillomavirus type 112
caagtcacaccccctgaccc

SEQ ID NO: 51060 - DNA, 20 bp, Human papillomavirus type 112
ctcccagattggcatttgaa

SEQ ID NO: 51061 - DNA, 20 bp, Human papillomavirus type 112
gcatttgaaaatccacgtga

SEQ ID NO: 51062 - DNA, 20 bp, Human papillomavirus type 112
ctaccagaagtggtaatatt

SEQ ID NO: 51063 - DNA, 20 bp, Human papillomavirus type 112
taccagaagtggtaatattt

SEQ ID NO: 51064 - DNA, 20 bp, Human papillomavirus type 112
tgacacaaaaggtgcattac

SEQ ID NO: 51065 - DNA, 20 bp, Human papillomavirus type 112
gacacaaaaggtgcattacc

SEQ ID NO: 51066 - DNA, 20 bp, Human papillomavirus type 112
acacaaaaggtgcattacca

SEQ ID NO: 51067 - DNA, 20 bp, Human papillomavirus type 112
acattgatccatttggatca

SEQ ID NO: 51068 - DNA, 20 bp, Human papillomavirus type 112
cattgatccatttggatcag

SEQ ID NO: 51069 - DNA, 20 bp, Human papillomavirus type 112
atccatttggatcagacttt

SEQ ID NO: 51070 - DNA, 20 bp, Human papillomavirus type 112
ggatcagacttttatttaca

SEQ ID NO: 51071 - DNA, 20 bp, Human papillomavirus type 112
gatcagacttttatttacat

SEQ ID NO: 51072 - DNA, 20 bp, Human papillomavirus type 112
tcctgctgcagaaacagacg

SEQ ID NO: 51073 - DNA, 20 bp, Human papillomavirus type 112
atcttagtatggatcctaag

SEQ ID NO: 51074 - DNA, 20 bp, Human papillomavirus type 112
gtatggatcctaagcaggta

SEQ ID NO: 51075 - DNA, 20 bp, Human papillomavirus type 112
ttaatagttggttgtgaacc

SEQ ID NO: 51076 - DNA, 20 bp, Human papillomavirus type 112
atagttggttgtgaaccagc

SEQ ID NO: 51077 - DNA, 20 bp, Human papillomavirus type 112
aatttttggaacgtagattt

SEQ ID NO: 51078 - DNA, 20 bp, Human papillomavirus type 112
atttttggaacgtagattta

SEQ ID NO: 51079 - DNA, 20 bp, Human papillomavirus type 112
ttggaacgtagatttaacag

SEQ ID NO: 51080 - DNA, 20 bp, Human papillomavirus type 112
tggaacgtagatttaacaga

SEQ ID NO: 51081 - DNA, 20 bp, Human papillomavirus type 112
ggaacgtagatttaacagag

SEQ ID NO: 51082 - DNA, 20 bp, Human papillomavirus type 90
tgcggaacagcattaacaga

SEQ ID NO: 51083 - DNA, 20 bp, Human papillomavirus type 90
gcggaacagcattaacagag

SEQ ID NO: 51084 - DNA, 20 bp, Human papillomavirus type 90
cggaacagcattaacagagg

SEQ ID NO: 51085 - DNA, 20 bp, Human papillomavirus type 90
acagaggaggaggttgtatc

SEQ ID NO: 51086 - DNA, 20 bp, Human papillomavirus type 90
tatgcaaacgatacaacctc

SEQ ID NO: 51087 - DNA, 20 bp, Human papillomavirus type 90
tcagtgaaggcaaacggttc

SEQ ID NO: 51088 - DNA, 20 bp, Human papillomavirus type 90
cataaaatagctgggctttg

SEQ ID NO: 51089 - DNA, 20 bp, Human papillomavirus type 90
ggcgaggcgcttgcctgcag

SEQ ID NO: 51090 - DNA, 20 bp, Human papillomavirus type 90
gcgaggcgcttgcctgcagt

SEQ ID NO: 51091 - DNA, 20 bp, Human papillomavirus type 90
cctgcagtgttggaaaccat

SEQ ID NO: 51092 - DNA, 20 bp, Human papillomavirus type 90
ttgtaggtgttgctgtacag

SEQ ID NO: 51093 - DNA, 20 bp, Human papillomavirus type 90
taggtgttgctgtacagtaa

SEQ ID NO: 51094 - DNA, 20 bp, Human papillomavirus type 90
ctgtacagtaaggctggtgg

SEQ ID NO: 51095 - DNA, 20 bp, Human papillomavirus type 90
tgttgggcgcactgcatata

SEQ ID NO: 51096 - DNA, 20 bp, Human papillomavirus type 90
ggcgcactgcatatagtgtg

SEQ ID NO: 51097 - DNA, 20 bp, Human papillomavirus type 90
attttattgataatagtagg

SEQ ID NO: 51098 - DNA, 20 bp, Human papillomavirus type 90
tattgataatagtaggcatc

SEQ ID NO: 51099 - DNA, 20 bp, Human papillomavirus type 90
attgataatagtaggcatcc

SEQ ID NO: 51100 - DNA, 20 bp, Human papillomavirus type 90
ttgataatagtaggcatccc

SEQ ID NO: 51101 - DNA, 20 bp, Human papillomavirus type 90
ataatagtaggcatcccggg

SEQ ID NO: 51102 - DNA, 20 bp, Human papillomavirus type 90
acgcgacagaggaccaggta

SEQ ID NO: 51103 - DNA, 20 bp, Human papillomavirus type 90
tcgctcctcctcctccgttt

SEQ ID NO: 51104 - DNA, 20 bp, Human papillomavirus type 90
cctgtaccccccctgtgcct

SEQ ID NO: 51105 - DNA, 20 bp, Human papillomavirus type 90
ctgtaccccccctgtgcctg

SEQ ID NO: 51106 - DNA, 20 bp, Human papillomavirus type 90
cccctactacctggtcctct

SEQ ID NO: 51107 - DNA, 20 bp, Human papillomavirus type 90
ggactgggtaatatgtgcat

SEQ ID NO: 51108 - DNA, 20 bp, Human papillomavirus type 90
gactgggtaatatgtgcatt

SEQ ID NO: 51109 - DNA, 20 bp, Human papillomavirus type 90
ggcgtgtactgcacagttgc

SEQ ID NO: 51110 - DNA, 20 bp, Human papillomavirus type 90
gcgtgtactgcacagttgca

SEQ ID NO: 51111 - DNA, 20 bp, Human papillomavirus type 90
cagagggtgtcaaaaccctt

SEQ ID NO: 51112 - DNA, 20 bp, Human papillomavirus type 90
gtataaagcaggcatgggca

SEQ ID NO: 51113 - DNA, 20 bp, Human papillomavirus type 90
gagaaacaccagaatggatt

SEQ ID NO: 51114 - DNA, 20 bp, Human papillomavirus type 90
taagacaaacagttgtgggg

SEQ ID NO: 51115 - DNA, 20 bp, Human papillomavirus type 90
tagactgtgccccacaactg

SEQ ID NO: 51116 - DNA, 20 bp, Human papillomavirus type 90
gtcttacaatccattctggt

SEQ ID NO: 51117 - DNA, 20 bp, Human papillomavirus type 90
caaacgggcagagcaggcac

SEQ ID NO: 51118 - DNA, 20 bp, Human papillomavirus type 90
agaagtgcaaagatatcaga

SEQ ID NO: 51119 - DNA, 20 bp, Human papillomavirus type 90
gaagtgcaaagatatcagag

SEQ ID NO: 51120 - DNA, 20 bp, Human papillomavirus type 90
gcacttctaaatcttatcca

SEQ ID NO: 51121 - DNA, 20 bp, Human papillomavirus type 90
cacttctaaatcttatccat

SEQ ID NO: 51122 - DNA, 20 bp, Human papillomavirus type 90
cgcttcctaggaggggttgt

SEQ ID NO: 51123 - DNA, 20 bp, Human papillomavirus type 90
ctaggaggggttgtgatttc

SEQ ID NO: 51124 - DNA, 20 bp, Human papillomavirus type 90
tgatttcctatgccaactcc

SEQ ID NO: 51125 - DNA, 20 bp, Human papillomavirus type 90
cctatgccaactccaccagc

SEQ ID NO: 51126 - DNA, 20 bp, Human papillomavirus type 90
ctatgccaactccaccagcc

SEQ ID NO: 51127 - DNA, 20 bp, Human papillomavirus type 90
ttacgtagtagactgcagct

SEQ ID NO: 51128 - DNA, 20 bp, Human papillomavirus type 90
tacgtagtagactgcagctg

SEQ ID NO: 51129 - DNA, 20 bp, Human papillomavirus type 90
acgtagtagactgcagctgt

SEQ ID NO: 51130 - DNA, 20 bp, Human papillomavirus type 90
cgtagtagactgcagctgtt

SEQ ID NO: 51131 - DNA, 20 bp, Human papillomavirus type 90
acctttcctaatgcatttcc

SEQ ID NO: 51132 - DNA, 20 bp, Human papillomavirus type 90
gtgtgtaaagtatagtcctg

SEQ ID NO: 51133 - DNA, 20 bp, Human papillomavirus type 90
gtccatgtatcatcatcacc

SEQ ID NO: 51134 - DNA, 20 bp, Human papillomavirus type 90
gtacatatatatacctccag

SEQ ID NO: 51135 - DNA, 20 bp, Human papillomavirus type 90
tacatatatatacctccagc

SEQ ID NO: 51136 - DNA, 20 bp, Human papillomavirus type 90
ggccccgcgtcgccacacgt

SEQ ID NO: 51137 - DNA, 20 bp, Human papillomavirus type 90
tcacgtgccagccgctggat

SEQ ID NO: 51138 - DNA, 20 bp, Human papillomavirus type 90
tgtggagtcgggatgctgat

SEQ ID NO: 51139 - DNA, 20 bp, Human papillomavirus type 90
tgcggcggcggcacgtgtgg

SEQ ID NO: 51140 - DNA, 20 bp, Human papillomavirus type 90
agcaaagtaacctccacctg

SEQ ID NO: 51141 - DNA, 20 bp, Human papillomavirus type 90
gcaaagtaacctccacctgg

SEQ ID NO: 51142 - DNA, 20 bp, Human papillomavirus type 90
caaaggctgatttttcattg

SEQ ID NO: 51143 - DNA, 20 bp, Human papillomavirus type 90
ttcattggtggtgttactgc

SEQ ID NO: 51144 - DNA, 20 bp, Human papillomavirus type 90
tcattggtggtgttactgca

SEQ ID NO: 51145 - DNA, 20 bp, Human papillomavirus type 90
ctacttgtctgcctggacac

SEQ ID NO: 51146 - DNA, 20 bp, Human papillomavirus type 90
tctgcctggacacaactgct

SEQ ID NO: 51147 - DNA, 20 bp, Human papillomavirus type 90
ttttggctgtctatccttcc

SEQ ID NO: 51148 - DNA, 20 bp, Human papillomavirus type 90
tggctgtctatccttcctgg

SEQ ID NO: 51149 - DNA, 20 bp, Human papillomavirus type 90
ggctgtctatccttcctggc

SEQ ID NO: 51150 - DNA, 20 bp, Human papillomavirus type 90
tagtacgtgatagagatggg

SEQ ID NO: 51151 - DNA, 20 bp, Human papillomavirus type 90
ccccccatctctatcacgta

SEQ ID NO: 51152 - DNA, 20 bp, Human papillomavirus type 90
gaacagggtccggcactggt

SEQ ID NO: 51153 - DNA, 20 bp, Human papillomavirus type 90
ggacccgaccccccactgtt

SEQ ID NO: 51154 - DNA, 20 bp, Human papillomavirus type 90
tggatgttggccctcctgcc

SEQ ID NO: 51155 - DNA, 20 bp, Human papillomavirus type 90
ttatcacagcctgaaacact

SEQ ID NO: 51156 - DNA, 20 bp, Human papillomavirus type 90
tatcacagcctgaaacactt

SEQ ID NO: 51157 - DNA, 20 bp, Human papillomavirus type 90
atcacagcctgaaacacttg

SEQ ID NO: 51158 - DNA, 20 bp, Human papillomavirus type 90
tcacagcctgaaacacttgt

SEQ ID NO: 51159 - DNA, 20 bp, Human papillomavirus type 90
ttacctatgacaatcctgta

SEQ ID NO: 51160 - DNA, 20 bp, Human papillomavirus type 90
gccatccttattttgctatc

SEQ ID NO: 51161 - DNA, 20 bp, Human papillomavirus type 90
ttttgctatcaaaaagcaat

SEQ ID NO: 51162 - DNA, 20 bp, Human papillomavirus type 90
tgctatcaaaaagcaatcag

SEQ ID NO: 51163 - DNA, 20 bp, Human papillomavirus type 90
gctatcaaaaagcaatcagg

SEQ ID NO: 51164 - DNA, 20 bp, Human papillomavirus type 90
ctatcaaaaagcaatcagga

SEQ ID NO: 51165 - DNA, 20 bp, Human papillomavirus type 90
atatgatgttgtgcctggcg

SEQ ID NO: 51166 - DNA, 20 bp, Human papillomavirus type 90
tatgatgttgtgcctggcga

SEQ ID NO: 51167 - DNA, 20 bp, Human papillomavirus type 90
tgcctggcgatgacacccgg

SEQ ID NO: 51168 - DNA, 20 bp, Human papillomavirus type 90
ctatggactataagcaaacc

SEQ ID NO: 51169 - DNA, 20 bp, Human papillomavirus type 90
attatagggtgcaaacctcc

SEQ ID NO: 51170 - DNA, 20 bp, Human papillomavirus type 90
tttgcagatggcagctgagc

SEQ ID NO: 51171 - DNA, 20 bp, Human papillomavirus type 90
ttgcagatggcagctgagcc

SEQ ID NO: 51172 - DNA, 20 bp, Human papillomavirus type 90
tgcagatggcagctgagcca

SEQ ID NO: 51173 - DNA, 20 bp, Human papillomavirus type 90
gcagatggcagctgagccat

SEQ ID NO: 51174 - DNA, 20 bp, Human papillomavirus type 90
cagatggcagctgagccata

SEQ ID NO: 51175 - DNA, 20 bp, Human papillomavirus type 90
ttgtaactgtggttgatact

SEQ ID NO: 51176 - DNA, 20 bp, Human papillomavirus type 90
tgtaactgtggttgatacta

SEQ ID NO: 51177 - DNA, 20 bp, Human papillomavirus type 90
gtaactgtggttgatactac

SEQ ID NO: 51178 - DNA, 20 bp, Human papillomavirus type 90
taactgtggttgatactaca

SEQ ID NO: 51179 - DNA, 20 bp, Human papillomavirus type 90
atactacacgtagcaccaat

SEQ ID NO: 51180 - DNA, 20 bp, Human papillomavirus type 90
tgtgtgtgtctgttgtatgc

SEQ ID NO: 51181 - DNA, 20 bp, Human papillomavirus type 90
tatgctgatgtttactgtgt

SEQ ID NO: 51182 - DNA, 20 bp, Human papillomavirus type 90
actgtgtctgtacacgggtt

SEQ ID NO: 51183 - DNA, 20 bp, Human papillomavirus type 90
ctgtgtctgtacacgggttc

SEQ ID NO: 51184 - DNA, 20 bp, Human papillomavirus type 90
cttgtactgttgtgtatgta

SEQ ID NO: 51185 - DNA, 20 bp, Human papillomavirus type 90
aatacccccggaccgatttc

SEQ ID NO: 51186 - DNA, 20 bp, Human papillomavirus type 90
atacccccggaccgatttcg

SEQ ID NO: 51187 - DNA, 20 bp, Human papillomavirus type 90
cggtcgctcccggtttcggt

SEQ ID NO: 51188 - DNA, 20 bp, Human papillomavirus type 90
ggtcgctcccggtttcggtc

SEQ ID NO: 51189 - DNA, 20 bp, Human papillomavirus type 90
cggtcgtgcacaacatggcg

SEQ ID NO: 51190 - DNA, 20 bp, Hepatitis C virus
acgcagaaagcgtctagcca

SEQ ID NO: 51191 - DNA, 20 bp, Hepatitis C virus
gtatgagtgtcgtacagcct

SEQ ID NO: 51192 - DNA, 20 bp, Hepatitis C virus
ctgcgtgaagacagtagttc

SEQ ID NO: 51193 - DNA, 20 bp, Hepatitis C virus
tgcgtgaagacagtagttcc

SEQ ID NO: 51194 - DNA, 20 bp, Hepatitis C virus
agtttccgggcggcggccag

SEQ ID NO: 51195 - DNA, 20 bp, Hepatitis C virus
ccgggcggcggccagatcgt

SEQ ID NO: 51196 - DNA, 20 bp, Hepatitis C virus
cgggcggcggccagatcgtt

SEQ ID NO: 51197 - DNA, 20 bp, Hepatitis C virus
gcggagtatacttgttgccg

SEQ ID NO: 51198 - DNA, 20 bp, Hepatitis C virus
ttgccgcgcaggggccccag

SEQ ID NO: 51199 - DNA, 20 bp, Hepatitis C virus
gccgacctcatggggtacat

SEQ ID NO: 51200 - DNA, 20 bp, Hepatitis C virus
ccgacctcatggggtacatc

SEQ ID NO: 51201 - DNA, 20 bp, Hepatitis C virus
accccgtcctccaggactct

SEQ ID NO: 51202 - DNA, 20 bp, Hepatitis C virus
gggtatcgatgaccttaccc

SEQ ID NO: 51203 - DNA, 20 bp, Hepatitis C virus
ggtgagaccggtatccagca

SEQ ID NO: 51204 - DNA, 20 bp, Hepatitis C virus
cccactttctcgcacgggac

SEQ ID NO: 51205 - DNA, 20 bp, Hepatitis C virus
ctcgcacgggacgcacccgg

SEQ ID NO: 51206 - DNA, 20 bp, Hepatitis C virus
tcgcacgggacgcacccggg

SEQ ID NO: 51207 - DNA, 20 bp, Hepatitis C virus
gcgtacgcgatgcgtgtccc

SEQ ID NO: 51208 - DNA, 20 bp, Hepatitis C virus
tagacatcattagcggggct

SEQ ID NO: 51209 - DNA, 20 bp, Hepatitis C virus
gcggggctcattggggcgtc

SEQ ID NO: 51210 - DNA, 20 bp, Hepatitis C virus
gggcgtcatgttcggcttgg

SEQ ID NO: 51211 - DNA, 20 bp, Hepatitis C virus
ggcttggcctacttctctat

SEQ ID NO: 51212 - DNA, 20 bp, Hepatitis C virus
atcgcgtctctgttctacac

SEQ ID NO: 51213 - DNA, 20 bp, Hepatitis C virus
tcgcgtctctgttctacacc

SEQ ID NO: 51214 - DNA, 20 bp, Hepatitis C virus
tacacccacagcttcaactc

SEQ ID NO: 51215 - DNA, 20 bp, Hepatitis C virus
aactcgtcaggatgtcccga

SEQ ID NO: 51216 - DNA, 20 bp, Hepatitis C virus
cgggtgggatggggcgcctt

SEQ ID NO: 51217 - DNA, 20 bp, Hepatitis C virus
tggctacaccaagacttgcg

SEQ ID NO: 51218 - DNA, 20 bp, Hepatitis C virus
cggcgcaccaccctgccgta

SEQ ID NO: 51219 - DNA, 20 bp, Hepatitis C virus
aacgccagcacggacctgtt

SEQ ID NO: 51220 - DNA, 20 bp, Hepatitis C virus
tgccccacggactgttttag

SEQ ID NO: 51221 - DNA, 20 bp, Hepatitis C virus
taggaagcatcctgatacca

SEQ ID NO: 51222 - DNA, 20 bp, Hepatitis C virus
caacttggaggacagagaca

SEQ ID NO: 51223 - DNA, 20 bp, Hepatitis C virus
gaggacagagacagaagtca

SEQ ID NO: 51224 - DNA, 20 bp, Hepatitis C virus
gttgcactccaccacggaat

SEQ ID NO: 51225 - DNA, 20 bp, Hepatitis C virus
ttgcactccaccacggaatg

SEQ ID NO: 51226 - DNA, 20 bp, Hepatitis C virus
cactccaccacggaatgggc

SEQ ID NO: 51227 - DNA, 20 bp, Hepatitis C virus
ctatattttgtcatcttttt

SEQ ID NO: 51228 - DNA, 20 bp, Hepatitis C virus
tgtcatctttttcgtggctg

SEQ ID NO: 51229 - DNA, 20 bp, Hepatitis C virus
gtcatctttttcgtggctgc

SEQ ID NO: 51230 - DNA, 20 bp, Hepatitis C virus
tcatctttttcgtggctgct

SEQ ID NO: 51231 - DNA, 20 bp, Hepatitis C virus
ttcgtggctgcttggtacat

SEQ ID NO: 51232 - DNA, 20 bp, Hepatitis C virus
gacataaccaagtggctctt

SEQ ID NO: 51233 - DNA, 20 bp, Hepatitis C virus
acataaccaagtggctcttg

SEQ ID NO: 51234 - DNA, 20 bp, Hepatitis C virus
gcggtgcttgggcctgctta

SEQ ID NO: 51235 - DNA, 20 bp, Hepatitis C virus
ggcctgcttacctcctaaaa

SEQ ID NO: 51236 - DNA, 20 bp, Hepatitis C virus
cctcctaaaaggtgctttga

SEQ ID NO: 51237 - DNA, 20 bp, Hepatitis C virus
tacacggacttcccgtgtcc

SEQ ID NO: 51238 - DNA, 20 bp, Hepatitis C virus
acacggacttcccgtgtccg

SEQ ID NO: 51239 - DNA, 20 bp, Hepatitis C virus
cacggacttcccgtgtccgc

SEQ ID NO: 51240 - DNA, 20 bp, Hepatitis C virus
ccgtgtccgcccgacttggt

SEQ ID NO: 51241 - DNA, 20 bp, Hepatitis C virus
gtcgggaggtcctccttggc

SEQ ID NO: 51242 - DNA, 20 bp, Hepatitis C virus
gtagggtggcccagcccccc

SEQ ID NO: 51243 - DNA, 20 bp, Hepatitis C virus
agtcccaggggggctgggcc

SEQ ID NO: 51244 - DNA, 20 bp, Hepatitis C virus
gtcccaggggggctgggcca

SEQ ID NO: 51245 - DNA, 20 bp, Hepatitis C virus
ttgccagctccatggtagac

SEQ ID NO: 51246 - DNA, 20 bp, Hepatitis C virus
ccagctccatggtagacagt

SEQ ID NO: 51247 - DNA, 20 bp, Hepatitis C virus
agtgacaacagcacaccacc

SEQ ID NO: 51248 - DNA, 20 bp, Hepatitis C virus
gtgacaacagcacaccacct

SEQ ID NO: 51249 - DNA, 20 bp, Hepatitis C virus
catgccccgactggcagtgg

SEQ ID NO: 51250 - DNA, 20 bp, Hepatitis C virus
ggtgctctttccactgccag

SEQ ID NO: 51251 - DNA, 20 bp, Hepatitis C virus
gtgctctttccactgccagt

SEQ ID NO: 51252 - DNA, 20 bp, Hepatitis C virus
gcatcggaacagtccttgat

SEQ ID NO: 51253 - DNA, 20 bp, Hepatitis C virus
atcaagcagagacagctggg

SEQ ID NO: 51254 - DNA, 20 bp, Hepatitis C virus
atcaaggactgttccgatgc

SEQ ID NO: 51255 - DNA, 20 bp, Hepatitis C virus
cgatgccaaggatggtggta

SEQ ID NO: 51256 - DNA, 20 bp, Hepatitis C virus
atcacatatgatgatgtcgt

SEQ ID NO: 51257 - DNA, 20 bp, Hepatitis C virus
gacgtctccgtaataccaac

SEQ ID NO: 51258 - DNA, 20 bp, Hepatitis C virus
gtattacggagacgtccaac

SEQ ID NO: 51259 - DNA, 20 bp, Hepatitis C virus
cggagacgtccaaccctctg

SEQ ID NO: 51260 - DNA, 20 bp, Hepatitis C virus
caacacgcccggtttgcctg

SEQ ID NO: 51261 - DNA, 20 bp, Hepatitis C virus
aacacgcccggtttgcctgt

SEQ ID NO: 51262 - DNA, 20 bp, Hepatitis C virus
gcctgtgtgccaagaccatc

SEQ ID NO: 51263 - DNA, 20 bp, Hepatitis C virus
cctgtgtgccaagaccatct

SEQ ID NO: 51264 - DNA, 20 bp, Hepatitis C virus
gcacacaggcaaaccgggcg

SEQ ID NO: 51265 - DNA, 20 bp, Hepatitis C virus
ggctctgttaccaacgaggt

SEQ ID NO: 51266 - DNA, 20 bp, Hepatitis C virus
ccaacgaggtcaccctcaca

SEQ ID NO: 51267 - DNA, 20 bp, Hepatitis C virus
catgcaggtggcgatgtatt

SEQ ID NO: 51268 - DNA, 20 bp, Hepatitis C virus
cgtcacgggatgtgtgaggg

SEQ ID NO: 51269 - DNA, 20 bp, Hepatitis C virus
gtcacgggatgtgtgagggt

SEQ ID NO: 51270 - DNA, 20 bp, Hepatitis C virus
ttgcagcaagcttccaaaca

SEQ ID NO: 51271 - DNA, 20 bp, Hepatitis C virus
cagcaagcttccaaacaagc

SEQ ID NO: 51272 - DNA, 20 bp, Hepatitis C virus
caaacaagctcaagacatac

SEQ ID NO: 51273 - DNA, 20 bp, Hepatitis C virus
atggcccaaggtagaacaat

SEQ ID NO: 51274 - DNA, 20 bp, Hepatitis C virus
tgggccaaacacatgtggaa

SEQ ID NO: 51275 - DNA, 20 bp, Hepatitis C virus
cgggggctctcgtcgcattc

SEQ ID NO: 51276 - DNA, 20 bp, Hepatitis C virus
gggggctctcgtcgcattca

SEQ ID NO: 51277 - DNA, 20 bp, Hepatitis C virus
aagatcatgtctggcgagaa

SEQ ID NO: 51278 - DNA, 20 bp, Hepatitis C virus
ctgcctggaattctgtctcc

SEQ ID NO: 51279 - DNA, 20 bp, Hepatitis C virus
tgtctccgggtgccttggta

SEQ ID NO: 51280 - DNA, 20 bp, Hepatitis C virus
cctatcaattgttacacgga

SEQ ID NO: 51281 - DNA, 20 bp, Hepatitis C virus
ctatcaattgttacacggag

SEQ ID NO: 51282 - DNA, 20 bp, Hepatitis C virus
ttacacggagggccagtgcg

SEQ ID NO: 51283 - DNA, 20 bp, Hepatitis C virus
cacggagggccagtgcgtgc

SEQ ID NO: 51284 - DNA, 20 bp, Hepatitis C virus
aaggtcgccatctggagggt

SEQ ID NO: 51285 - DNA, 20 bp, Hepatitis C virus
atgtccatgctaacagatcc

SEQ ID NO: 51286 - DNA, 20 bp, Hepatitis C virus
agcgcgggggtcacccccat

SEQ ID NO: 51287 - DNA, 20 bp, Hepatitis C virus
gcgcgggggtcacccccatc

SEQ ID NO: 51288 - DNA, 20 bp, Hepatitis C virus
cctcggatgggggtgacccc

SEQ ID NO: 51289 - DNA, 20 bp, Hepatitis C virus
gcatggacatcaatacgtct

SEQ ID NO: 51290 - DNA, 20 bp, Hepatitis C virus
ccaccagctttaccggcctg

SEQ ID NO: 51291 - DNA, 20 bp, Hepatitis C virus
accggcctgggcacggcctg

SEQ ID NO: 51292 - DNA, 20 bp, Hepatitis C virus
ccggcctgggcacggcctga

SEQ ID NO: 51293 - DNA, 20 bp, Hepatitis C virus
caacccaccgcttgtggaat

SEQ ID NO: 51294 - DNA, 20 bp, Hepatitis C virus
tccacgattccacaagcggt

SEQ ID NO: 51295 - DNA, 20 bp, Hepatitis C virus
cggagacaggttccatctct

SEQ ID NO: 51296 - DNA, 20 bp, Hepatitis C virus
ggagacaggttccatctctt

SEQ ID NO: 51297 - DNA, 20 bp, Hepatitis C virus
catctcttccatgccccccc

SEQ ID NO: 51298 - DNA, 20 bp, Hepatitis C virus
catgccccccctcgaggggg

SEQ ID NO: 51299 - DNA, 20 bp, Hepatitis C virus
gagatccagacctggagcct

SEQ ID NO: 51300 - DNA, 20 bp, Hepatitis C virus
aaggacattaagctagcggc

SEQ ID NO: 51301 - DNA, 20 bp, Hepatitis C virus
agctagcggcctccaaggtc

SEQ ID NO: 51302 - DNA, 20 bp, Hepatitis C virus
actggcaagcctcctccatg

SEQ ID NO: 51303 - DNA, 20 bp, Hepatitis C virus
cggtgaccttggaggccgct

SEQ ID NO: 51304 - DNA, 20 bp, Hepatitis C virus
gaggccgctagcttaatgtc

SEQ ID NO: 51305 - DNA, 20 bp, Hepatitis C virus
atgacattacacaaaaactt

SEQ ID NO: 51306 - DNA, 20 bp, Hepatitis C virus
tgacattacacaaaaacttc

SEQ ID NO: 51307 - DNA, 20 bp, Hepatitis C virus
cacaaaaacttcctcaggcg

SEQ ID NO: 51308 - DNA, 20 bp, Hepatitis C virus
ctcaggcggtgatgggggct

SEQ ID NO: 51309 - DNA, 20 bp, Hepatitis C virus
ttatggattccagtattccc

SEQ ID NO: 51310 - DNA, 20 bp, Hepatitis C virus
gcggcttgtaaagctgcagg

SEQ ID NO: 51311 - DNA, 20 bp, Hepatitis C virus
taaagctgcagggataatcg

SEQ ID NO: 51312 - DNA, 20 bp, Hepatitis C virus
tgggcgcgattatccctgca

SEQ ID NO: 51313 - DNA, 20 bp, Hepatitis C virus
tccctgcagctttacaagcc

SEQ ID NO: 51314 - DNA, 20 bp, Hepatitis C virus
acaagccgctaaggctttca

SEQ ID NO: 51315 - DNA, 20 bp, Hepatitis C virus
gacactcccctgtcaattca

SEQ ID NO: 51316 - DNA, 20 bp, Hepatitis C virus
acaggggagtgtctaactgt

SEQ ID NO: 51317 - DNA, 20 bp, Hepatitis C virus
cccaggcagcccgggcgatt

SEQ ID NO: 51318 - DNA, 20 bp, Hepatitis C virus
ccaggcagcccgggcgattg

SEQ ID NO: 51319 - DNA, 20 bp, Hepatitis C virus
gagtggtagggtctctggtc

SEQ ID NO: 51320 - DNA, 20 bp, Hepatitis C virus
agccctcagaaaacttgggg

SEQ ID NO: 51321 - DNA, 20 bp, Hepatitis C virus
gggcgccacccctcagagcg

SEQ ID NO: 51322 - DNA, 20 bp, Hepatitis C virus
cacgctctgaggggtggcgc

SEQ ID NO: 51323 - DNA, 20 bp, Hepatitis C virus
tctgagggctgaagccaccc

SEQ ID NO: 51324 - DNA, 20 bp, Hepatitis C virus
ctgagggctgaagccacccg

SEQ ID NO: 51325 - DNA, 20 bp, Neisseria gonorrhoeae
cgccttgtggcgaccgacgg

SEQ ID NO: 51326 - DNA, 20 bp, Neisseria gonorrhoeae
tggcgaccgacggacaccgc

SEQ ID NO: 51327 - DNA, 20 bp, Neisseria gonorrhoeae
cctatgcagcctgcgcgatt

SEQ ID NO: 51328 - DNA, 20 bp, Neisseria gonorrhoeae
atgcggatttgccgcgcgcc

SEQ ID NO: 51329 - DNA, 20 bp, Neisseria gonorrhoeae
gccgcgcgccgaagtgattt

SEQ ID NO: 51330 - DNA, 20 bp, Neisseria gonorrhoeae
gtggtagttgcccgtgccga

SEQ ID NO: 51331 - DNA, 20 bp, Neisseria gonorrhoeae
cccgtgccgaggtgggcgta

SEQ ID NO: 51332 - DNA, 20 bp, Neisseria gonorrhoeae
agcacgccgtcttcgcggcg

SEQ ID NO: 51333 - DNA, 20 bp, Neisseria gonorrhoeae
gcggcggatgaccagtgcca

SEQ ID NO: 51334 - DNA, 20 bp, Neisseria gonorrhoeae
cgcccacctcggcacgggca

SEQ ID NO: 51335 - DNA, 20 bp, Neisseria gonorrhoeae
gacgttcatgcccgggaaga

SEQ ID NO: 51336 - DNA, 20 bp, Neisseria gonorrhoeae
acgttcatgcccgggaagag

SEQ ID NO: 51337 - DNA, 20 bp, Neisseria gonorrhoeae
atgcccgggaagagtttgcc

SEQ ID NO: 51338 - DNA, 20 bp, Neisseria gonorrhoeae
gccgacgtgggcgtggagga

SEQ ID NO: 51339 - DNA, 20 bp, Neisseria gonorrhoeae
ccgacgtgggcgtggaggat

SEQ ID NO: 51340 - DNA, 20 bp, Neisseria gonorrhoeae
ggtcataaggttctcccaaa

SEQ ID NO: 51341 - DNA, 20 bp, Neisseria gonorrhoeae
tcccaaagatggttgttgtt

SEQ ID NO: 51342 - DNA, 20 bp, Neisseria gonorrhoeae
ttgttcggtcggagcgggcg

SEQ ID NO: 51343 - DNA, 20 bp, Neisseria gonorrhoeae
ttcggtcggagcgggcggac

SEQ ID NO: 51344 - DNA, 20 bp, Neisseria gonorrhoeae
ggtcggagcgggcggacaat

SEQ ID NO: 51345 - DNA, 20 bp, Neisseria gonorrhoeae
aaaccgatgacttcgccgcc

SEQ ID NO: 51346 - DNA, 20 bp, Neisseria gonorrhoeae
gccgccgtaaccgggcttgt

SEQ ID NO: 51347 - DNA, 20 bp, Neisseria gonorrhoeae
tcggtactgttcagcgtcag

SEQ ID NO: 51348 - DNA, 20 bp, Neisseria gonorrhoeae
agcgtcagtccgaacgtccc

SEQ ID NO: 51349 - DNA, 20 bp, Neisseria gonorrhoeae
ggtgtggcagtgccgatgag

SEQ ID NO: 51350 - DNA, 20 bp, Neisseria gonorrhoeae
gatgccgttgccgccaagct

SEQ ID NO: 51351 - DNA, 20 bp, Neisseria gonorrhoeae
atgccgttgccgccaagctg

SEQ ID NO: 51352 - DNA, 20 bp, Neisseria gonorrhoeae
ccgccaagctgcaaagccaa

SEQ ID NO: 51353 - DNA, 20 bp, Neisseria gonorrhoeae
gcgcgaaatgccccagtcgc

SEQ ID NO: 51354 - DNA, 20 bp, Neisseria gonorrhoeae
ggttttcggttcgcccgcac

SEQ ID NO: 51355 - DNA, 20 bp, Neisseria gonorrhoeae
gatgccgccgatgtattggt

SEQ ID NO: 51356 - DNA, 20 bp, Neisseria gonorrhoeae
gtcgaccgcgccccagtatt

SEQ ID NO: 51357 - DNA, 20 bp, Neisseria gonorrhoeae
cgcggattctgccgatacca

SEQ ID NO: 51358 - DNA, 20 bp, Neisseria gonorrhoeae
gcggattctgccgataccat

SEQ ID NO: 51359 - DNA, 20 bp, Neisseria gonorrhoeae
tgccgataccatgccgtctg

SEQ ID NO: 51360 - DNA, 20 bp, Neisseria gonorrhoeae
aagtcaacggcaaactgcgc

SEQ ID NO: 51361 - DNA, 20 bp, Neisseria gonorrhoeae
gaggtcggctttggaggcgt

SEQ ID NO: 51362 - DNA, 20 bp, Neisseria gonorrhoeae
ggaggcgtcggcggcgacgg

SEQ ID NO: 51363 - DNA, 20 bp, Neisseria gonorrhoeae
gaggcgtcggcggcgacggt

SEQ ID NO: 51364 - DNA, 20 bp, Neisseria gonorrhoeae
tgccgcgcagtttgccgttg

SEQ ID NO: 51365 - DNA, 20 bp, Neisseria gonorrhoeae
ttgacgatggtcagcagctt

SEQ ID NO: 51366 - DNA, 20 bp, Neisseria gonorrhoeae
tgacgatggtcagcagcttc

SEQ ID NO: 51367 - DNA, 20 bp, Neisseria gonorrhoeae
gacgatggtcagcagcttca

SEQ ID NO: 51368 - DNA, 20 bp, Neisseria gonorrhoeae
acgatggtcagcagcttcaa

SEQ ID NO: 51369 - DNA, 20 bp, Neisseria gonorrhoeae
aacgccgcgccgctcggctt

SEQ ID NO: 51370 - DNA, 20 bp, Neisseria gonorrhoeae
gctttggctgtagcctgcct

SEQ ID NO: 51371 - DNA, 20 bp, Neisseria gonorrhoeae
ctttggctgtagcctgcctg

SEQ ID NO: 51372 - DNA, 20 bp, Neisseria gonorrhoeae
ggctgtagcctgcctgtatc

SEQ ID NO: 51373 - DNA, 20 bp, Neisseria gonorrhoeae
gctgtagcctgcctgtatct

SEQ ID NO: 51374 - DNA, 20 bp, Neisseria gonorrhoeae
gggcgtgatgcggccgccga

SEQ ID NO: 51375 - DNA, 20 bp, Neisseria gonorrhoeae
ccggtcaatgacatgctggc

SEQ ID NO: 51376 - DNA, 20 bp, Neisseria gonorrhoeae
ccatcgaccacagcactgcc

SEQ ID NO: 51377 - DNA, 20 bp, Neisseria gonorrhoeae
catcgaccacagcactgccg

SEQ ID NO: 51378 - DNA, 20 bp, Neisseria gonorrhoeae
ccggttattggcacgccgat

SEQ ID NO: 51379 - DNA, 20 bp, Neisseria gonorrhoeae
ttggcacgccgatccgcgca

SEQ ID NO: 51380 - DNA, 20 bp, Neisseria gonorrhoeae
cgcgcagggtcatgggcagc

SEQ ID NO: 51381 - DNA, 20 bp, Neisseria gonorrhoeae
gcgcagggtcatgggcagcc

SEQ ID NO: 51382 - DNA, 20 bp, Neisseria gonorrhoeae
caacgacggctacaccgttt

SEQ ID NO: 51383 - DNA, 20 bp, Neisseria gonorrhoeae
ccggcacgcacaccccgttc

SEQ ID NO: 51384 - DNA, 20 bp, Neisseria gonorrhoeae
cggcacgcacaccccgttcg

SEQ ID NO: 51385 - DNA, 20 bp, Neisseria gonorrhoeae
aactgttccgccgcctgtat

SEQ ID NO: 51386 - DNA, 20 bp, Neisseria gonorrhoeae
cgccgcctgtatcaactgcc

SEQ ID NO: 51387 - DNA, 20 bp, Neisseria gonorrhoeae
gcggcaggcatgacgatgat

SEQ ID NO: 51388 - DNA, 20 bp, Neisseria gonorrhoeae
tcgcgggcggcgcgcggcag

SEQ ID NO: 51389 - DNA, 20 bp, Neisseria gonorrhoeae
atacaggcggcggaacagtt

SEQ ID NO: 51390 - DNA, 20 bp, Neisseria gonorrhoeae
cctgtaaccgacagcaccag

SEQ ID NO: 51391 - DNA, 20 bp, Neisseria gonorrhoeae
gcctttggcggcttcgcgct

SEQ ID NO: 51392 - DNA, 20 bp, Neisseria gonorrhoeae
cctttggcggcttcgcgctt

SEQ ID NO: 51393 - DNA, 20 bp, Neisseria gonorrhoeae
ggcggcttcgcgcttttggg

SEQ ID NO: 51394 - DNA, 20 bp, Neisseria gonorrhoeae
gcggcttcgcgcttttgggc

SEQ ID NO: 51395 - DNA, 20 bp, Neisseria gonorrhoeae
ttcgtcatggtatcggggca

SEQ ID NO: 51396 - DNA, 20 bp, Neisseria gonorrhoeae
gtcatggtatcggggcagaa

SEQ ID NO: 51397 - DNA, 20 bp, Neisseria gonorrhoeae
caaatgggcggcagggaata

SEQ ID NO: 51398 - DNA, 20 bp, Neisseria gonorrhoeae
cgccggcagacgggcggtat

SEQ ID NO: 51399 - DNA, 20 bp, Neisseria gonorrhoeae
gccggcagacgggcggtatt

SEQ ID NO: 51400 - DNA, 20 bp, Neisseria gonorrhoeae
gcggttcgcgcacgaaggcg

SEQ ID NO: 51401 - DNA, 20 bp, Neisseria gonorrhoeae
cggttcgcgcacgaaggcgg

SEQ ID NO: 51402 - DNA, 20 bp, Neisseria gonorrhoeae
gcgcacgaaggcggcggcgg

SEQ ID NO: 51403 - DNA, 20 bp, Neisseria gonorrhoeae
ctgccgccctgcaagccgat

SEQ ID NO: 51404 - DNA, 20 bp, Neisseria gonorrhoeae
gggcgaactcatgccgcgtt

SEQ ID NO: 51405 - DNA, 20 bp, Neisseria gonorrhoeae
gtcggtcatttccaacgcgc

SEQ ID NO: 51406 - DNA, 20 bp, Neisseria gonorrhoeae
ccaacgcgccggagggcagg

SEQ ID NO: 51407 - DNA, 20 bp, Neisseria gonorrhoeae
caacgcgccggagggcaggt

SEQ ID NO: 51408 - DNA, 20 bp, Neisseria gonorrhoeae
ctgccatttgctgtcggcaa

SEQ ID NO: 51409 - DNA, 20 bp, Neisseria gonorrhoeae
gctgtcggcaaaccgccacg

SEQ ID NO: 51410 - DNA, 20 bp, Neisseria gonorrhoeae
atcgggcgcaaacaaaagct

SEQ ID NO: 51411 - DNA, 20 bp, Neisseria gonorrhoeae
gccccgattcagtttcaccg

SEQ ID NO: 51412 - DNA, 20 bp, Neisseria gonorrhoeae
agtttcaccgccaccaacgc

SEQ ID NO: 51413 - DNA, 20 bp, Neisseria gonorrhoeae
caccgccaccaacgcgccac

SEQ ID NO: 51414 - DNA, 20 bp, Neisseria gonorrhoeae
accgccaccaacgcgccact

SEQ ID NO: 51415 - DNA, 20 bp, Neisseria gonorrhoeae
caccagccacacttcgcgcg

SEQ ID NO: 51416 - DNA, 20 bp, Neisseria gonorrhoeae
gcgcggatagcccgattcgg

SEQ ID NO: 51417 - DNA, 20 bp, Neisseria gonorrhoeae
ggtcaactggcgttcgtccc

SEQ ID NO: 51418 - DNA, 20 bp, Neisseria gonorrhoeae
gtcccaagccggacacaccc

SEQ ID NO: 51419 - DNA, 20 bp, Neisseria gonorrhoeae
ggacgaacgccagttgaccg

SEQ ID NO: 51420 - DNA, 20 bp, Neisseria gonorrhoeae
cgtccgttgctgcggtagtc

SEQ ID NO: 51421 - DNA, 20 bp, Neisseria gonorrhoeae
gtccgttgctgcggtagtct

SEQ ID NO: 51422 - DNA, 20 bp, Neisseria gonorrhoeae
ctgcggtagtctttgcgccg

SEQ ID NO: 51423 - DNA, 20 bp, Neisseria gonorrhoeae
gcgccgcgtttcgggcaact

SEQ ID NO: 51424 - DNA, 20 bp, Neisseria gonorrhoeae
cgccgcgtttcgggcaactc

SEQ ID NO: 51425 - DNA, 20 bp, Neisseria gonorrhoeae
cgcggcggcgaggcggtcga

SEQ ID NO: 51426 - DNA, 20 bp, Neisseria gonorrhoeae
ctcgaccgcctcgccgccgc

SEQ ID NO: 51427 - DNA, 20 bp, Neisseria gonorrhoeae
gaggatgttgtcgagcagga

SEQ ID NO: 51428 - DNA, 20 bp, Neisseria gonorrhoeae
aggatgttgtcgagcaggat

SEQ ID NO: 51429 - DNA, 20 bp, Neisseria gonorrhoeae
tcgagcaggatgcccgcttt

SEQ ID NO: 51430 - DNA, 20 bp, Neisseria gonorrhoeae
gccgtggaacagttgcccgt

SEQ ID NO: 51431 - DNA, 20 bp, Neisseria gonorrhoeae
ccgtggaacagttgcccgta

SEQ ID NO: 51432 - DNA, 20 bp, Neisseria gonorrhoeae
cagccacatcggacccaagc

SEQ ID NO: 51433 - DNA, 20 bp, Neisseria gonorrhoeae
agccacatcggacccaagcc

SEQ ID NO: 51434 - DNA, 20 bp, Neisseria gonorrhoeae
acatattttctccattaaga

SEQ ID NO: 51435 - DNA, 20 bp, Neisseria gonorrhoeae
atggagaaaatatgttaagc

SEQ ID NO: 51436 - DNA, 20 bp, Neisseria gonorrhoeae
agcgcgcgctacctccacct

SEQ ID NO: 51437 - DNA, 20 bp, Neisseria gonorrhoeae
cgcctgttctttggcagtca

SEQ ID NO: 51438 - DNA, 20 bp, Neisseria gonorrhoeae
tttggcagtcagggcgattt

SEQ ID NO: 51439 - DNA, 20 bp, Neisseria gonorrhoeae
ggcagtcagggcgattttgt

SEQ ID NO: 51440 - DNA, 20 bp, Neisseria gonorrhoeae
gcagtcagggcgattttgtt

SEQ ID NO: 51441 - DNA, 20 bp, Neisseria gonorrhoeae
tgttgcggacgtagagcagt

SEQ ID NO: 51442 - DNA, 20 bp, Neisseria gonorrhoeae
ataatcgctcaaacggcggc

SEQ ID NO: 51443 - DNA, 20 bp, Neisseria gonorrhoeae
gacacgctgaaccgccgccg

SEQ ID NO: 51444 - DNA, 20 bp, Neisseria gonorrhoeae
gagcgattatcaagtcggta

SEQ ID NO: 51445 - DNA, 20 bp, Neisseria gonorrhoeae
agcgattatcaagtcggtag

SEQ ID NO: 51446 - DNA, 20 bp, Neisseria gonorrhoeae
tcaagtcggtagggcggcag

SEQ ID NO: 51447 - DNA, 20 bp, Neisseria gonorrhoeae
ctcttcgccgccgtagcgcg

SEQ ID NO: 51448 - DNA, 20 bp, Neisseria gonorrhoeae
tcttcgccgccgtagcgcgt

SEQ ID NO: 51449 - DNA, 20 bp, Neisseria gonorrhoeae
gccgccgtagcgcgtgtcgc

SEQ ID NO: 51450 - DNA, 20 bp, Neisseria gonorrhoeae
tgggcgacacgcgctacggc

SEQ ID NO: 51451 - DNA, 20 bp, Neisseria gonorrhoeae
gggcgacacgcgctacggcg

SEQ ID NO: 51452 - DNA, 20 bp, Neisseria gonorrhoeae
accggcaggaacggcacgcg

SEQ ID NO: 51453 - DNA, 20 bp, Neisseria gonorrhoeae
ccggcaggaacggcacgcgc

SEQ ID NO: 51454 - DNA, 20 bp, Neisseria gonorrhoeae
cgccgcccacgattcgaggc

SEQ ID NO: 51455 - DNA, 20 bp, Neisseria gonorrhoeae
gaggcgtttttggatttggc

SEQ ID NO: 51456 - DNA, 20 bp, Neisseria gonorrhoeae
ttggatttggcgttggctca

SEQ ID NO: 51457 - DNA, 20 bp, Neisseria gonorrhoeae
gtcgttcggcgcgcccaccg

SEQ ID NO: 51458 - DNA, 20 bp, Neisseria gonorrhoeae
tcgttcggcgcgcccaccga

SEQ ID NO: 51459 - DNA, 20 bp, Neisseria gonorrhoeae
ggcgcgcccaccgaaggcga

SEQ ID NO: 51460 - DNA, 20 bp, Neisseria gonorrhoeae
ccgaacaaattgccgaaatt

SEQ ID NO: 51461 - DNA, 20 bp, Neisseria gonorrhoeae
ccgaaattatgccgtctgtc

SEQ ID NO: 51462 - DNA, 20 bp, Neisseria gonorrhoeae
gttttgcgtgccggcgcagg

SEQ ID NO: 51463 - DNA, 20 bp, Neisseria gonorrhoeae
tgcgtgccggcgcaggcatc

SEQ ID NO: 51464 - DNA, 20 bp, Neisseria gonorrhoeae
gcgtgccggcgcaggcatct

SEQ ID NO: 51465 - DNA, 20 bp, Neisseria gonorrhoeae
cgtgccggcgcaggcatctt

SEQ ID NO: 51466 - DNA, 20 bp, Neisseria gonorrhoeae
gatggcggcggagagtgcac

SEQ ID NO: 51467 - DNA, 20 bp, Neisseria gonorrhoeae
ggcggagactttgtcgccca

SEQ ID NO: 51468 - DNA, 20 bp, Neisseria gonorrhoeae
gcggagactttgtcgcccat

SEQ ID NO: 51469 - DNA, 20 bp, Neisseria gonorrhoeae
gtcgcccatcaggcggatgg

SEQ ID NO: 51470 - DNA, 20 bp, Neisseria gonorrhoeae
tcgcccatcaggcggatggt

SEQ ID NO: 51471 - DNA, 20 bp, Neisseria gonorrhoeae
cgggccgatgaaggtaaagc

SEQ ID NO: 51472 - DNA, 20 bp, Neisseria gonorrhoeae
agataactttgcgcagaagc

SEQ ID NO: 51473 - DNA, 20 bp, Neisseria gonorrhoeae
gcgcagaagcggcaggaccg

SEQ ID NO: 51474 - DNA, 20 bp, Neisseria gonorrhoeae
cgcagaagcggcaggaccga

SEQ ID NO: 51475 - DNA, 20 bp, Neisseria gonorrhoeae
gtcggcgagtttgacgtgca

SEQ ID NO: 51476 - DNA, 20 bp, Neisseria gonorrhoeae
gacgtgcaggctgcctttgt

SEQ ID NO: 51477 - DNA, 20 bp, Neisseria gonorrhoeae
ggcgagcggcacgccggtgg

SEQ ID NO: 51478 - DNA, 20 bp, Neisseria gonorrhoeae
gcgagcggcacgccggtggc

SEQ ID NO: 51479 - DNA, 20 bp, Neisseria gonorrhoeae
ggagacaaaggggacggtac

SEQ ID NO: 51480 - DNA, 20 bp, Neisseria gonorrhoeae
gagacaaaggggacggtacg

SEQ ID NO: 51481 - DNA, 20 bp, Neisseria gonorrhoeae
gtctccaaagccaccggcgt

SEQ ID NO: 51482 - DNA, 20 bp, Neisseria gonorrhoeae
tcggtgcggacgatttccaa

SEQ ID NO: 51483 - DNA, 20 bp, Neisseria gonorrhoeae
cggtgcggacgatttccaac

SEQ ID NO: 51484 - DNA, 20 bp, Neisseria gonorrhoeae
ggtgcggacgatttccaaca

SEQ ID NO: 51485 - DNA, 20 bp, Neisseria gonorrhoeae
ccaacacgtcttccaatgtc

SEQ ID NO: 51486 - DNA, 20 bp, Neisseria gonorrhoeae
caacacgtcttccaatgtca

SEQ ID NO: 51487 - DNA, 20 bp, Neisseria gonorrhoeae
cgcgcctttttcgcgcaaca

SEQ ID NO: 51488 - DNA, 20 bp, Neisseria gonorrhoeae
ttcgcgcaacagcatggtca

SEQ ID NO: 51489 - DNA, 20 bp, Neisseria gonorrhoeae
tcgcgcaacagcatggtcag

SEQ ID NO: 51490 - DNA, 20 bp, Neisseria gonorrhoeae
cgcgcaacagcatggtcagg

SEQ ID NO: 51491 - DNA, 20 bp, Neisseria gonorrhoeae
gcgcaacagcatggtcaggc

SEQ ID NO: 51492 - DNA, 20 bp, Neisseria gonorrhoeae
cgggcatcagggtttcttgt

SEQ ID NO: 51493 - DNA, 20 bp, Neisseria gonorrhoeae
gggcatcagggtttcttgta

SEQ ID NO: 51494 - DNA, 20 bp, Neisseria gonorrhoeae
cttgtacggcatcggcgagg

SEQ ID NO: 51495 - DNA, 20 bp, Neisseria gonorrhoeae
ttgtacggcatcggcgaggg

SEQ ID NO: 51496 - DNA, 20 bp, Neisseria gonorrhoeae
tacggcatcggcgagggcgg

SEQ ID NO: 51497 - DNA, 20 bp, Neisseria gonorrhoeae
gtcgacgggcgcgacttgcg

SEQ ID NO: 51498 - DNA, 20 bp, Neisseria gonorrhoeae
tcgacgggcgcgacttgcgg

SEQ ID NO: 51499 - DNA, 20 bp, Neisseria gonorrhoeae
cggggcgttgcccagttgca

SEQ ID NO: 51500 - DNA, 20 bp, Neisseria gonorrhoeae
cccagttgcagggctttgaa

SEQ ID NO: 51501 - DNA, 20 bp, Neisseria gonorrhoeae
cagggctttgaagtaggcga

SEQ ID NO: 51502 - DNA, 20 bp, Neisseria gonorrhoeae
ctttatgccttccgcgctcg

SEQ ID NO: 51503 - DNA, 20 bp, Neisseria gonorrhoeae
atgccttccgcgctcgataa

SEQ ID NO: 51504 - DNA, 20 bp, Neisseria gonorrhoeae
tgccttccgcgctcgataaa

SEQ ID NO: 51505 - DNA, 20 bp, Neisseria gonorrhoeae
cgcgctcgataaatattacc

SEQ ID NO: 51506 - DNA, 20 bp, Neisseria gonorrhoeae
cctgccccacctgcgcgcct

SEQ ID NO: 51507 - DNA, 20 bp, Neisseria gonorrhoeae
tggcgatgcgctggggcagc

SEQ ID NO: 51508 - DNA, 20 bp, Neisseria gonorrhoeae
ggcgatgcgctggggcagcc

SEQ ID NO: 51509 - DNA, 20 bp, Neisseria gonorrhoeae
gcgatgcgctggggcagcca

SEQ ID NO: 51510 - DNA, 20 bp, Neisseria gonorrhoeae
cctacgatgccggttttttc

SEQ ID NO: 51511 - DNA, 20 bp, Neisseria gonorrhoeae
ttggaaaaaaccggcatcgt

SEQ ID NO: 51512 - DNA, 20 bp, Neisseria gonorrhoeae
cactggtgggcggcgcgacc

SEQ ID NO: 51513 - DNA, 20 bp, Neisseria gonorrhoeae
aaagccgccgaacgcagctt

SEQ ID NO: 51514 - DNA, 20 bp, Neisseria gonorrhoeae
aattccgccgaaaccgttgc

SEQ ID NO: 51515 - DNA, 20 bp, Neisseria gonorrhoeae
cggcggaattcaagctgcgt

SEQ ID NO: 51516 - DNA, 20 bp, Neisseria gonorrhoeae
ggcggaattcaagctgcgtt

SEQ ID NO: 51517 - DNA, 20 bp, Neisseria gonorrhoeae
gccgagttgaacaaacgcca

SEQ ID NO: 51518 - DNA, 20 bp, Neisseria gonorrhoeae
aacaaacgccacggcgcggt

SEQ ID NO: 51519 - DNA, 20 bp, Neisseria gonorrhoeae
tggaaatcggcggttccgac

SEQ ID NO: 51520 - DNA, 20 bp, Neisseria gonorrhoeae
ggaaatcggcggttccgacc

SEQ ID NO: 51521 - DNA, 20 bp, Neisseria gonorrhoeae
gaaatcggcggttccgacca

SEQ ID NO: 51522 - DNA, 20 bp, Neisseria gonorrhoeae
ttcgcactccgtaccggcaa

SEQ ID NO: 51523 - DNA, 20 bp, Neisseria gonorrhoeae
tcgcactccgtaccggcaaa

SEQ ID NO: 51524 - DNA, 20 bp, Neisseria gonorrhoeae
cgcactccgtaccggcaaaa

SEQ ID NO: 51525 - DNA, 20 bp, Neisseria gonorrhoeae
gcactccgtaccggcaaaac

SEQ ID NO: 51526 - DNA, 20 bp, Neisseria gonorrhoeae
ctggaagggacgggttgcgt

SEQ ID NO: 51527 - DNA, 20 bp, Neisseria gonorrhoeae
accgagcgacaggtcagtgg

SEQ ID NO: 51528 - DNA, 20 bp, Neisseria gonorrhoeae
ccgagcgacaggtcagtggt

SEQ ID NO: 51529 - DNA, 20 bp, Neisseria gonorrhoeae
gtcggcatggacaaagccgg

SEQ ID NO: 51530 - DNA, 20 bp, Neisseria gonorrhoeae
tcggcatggacaaagccggc

SEQ ID NO: 51531 - DNA, 20 bp, Neisseria gonorrhoeae
taccgtcgctgccggctttg

SEQ ID NO: 51532 - DNA, 20 bp, Neisseria gonorrhoeae
gcgcgccgacaaaaccgtcg

SEQ ID NO: 51533 - DNA, 20 bp, Neisseria gonorrhoeae
cgcgccgacaaaaccgtcgg

SEQ ID NO: 51534 - DNA, 20 bp, Neisseria gonorrhoeae
tgtcggcgcgcaaaggctcg

SEQ ID NO: 51535 - DNA, 20 bp, Neisseria gonorrhoeae
gtcggcgcgcaaaggctcga

SEQ ID NO: 51536 - DNA, 20 bp, Neisseria gonorrhoeae
tcggcgcgcaaaggctcgat

SEQ ID NO: 51537 - DNA, 20 bp, Neisseria gonorrhoeae
caaacgcagggaagaacgcg

SEQ ID NO: 51538 - DNA, 20 bp, Neisseria gonorrhoeae
gttcggcctgccctgccatg

SEQ ID NO: 51539 - DNA, 20 bp, Neisseria gonorrhoeae
ttcggcctgccctgccatgt

SEQ ID NO: 51540 - DNA, 20 bp, Neisseria gonorrhoeae
ggcctgccctgccatgtcgc

SEQ ID NO: 51541 - DNA, 20 bp, Neisseria gonorrhoeae
ttccctgcgtttgcaaccgc

SEQ ID NO: 51542 - DNA, 20 bp, Neisseria gonorrhoeae
tccagcgtttgtccgccgac

SEQ ID NO: 51543 - DNA, 20 bp, Neisseria gonorrhoeae
ccagcgtttgtccgccgacc

SEQ ID NO: 51544 - DNA, 20 bp, Neisseria gonorrhoeae
cagcgtttgtccgccgacca

SEQ ID NO: 51545 - DNA, 20 bp, Neisseria gonorrhoeae
gtccgccgaccatgatttca

SEQ ID NO: 51546 - DNA, 20 bp, Neisseria gonorrhoeae
tccgccgaccatgatttcag

SEQ ID NO: 51547 - DNA, 20 bp, Neisseria gonorrhoeae
gtcggcgttgtccatggcaa

SEQ ID NO: 51548 - DNA, 20 bp, Neisseria gonorrhoeae
tccatggcaaggtcgatgtt

SEQ ID NO: 51549 - DNA, 20 bp, Neisseria gonorrhoeae
gccaagagcatggcgcggtt

SEQ ID NO: 51550 - DNA, 20 bp, Neisseria gonorrhoeae
ggttcgatgctgtcgaacgc

SEQ ID NO: 51551 - DNA, 20 bp, Neisseria gonorrhoeae
gatgctgtcgaacgcgccgc

SEQ ID NO: 51552 - DNA, 20 bp, Neisseria gonorrhoeae
cacgtcgcccttgtcgtaca

SEQ ID NO: 51553 - DNA, 20 bp, Neisseria gonorrhoeae
tcgtacatggatacgggcga

SEQ ID NO: 51554 - DNA, 20 bp, Neisseria gonorrhoeae
gtccgcctgatacacggggc

SEQ ID NO: 51555 - DNA, 20 bp, Neisseria gonorrhoeae
cgccgggcaagatttccgat

SEQ ID NO: 51556 - DNA, 20 bp, Neisseria gonorrhoeae
ccgattacagccccgtgtat

SEQ ID NO: 51557 - DNA, 20 bp, Neisseria gonorrhoeae
tggacgaacccgtccgcccc

SEQ ID NO: 51558 - DNA, 20 bp, Neisseria gonorrhoeae
ggacgaacccgtccgccccg

SEQ ID NO: 51559 - DNA, 20 bp, Neisseria gonorrhoeae
gacgaacccgtccgccccga

SEQ ID NO: 51560 - DNA, 20 bp, Neisseria gonorrhoeae
agacgatttactgggcggac

SEQ ID NO: 51561 - DNA, 20 bp, Neisseria gonorrhoeae
actgggcggacaaggcacgc

SEQ ID NO: 51562 - DNA, 20 bp, Neisseria gonorrhoeae
cgtaggcgttgtcgataatc

SEQ ID NO: 51563 - DNA, 20 bp, Neisseria gonorrhoeae
tcgataatcggcggaatgcc

SEQ ID NO: 51564 - DNA, 20 bp, Neisseria gonorrhoeae
acgcgccaaagcgtccaaac

SEQ ID NO: 51565 - DNA, 20 bp, Neisseria gonorrhoeae
cgccgtcggtcaacacgttg

SEQ ID NO: 51566 - DNA, 20 bp, Neisseria gonorrhoeae
gccgtcggtcaacacgttgc

SEQ ID NO: 51567 - DNA, 20 bp, Neisseria gonorrhoeae
gtgccacggcagcatggtct

SEQ ID NO: 51568 - DNA, 20 bp, Neisseria gonorrhoeae
gacggcgtttttcagccgct

SEQ ID NO: 51569 - DNA, 20 bp, Neisseria gonorrhoeae
ttcagccgctctttgggccg

SEQ ID NO: 51570 - DNA, 20 bp, Neisseria gonorrhoeae
tcagccgctctttgggccgc

SEQ ID NO: 51571 - DNA, 20 bp, Neisseria gonorrhoeae
cagccgctctttgggccgcc

SEQ ID NO: 51572 - DNA, 20 bp, Neisseria gonorrhoeae
agccgctctttgggccgcca

SEQ ID NO: 51573 - DNA, 20 bp, Neisseria gonorrhoeae
tcgggtgaagctcggccatg

SEQ ID NO: 51574 - DNA, 20 bp, Neisseria gonorrhoeae
agcatggtgtttggtccgtc

SEQ ID NO: 51575 - DNA, 20 bp, Neisseria gonorrhoeae
ggtccgtcgggttcggacgg

SEQ ID NO: 51576 - DNA, 20 bp, Neisseria gonorrhoeae
gtccgtcgggttcggacggc

SEQ ID NO: 51577 - DNA, 20 bp, Neisseria gonorrhoeae
ggacggcatttccgacccta

SEQ ID NO: 51578 - DNA, 20 bp, Neisseria gonorrhoeae
gagcggctgccacaggcggc

SEQ ID NO: 51579 - DNA, 20 bp, Neisseria gonorrhoeae
agcggctgccacaggcggca

SEQ ID NO: 51580 - DNA, 20 bp, Neisseria gonorrhoeae
ctgtcttgaaaacaaaaaac

SEQ ID NO: 51581 - DNA, 20 bp, Neisseria gonorrhoeae
tgtcttgaaaacaaaaaaca

SEQ ID NO: 51582 - DNA, 20 bp, Neisseria gonorrhoeae
aaaacaaaaaacaaccagaa

SEQ ID NO: 51583 - DNA, 20 bp, Neisseria gonorrhoeae
cggacgacgttcaaaccgat

SEQ ID NO: 51584 - DNA, 20 bp, Neisseria gonorrhoeae
aaaccgatgccgctgatttc

SEQ ID NO: 51585 - DNA, 20 bp, Neisseria gonorrhoeae
cggtcagcgtgtaaaacagc

SEQ ID NO: 51586 - DNA, 20 bp, Neisseria gonorrhoeae
ggtcagcgtgtaaaacagcg

SEQ ID NO: 51587 - DNA, 20 bp, Neisseria gonorrhoeae
accgtcgtatcgtgcatgtt

SEQ ID NO: 51588 - DNA, 20 bp, Neisseria gonorrhoeae
gccggaaagtgcagcagccc

SEQ ID NO: 51589 - DNA, 20 bp, Neisseria gonorrhoeae
tgctgctgttgccgctgacg

SEQ ID NO: 51590 - DNA, 20 bp, Neisseria gonorrhoeae
ccgctgacggtcgggctgct

SEQ ID NO: 51591 - DNA, 20 bp, Neisseria gonorrhoeae
ccggcgaacacctccgtcct

SEQ ID NO: 51592 - DNA, 20 bp, Neisseria gonorrhoeae
cggcgaacacctccgtcctg

SEQ ID NO: 51593 - DNA, 20 bp, Neisseria gonorrhoeae
tgcctcgggctggatcaggc

SEQ ID NO: 51594 - DNA, 20 bp, Neisseria gonorrhoeae
tctgccaacaccgtgccgat

SEQ ID NO: 51595 - DNA, 20 bp, Neisseria gonorrhoeae
cggcacgcaaaacctgtacg

SEQ ID NO: 51596 - DNA, 20 bp, Neisseria gonorrhoeae
ggcacgcaaaacctgtacgt

SEQ ID NO: 51597 - DNA, 20 bp, Neisseria gonorrhoeae
ccggcgaggaagcgcgtgcc

SEQ ID NO: 51598 - DNA, 20 bp, Neisseria gonorrhoeae
tgcgtgccgaaagctgcgcg

SEQ ID NO: 51599 - DNA, 20 bp, Neisseria gonorrhoeae
tcgggcggcggcggtcaggt

SEQ ID NO: 51600 - DNA, 20 bp, Neisseria gonorrhoeae
cgggcggcggcggtcaggtc

SEQ ID NO: 51601 - DNA, 20 bp, Neisseria gonorrhoeae
gggcggcggcggtcaggtcg

SEQ ID NO: 51602 - DNA, 20 bp, Neisseria gonorrhoeae
cggaggcgttgtgcattgaa

SEQ ID NO: 51603 - DNA, 20 bp, Neisseria gonorrhoeae
tgcattgaagggcgaacgtt

SEQ ID NO: 51604 - DNA, 20 bp, Neisseria gonorrhoeae
tccgatttaatctggtaggc

SEQ ID NO: 51605 - DNA, 20 bp, Neisseria gonorrhoeae
ccgatttaatctggtaggcg

SEQ ID NO: 51606 - DNA, 20 bp, Neisseria gonorrhoeae
cgatttaatctggtaggcgc

SEQ ID NO: 51607 - DNA, 20 bp, Neisseria gonorrhoeae
aatctggtaggcgcgcacga

SEQ ID NO: 51608 - DNA, 20 bp, Neisseria gonorrhoeae
atctggtaggcgcgcacgag

SEQ ID NO: 51609 - DNA, 20 bp, Neisseria gonorrhoeae
ccgcttcgacggcgtgtccg

SEQ ID NO: 51610 - DNA, 20 bp, Neisseria gonorrhoeae
cgcttcgacggcgtgtccga

SEQ ID NO: 51611 - DNA, 20 bp, Neisseria gonorrhoeae
gacggcgtgtccgaaggtgt

SEQ ID NO: 51612 - DNA, 20 bp, Neisseria gonorrhoeae
ggacacgccgtcgaagcgga

SEQ ID NO: 51613 - DNA, 20 bp, Neisseria gonorrhoeae
cggcgtatggctgcacggcg

SEQ ID NO: 51614 - DNA, 20 bp, Neisseria gonorrhoeae
gcctatatttcgggcgcggt

SEQ ID NO: 51615 - DNA, 20 bp, Neisseria gonorrhoeae
cgggcgcggttttggcaagc

SEQ ID NO: 51616 - DNA, 20 bp, Neisseria gonorrhoeae
gggcgcggttttggcaagcg

SEQ ID NO: 51617 - DNA, 20 bp, Neisseria gonorrhoeae
tggcaagcgtgaaaaatgtg

SEQ ID NO: 51618 - DNA, 20 bp, Neisseria gonorrhoeae
ggcaagcgtgaaaaatgtgc

SEQ ID NO: 51619 - DNA, 20 bp, Neisseria gonorrhoeae
gacaaaacggcgaaactgct

SEQ ID NO: 51620 - DNA, 20 bp, Neisseria gonorrhoeae
gccgtatccgggcggtgcga

SEQ ID NO: 51621 - DNA, 20 bp, Neisseria gonorrhoeae
ccgtatccgggcggtgcgaa

SEQ ID NO: 51622 - DNA, 20 bp, Neisseria gonorrhoeae
cgcaagttccgacagtttcg

SEQ ID NO: 51623 - DNA, 20 bp, Neisseria gonorrhoeae
cgacagtttcgcaccgcccg

SEQ ID NO: 51624 - DNA, 20 bp, Neisseria gonorrhoeae
tgtctatcgctttgattttc

SEQ ID NO: 51625 - DNA, 20 bp, Neisseria gonorrhoeae
gtctatcgctttgattttcg

SEQ ID NO: 51626 - DNA, 20 bp, Neisseria gonorrhoeae
tctatcgctttgattttcgg

SEQ ID NO: 51627 - DNA, 20 bp, Neisseria gonorrhoeae
gattttcggcggcttgtaca

SEQ ID NO: 51628 - DNA, 20 bp, Neisseria gonorrhoeae
attttcggcggcttgtacat

SEQ ID NO: 51629 - DNA, 20 bp, Neisseria gonorrhoeae
gggggcgtcataaacggcga

SEQ ID NO: 51630 - DNA, 20 bp, Neisseria gonorrhoeae
ggggcgtcataaacggcgaa

SEQ ID NO: 51631 - DNA, 20 bp, Neisseria gonorrhoeae
aaaatggtcgggactgccga

SEQ ID NO: 51632 - DNA, 20 bp, Neisseria gonorrhoeae
tgaagccgacagcggttcgc

SEQ ID NO: 51633 - DNA, 20 bp, Neisseria gonorrhoeae
gaagccgacagcggttcgcc

SEQ ID NO: 51634 - DNA, 20 bp, Neisseria gonorrhoeae
gcaggaagggcagggttcgc

SEQ ID NO: 51635 - DNA, 20 bp, Neisseria gonorrhoeae
gcagaggacttggtttaagt

SEQ ID NO: 51636 - DNA, 20 bp, Neisseria gonorrhoeae
gtttaagttttcgcgcgagc

SEQ ID NO: 51637 - DNA, 20 bp, Neisseria gonorrhoeae
aagttttcgcgcgagcgttt

SEQ ID NO: 51638 - DNA, 20 bp, Neisseria gonorrhoeae
agttttcgcgcgagcgtttg

SEQ ID NO: 51639 - DNA, 20 bp, Neisseria gonorrhoeae
tcggcgttggtgcggatgat

SEQ ID NO: 51640 - DNA, 20 bp, Neisseria gonorrhoeae
cggcgttggtgcggatgatg

SEQ ID NO: 51641 - DNA, 20 bp, Neisseria gonorrhoeae
ggcgttggtgcggatgatgt

SEQ ID NO: 51642 - DNA, 20 bp, Neisseria gonorrhoeae
gtgcggatgatgtagccccg

SEQ ID NO: 51643 - DNA, 20 bp, Neisseria gonorrhoeae
tccggcaggagcttgtcgag

SEQ ID NO: 51644 - DNA, 20 bp, Neisseria gonorrhoeae
gccgaaatgcagcggctttc

SEQ ID NO: 51645 - DNA, 20 bp, Neisseria gonorrhoeae
ccgaaatgcagcggctttcg

SEQ ID NO: 51646 - DNA, 20 bp, Neisseria gonorrhoeae
cgggacagcgcagcgtgccg

SEQ ID NO: 51647 - DNA, 20 bp, Neisseria gonorrhoeae
gggacagcgcagcgtgccgc

SEQ ID NO: 51648 - DNA, 20 bp, Neisseria gonorrhoeae
tcatcggcgaaacgcacgtc

SEQ ID NO: 51649 - DNA, 20 bp, Neisseria gonorrhoeae
ccgaaagcctgcgccttttg

SEQ ID NO: 51650 - DNA, 20 bp, Neisseria gonorrhoeae
tgcattcgccgccgccgagt

SEQ ID NO: 51651 - DNA, 20 bp, Neisseria gonorrhoeae
gcattcgccgccgccgagtt

SEQ ID NO: 51652 - DNA, 20 bp, Neisseria gonorrhoeae
cattcgccgccgccgagttt

SEQ ID NO: 51653 - DNA, 20 bp, Neisseria gonorrhoeae
gccgccgccgagtttcacta

SEQ ID NO: 51654 - DNA, 20 bp, Neisseria gonorrhoeae
gccgcaggccgtctgaacgt

SEQ ID NO: 51655 - DNA, 20 bp, Neisseria gonorrhoeae
ccgcaggccgtctgaacgtc

SEQ ID NO: 51656 - DNA, 20 bp, Neisseria gonorrhoeae
gttgccaccaccgtcatcga

SEQ ID NO: 51657 - DNA, 20 bp, Neisseria gonorrhoeae
ccaccaccgtcatcgaagtc

SEQ ID NO: 51658 - DNA, 20 bp, Neisseria gonorrhoeae
gatcaccatcagggcggcgt

SEQ ID NO: 51659 - DNA, 20 bp, Neisseria gonorrhoeae
caccttttggaacaagcgcg

SEQ ID NO: 51660 - DNA, 20 bp, Neisseria gonorrhoeae
tggaacaagcgcgcgaaacc

SEQ ID NO: 51661 - DNA, 20 bp, Neisseria gonorrhoeae
ggaacaagcgcgcgaaaccg

SEQ ID NO: 51662 - DNA, 20 bp, Neisseria gonorrhoeae
gaacaagcgcgcgaaaccgc

SEQ ID NO: 51663 - DNA, 20 bp, Neisseria gonorrhoeae
aacaaaaccctgaaatcgtc

SEQ ID NO: 51664 - DNA, 20 bp, Neisseria gonorrhoeae
gcgccgcgcacgctgcgggt

SEQ ID NO: 51665 - DNA, 20 bp, Neisseria gonorrhoeae
cgccgcgcacgctgcgggtt

SEQ ID NO: 51666 - DNA, 20 bp, Neisseria gonorrhoeae
cgggtgtcgaaccggcgggc

SEQ ID NO: 51667 - DNA, 20 bp, Neisseria gonorrhoeae
gggtgtcgaaccggcgggca

SEQ ID NO: 51668 - DNA, 20 bp, Neisseria gonorrhoeae
atggacatcctgcccgccgg

SEQ ID NO: 51669 - DNA, 20 bp, Neisseria gonorrhoeae
ggcgatgccgtcctgaagcc

SEQ ID NO: 51670 - DNA, 20 bp, Neisseria gonorrhoeae
cgggcaggtggcggtgtccg

SEQ ID NO: 51671 - DNA, 20 bp, Neisseria gonorrhoeae
gggcaggtggcggtgtccgg

SEQ ID NO: 51672 - DNA, 20 bp, Neisseria gonorrhoeae
aggacggcatcgccgaagga

SEQ ID NO: 51673 - DNA, 20 bp, Neisseria gonorrhoeae
gtgttcacgccgcacctcgc

SEQ ID NO: 51674 - DNA, 20 bp, Neisseria gonorrhoeae
ccaggtcggaatgtcccgta

SEQ ID NO: 51675 - DNA, 20 bp, Neisseria gonorrhoeae
tggaacagggcgtgcgcgtc

SEQ ID NO: 51676 - DNA, 20 bp, Neisseria gonorrhoeae
ggaacagggcgtgcgcgtca

SEQ ID NO: 51677 - DNA, 20 bp, Neisseria gonorrhoeae
gaacagggcgtgcgcgtcat

SEQ ID NO: 51678 - DNA, 20 bp, Neisseria gonorrhoeae
ccgccgacttccgcatacgg

SEQ ID NO: 51679 - DNA, 20 bp, Neisseria gonorrhoeae
ggaaggcgaggccgtacacg

SEQ ID NO: 51680 - DNA, 20 bp, Neisseria gonorrhoeae
gaaggcgaggccgtacacgc

SEQ ID NO: 51681 - DNA, 20 bp, Neisseria gonorrhoeae
gaaagtaatcggcaactgcg

SEQ ID NO: 51682 - DNA, 20 bp, Neisseria gonorrhoeae
ccgcttcgctgcggctggtt

SEQ ID NO: 51683 - DNA, 20 bp, Neisseria gonorrhoeae
gctgcggctggttacggcgg

SEQ ID NO: 51684 - DNA, 20 bp, Neisseria gonorrhoeae
tcatctcgaacagttcgcga

SEQ ID NO: 51685 - DNA, 20 bp, Neisseria gonorrhoeae
catctcgaacagttcgcgaa

SEQ ID NO: 51686 - DNA, 20 bp, Neisseria gonorrhoeae
atctcgaacagttcgcgaat

SEQ ID NO: 51687 - DNA, 20 bp, Neisseria gonorrhoeae
gcgaatcccaacgctactcc

SEQ ID NO: 51688 - DNA, 20 bp, Neisseria gonorrhoeae
cagacgacgtcaggttgaga

SEQ ID NO: 51689 - DNA, 20 bp, Neisseria gonorrhoeae
ggagcacaggggcagagtct

SEQ ID NO: 51690 - DNA, 20 bp, Neisseria gonorrhoeae
agggtcgtttgccggagcat

SEQ ID NO: 51691 - DNA, 20 bp, Neisseria gonorrhoeae
gggtcgtttgccggagcatt

SEQ ID NO: 51692 - DNA, 20 bp, Neisseria gonorrhoeae
gccggagcattcacgggaat

SEQ ID NO: 51693 - DNA, 20 bp, Neisseria gonorrhoeae
ccggagcattcacgggaatg

SEQ ID NO: 51694 - DNA, 20 bp, Neisseria gonorrhoeae
cgaggcaggggaagaaaagc

SEQ ID NO: 51695 - DNA, 20 bp, Neisseria gonorrhoeae
gaggcaggggaagaaaagca

SEQ ID NO: 51696 - DNA, 20 bp, Neisseria gonorrhoeae
cgcgggatttctgggctggg

SEQ ID NO: 51697 - DNA, 20 bp, Neisseria gonorrhoeae
ctgggctggggcggacattg

SEQ ID NO: 51698 - DNA, 20 bp, Neisseria gonorrhoeae
tgggctggggcggacattgt

SEQ ID NO: 51699 - DNA, 20 bp, Neisseria gonorrhoeae
gtgtccacttgcggataaac

SEQ ID NO: 51700 - DNA, 20 bp, Neisseria gonorrhoeae
tgtccacttgcggataaacg

SEQ ID NO: 51701 - DNA, 20 bp, Neisseria gonorrhoeae
cggataaacgacgtgggcgg

SEQ ID NO: 51702 - DNA, 20 bp, Neisseria gonorrhoeae
gcggctcatagtgcggaagg

SEQ ID NO: 51703 - DNA, 20 bp, Neisseria gonorrhoeae
cgcactatgagccgcgaagg

SEQ ID NO: 51704 - DNA, 20 bp, Neisseria gonorrhoeae
cgaggtaacgtggtcgatgt

SEQ ID NO: 51705 - DNA, 20 bp, Neisseria gonorrhoeae
cagcgcgcgccggtggacga

SEQ ID NO: 51706 - DNA, 20 bp, Neisseria gonorrhoeae
cctcgcaactgccttatgcc

SEQ ID NO: 51707 - DNA, 20 bp, Neisseria gonorrhoeae
tgccctgacggttgccgccg

SEQ ID NO: 51708 - DNA, 20 bp, Neisseria gonorrhoeae
ccgccgccgccgcatcgggc

SEQ ID NO: 51709 - DNA, 20 bp, Neisseria gonorrhoeae
gactttgaccgccatggcgg

SEQ ID NO: 51710 - DNA, 20 bp, Neisseria gonorrhoeae
gaccgccatggcggcggcaa

SEQ ID NO: 51711 - DNA, 20 bp, Neisseria gonorrhoeae
accgccatggcggcggcaat

SEQ ID NO: 51712 - DNA, 20 bp, Neisseria gonorrhoeae
tgcctgtggcaaacgccatc

SEQ ID NO: 51713 - DNA, 20 bp, Neisseria gonorrhoeae
gccacaggcacaagctgggg

SEQ ID NO: 51714 - DNA, 20 bp, Neisseria gonorrhoeae
aaacgggcatcagcacgcac

SEQ ID NO: 51715 - DNA, 20 bp, Neisseria gonorrhoeae
ggcgcgggaaactttaaact

SEQ ID NO: 51716 - DNA, 20 bp, Neisseria gonorrhoeae
gcgcgggaaactttaaactt

SEQ ID NO: 51717 - DNA, 20 bp, Neisseria gonorrhoeae
aaagtttcccgcgccaaact

SEQ ID NO: 51718 - DNA, 20 bp, Neisseria gonorrhoeae
aagtttcccgcgccaaactc

SEQ ID NO: 51719 - DNA, 20 bp, Neisseria gonorrhoeae
caggtgtgtcagaccgtcga

SEQ ID NO: 51720 - DNA, 20 bp, Neisseria gonorrhoeae
aggtgtgtcagaccgtcgac

SEQ ID NO: 51721 - DNA, 20 bp, Neisseria gonorrhoeae
ccgccgaccaaaaaggcaac

SEQ ID NO: 51722 - DNA, 20 bp, Neisseria gonorrhoeae
tggtcggcgttgcctttttg

SEQ ID NO: 51723 - DNA, 20 bp, Neisseria gonorrhoeae
ggtcggcgttgcctttttgg

SEQ ID NO: 51724 - DNA, 20 bp, Neisseria gonorrhoeae
gcgaattgatgccgacgacc

SEQ ID NO: 51725 - DNA, 20 bp, Neisseria gonorrhoeae
cgaattgatgccgacgacct

SEQ ID NO: 51726 - DNA, 20 bp, Neisseria gonorrhoeae
atgccgacgacctgtccttt

SEQ ID NO: 51727 - DNA, 20 bp, Neisseria gonorrhoeae
taagttgaacagcgggccgc

SEQ ID NO: 51728 - DNA, 20 bp, Neisseria gonorrhoeae
aagttgaacagcgggccgcc

SEQ ID NO: 51729 - DNA, 20 bp, Neisseria gonorrhoeae
gccgtcgccttgtttacgcc

SEQ ID NO: 51730 - DNA, 20 bp, Neisseria gonorrhoeae
tttacgccgacatcggtcgc

SEQ ID NO: 51731 - DNA, 20 bp, Neisseria gonorrhoeae
acgccgacatcggtcgcctg

SEQ ID NO: 51732 - DNA, 20 bp, Neisseria gonorrhoeae
cgccgacatcggtcgcctgc

SEQ ID NO: 51733 - DNA, 20 bp, Neisseria gonorrhoeae
ggcgcaggcgaccgatgtcg

SEQ ID NO: 51734 - DNA, 20 bp, Neisseria gonorrhoeae
cctcggttcggcggtaatgg

SEQ ID NO: 51735 - DNA, 20 bp, Neisseria gonorrhoeae
ctcggttcggcggtaatggc

SEQ ID NO: 51736 - DNA, 20 bp, Neisseria gonorrhoeae
ggcggtaatggcgaaattcg

SEQ ID NO: 51737 - DNA, 20 bp, Neisseria gonorrhoeae
gcgcccaaccgttatttggc

SEQ ID NO: 51738 - DNA, 20 bp, Neisseria gonorrhoeae
tttggcgtttaacgcatcgg

SEQ ID NO: 51739 - DNA, 20 bp, Neisseria gonorrhoeae
ggcggtgtgcgaaatgctgg

SEQ ID NO: 51740 - DNA, 20 bp, Neisseria gonorrhoeae
tgccgatgaaggcggcatcg

SEQ ID NO: 51741 - DNA, 20 bp, Neisseria gonorrhoeae
gccgatgaaggcggcatcgt

SEQ ID NO: 51742 - DNA, 20 bp, Neisseria gonorrhoeae
ccgatgaaggcggcatcgtt

SEQ ID NO: 51743 - DNA, 20 bp, Neisseria gonorrhoeae
atcggcaaaatcactgcggt

SEQ ID NO: 51744 - DNA, 20 bp, Neisseria gonorrhoeae
gacgttgcacactttcttgg

SEQ ID NO: 51745 - DNA, 20 bp, Neisseria gonorrhoeae
cacactttcttggcggggca

SEQ ID NO: 51746 - DNA, 20 bp, Neisseria gonorrhoeae
cttggcggggcagcccatat

SEQ ID NO: 51747 - DNA, 20 bp, Neisseria gonorrhoeae
ttggcggggcagcccatatt

SEQ ID NO: 51748 - DNA, 20 bp, Neisseria gonorrhoeae
gcggggcagcccatattgat

SEQ ID NO: 51749 - DNA, 20 bp, Neisseria gonorrhoeae
ttccgcgatttgaagcatta

SEQ ID NO: 51750 - DNA, 20 bp, Neisseria gonorrhoeae
tccgcgatttgaagcattat

SEQ ID NO: 51751 - DNA, 20 bp, Neisseria gonorrhoeae
ccgcgatttgaagcattatg

SEQ ID NO: 51752 - DNA, 20 bp, Neisseria gonorrhoeae
cgcgatttgaagcattatgc

SEQ ID NO: 51753 - DNA, 20 bp, Neisseria gonorrhoeae
ggcataatgcttcaaatcgc

SEQ ID NO: 51754 - DNA, 20 bp, Neisseria gonorrhoeae
ccatgccgccgttcgggttc

SEQ ID NO: 51755 - DNA, 20 bp, Neisseria gonorrhoeae
gggttcggacggcatctgtc

SEQ ID NO: 51756 - DNA, 20 bp, Neisseria gonorrhoeae
ggacggcatctgtctgcatg

SEQ ID NO: 51757 - DNA, 20 bp, Neisseria gonorrhoeae
ggaggtcgggcggaatcccg

SEQ ID NO: 51758 - DNA, 20 bp, Neisseria gonorrhoeae
cgcccgacctccgaaccatg

SEQ ID NO: 51759 - DNA, 20 bp, Neisseria gonorrhoeae
gcggctttggtcagccataa

SEQ ID NO: 51760 - DNA, 20 bp, Neisseria gonorrhoeae
ggtcagccataagctgcccg

SEQ ID NO: 51761 - DNA, 20 bp, Neisseria gonorrhoeae
gtcagccataagctgcccgt

SEQ ID NO: 51762 - DNA, 20 bp, Neisseria gonorrhoeae
cggaatacacggccttgcag

SEQ ID NO: 51763 - DNA, 20 bp, Neisseria gonorrhoeae
ggaatacacggccttgcagg

SEQ ID NO: 51764 - DNA, 20 bp, Neisseria gonorrhoeae
ccgggcaagctgggtatgga

SEQ ID NO: 51765 - DNA, 20 bp, Neisseria gonorrhoeae
cgggcaagctgggtatggac

SEQ ID NO: 51766 - DNA, 20 bp, Neisseria gonorrhoeae
ctgccgtccatacccagctt

SEQ ID NO: 51767 - DNA, 20 bp, Neisseria gonorrhoeae
cccggaaagccgcacagttt

SEQ ID NO: 51768 - DNA, 20 bp, Neisseria gonorrhoeae
cgccatatcgtccagcggca

SEQ ID NO: 51769 - DNA, 20 bp, Neisseria gonorrhoeae
agcgcgccggtgtatctgaa

SEQ ID NO: 51770 - DNA, 20 bp, Neisseria gonorrhoeae
ccagcacgtgaaagcgtcgc

SEQ ID NO: 51771 - DNA, 20 bp, Neisseria gonorrhoeae
agatacaccggcgcgctgaa

SEQ ID NO: 51772 - DNA, 20 bp, Neisseria gonorrhoeae
gcagaattcgacttcatgca

SEQ ID NO: 51773 - DNA, 20 bp, Neisseria gonorrhoeae
cagaattcgacttcatgcac

SEQ ID NO: 51774 - DNA, 20 bp, Neisseria gonorrhoeae
gacttcatgcactacgccct

SEQ ID NO: 51775 - DNA, 20 bp, Neisseria gonorrhoeae
atgcactacgccctcgcatc

SEQ ID NO: 51776 - DNA, 20 bp, Neisseria gonorrhoeae
tgcctgtccctcagcgccgc

SEQ ID NO: 51777 - DNA, 20 bp, Neisseria gonorrhoeae
cgacgggcgataaccacgcc

SEQ ID NO: 51778 - DNA, 20 bp, Neisseria gonorrhoeae
gtaggcttgcagacggctgc

SEQ ID NO: 51779 - DNA, 20 bp, Neisseria gonorrhoeae
cagacggctgcgggtacctt

SEQ ID NO: 51780 - DNA, 20 bp, Neisseria gonorrhoeae
cacgacgcgtacggatacga

SEQ ID NO: 51781 - DNA, 20 bp, Neisseria gonorrhoeae
acagtggtaatcggggttgc

SEQ ID NO: 51782 - DNA, 20 bp, Neisseria gonorrhoeae
cacaggcgtgccaacgtggc

SEQ ID NO: 51783 - DNA, 20 bp, Neisseria gonorrhoeae
gttggtgtgggtcatgaagc

SEQ ID NO: 51784 - DNA, 20 bp, Neisseria gonorrhoeae
gtgtgggtcatgaagcgtgt

SEQ ID NO: 51785 - DNA, 20 bp, Neisseria gonorrhoeae
atgacccacaccaacgaact

SEQ ID NO: 51786 - DNA, 20 bp, Neisseria gonorrhoeae
cggcggcatgttcgagggtt

SEQ ID NO: 51787 - DNA, 20 bp, Neisseria gonorrhoeae
gagggtttgggcggctttgc

SEQ ID NO: 51788 - DNA, 20 bp, Neisseria gonorrhoeae
gggcggctttgcctgtgttc

SEQ ID NO: 51789 - DNA, 20 bp, Neisseria gonorrhoeae
ggcggctttgcctgtgttct

SEQ ID NO: 51790 - DNA, 20 bp, Neisseria gonorrhoeae
gcctgtgttcttgcgtttgg

SEQ ID NO: 51791 - DNA, 20 bp, Neisseria gonorrhoeae
gtgtgccgtcgagttcggca

SEQ ID NO: 51792 - DNA, 20 bp, Neisseria gonorrhoeae
tgtgccgtcgagttcggcaa

SEQ ID NO: 51793 - DNA, 20 bp, Neisseria gonorrhoeae
ggcaaagcgggcaaggtggc

SEQ ID NO: 51794 - DNA, 20 bp, Neisseria gonorrhoeae
accacgctcgacagccgcca

SEQ ID NO: 51795 - DNA, 20 bp, Neisseria gonorrhoeae
ccacgctcgacagccgccac

SEQ ID NO: 51796 - DNA, 20 bp, Neisseria gonorrhoeae
ggcgagcagggcgggatttg

SEQ ID NO: 51797 - DNA, 20 bp, Neisseria gonorrhoeae
gccgctgcaagggctttttt

SEQ ID NO: 51798 - DNA, 20 bp, Neisseria gonorrhoeae
ccgctgcaagggcttttttg

SEQ ID NO: 51799 - DNA, 20 bp, Neisseria gonorrhoeae
tttgatgttttggggttgcg

SEQ ID NO: 51800 - DNA, 20 bp, Neisseria gonorrhoeae
ttgatgttttggggttgcgg

SEQ ID NO: 51801 - DNA, 20 bp, Neisseria gonorrhoeae
agggtgtgggtgtgccggtc

SEQ ID NO: 51802 - DNA, 20 bp, Neisseria gonorrhoeae
cggatgtggtggggaaggtt

SEQ ID NO: 51803 - DNA, 20 bp, Neisseria gonorrhoeae
cccaaccttccccaccacat

SEQ ID NO: 51804 - DNA, 20 bp, Neisseria gonorrhoeae
ccaaccttccccaccacatc

SEQ ID NO: 51805 - DNA, 20 bp, Neisseria gonorrhoeae
cccaccacatccgcaacgga

SEQ ID NO: 51806 - DNA, 20 bp, Neisseria gonorrhoeae
ggcgctcagtgcggcttcga

SEQ ID NO: 51807 - DNA, 20 bp, Neisseria gonorrhoeae
gaggtcgtcggcgttgaaac

SEQ ID NO: 51808 - DNA, 20 bp, Neisseria gonorrhoeae
aaactgatgaggaagttgca

SEQ ID NO: 51809 - DNA, 20 bp, Neisseria gonorrhoeae
cagtgtcgggcgaggcagtg

SEQ ID NO: 51810 - DNA, 20 bp, Neisseria gonorrhoeae
ctcatcagtttcaacgccga

SEQ ID NO: 51811 - DNA, 20 bp, Neisseria gonorrhoeae
agggttgtggtgtaggacgg

SEQ ID NO: 51812 - DNA, 20 bp, Neisseria gonorrhoeae
tggtgtaggacggcggtttt

SEQ ID NO: 51813 - DNA, 20 bp, Neisseria gonorrhoeae
tggtgtgcaggctgtgtccg

SEQ ID NO: 51814 - DNA, 20 bp, Neisseria gonorrhoeae
ggtgtgcaggctgtgtccga

SEQ ID NO: 51815 - DNA, 20 bp, Neisseria gonorrhoeae
gtgtgcaggctgtgtccgaa

SEQ ID NO: 51816 - DNA, 20 bp, Neisseria gonorrhoeae
ggcggggtataggacgacat

SEQ ID NO: 51817 - DNA, 20 bp, Neisseria gonorrhoeae
gcggggtataggacgacatc

SEQ ID NO: 51818 - DNA, 20 bp, Neisseria gonorrhoeae
ggtgcgttgttctgttcgcc

SEQ ID NO: 51819 - DNA, 20 bp, Neisseria gonorrhoeae
ttctgttcgccgctgtgttg

SEQ ID NO: 51820 - DNA, 20 bp, Neisseria gonorrhoeae
tgttcgccgctgtgttgtgc

SEQ ID NO: 51821 - DNA, 20 bp, Neisseria gonorrhoeae
gcggcttttttgaaggcgat

SEQ ID NO: 51822 - DNA, 20 bp, Neisseria gonorrhoeae
aaaaaagccgccaatctcgg

SEQ ID NO: 51823 - DNA, 20 bp, Neisseria gonorrhoeae
gcaggattgctgcacttgga

SEQ ID NO: 51824 - DNA, 20 bp, Neisseria gonorrhoeae
ctgcacttggactggacata

SEQ ID NO: 51825 - DNA, 20 bp, Neisseria gonorrhoeae
gactggacatacacccggct

SEQ ID NO: 51826 - DNA, 20 bp, Neisseria gonorrhoeae
ccgccatgcgcggtctttgt

SEQ ID NO: 51827 - DNA, 20 bp, Neisseria gonorrhoeae
gtcggtttccgcaggttcgg

SEQ ID NO: 51828 - DNA, 20 bp, Neisseria gonorrhoeae
tcggtttccgcaggttcggc

SEQ ID NO: 51829 - DNA, 20 bp, Neisseria gonorrhoeae
ccgcaggttcggctgtactg

SEQ ID NO: 51830 - DNA, 20 bp, Neisseria gonorrhoeae
cgcaggttcggctgtactgc

SEQ ID NO: 51831 - DNA, 20 bp, Neisseria gonorrhoeae
aaaccgatgcgggtgatgag

SEQ ID NO: 51832 - DNA, 20 bp, Neisseria gonorrhoeae
gagttcgggatcggagaggc

SEQ ID NO: 51833 - DNA, 20 bp, Neisseria gonorrhoeae
gggatcggagaggctgtgcc

SEQ ID NO: 51834 - DNA, 20 bp, Neisseria gonorrhoeae
caacctgttttgccgttttg

SEQ ID NO: 51835 - DNA, 20 bp, Neisseria gonorrhoeae
aacctgttttgccgttttga

SEQ ID NO: 51836 - DNA, 20 bp, Neisseria gonorrhoeae
ttcgatcggctgccaatcaa

SEQ ID NO: 51837 - DNA, 20 bp, Neisseria gonorrhoeae
gatcggctgccaatcaatca

SEQ ID NO: 51838 - DNA, 20 bp, Neisseria gonorrhoeae
ggcagtcatggcttgtgcgg

SEQ ID NO: 51839 - DNA, 20 bp, Neisseria gonorrhoeae
gcagtcatggcttgtgcggt

SEQ ID NO: 51840 - DNA, 20 bp, Neisseria gonorrhoeae
ccgctatcggagttggacca

SEQ ID NO: 51841 - DNA, 20 bp, Neisseria gonorrhoeae
ttcagcaggcagaatccgcc

SEQ ID NO: 51842 - DNA, 20 bp, Neisseria gonorrhoeae
agcaggcagaatccgccggc

SEQ ID NO: 51843 - DNA, 20 bp, Neisseria gonorrhoeae
gccgcttttcgcgtgatgcc

SEQ ID NO: 51844 - DNA, 20 bp, Neisseria gonorrhoeae
ccgcttttcgcgtgatgccc

SEQ ID NO: 51845 - DNA, 20 bp, Neisseria gonorrhoeae
tcgcgtgatgccccggcggg

SEQ ID NO: 51846 - DNA, 20 bp, Neisseria gonorrhoeae
gccccggggtcgtgcccggt

SEQ ID NO: 51847 - DNA, 20 bp, Neisseria gonorrhoeae
ccccggggtcgtgcccggtg

SEQ ID NO: 51848 - DNA, 20 bp, Neisseria gonorrhoeae
tccaccccgcctgcaccggg

SEQ ID NO: 51849 - DNA, 20 bp, Neisseria gonorrhoeae
ccaccccgcctgcaccgggc

SEQ ID NO: 51850 - DNA, 20 bp, Neisseria gonorrhoeae
caccccgcctgcaccgggca

SEQ ID NO: 51851 - DNA, 20 bp, Neisseria gonorrhoeae
atcggcccgcaagtcggtga

SEQ ID NO: 51852 - DNA, 20 bp, Neisseria gonorrhoeae
tcggcccgcaagtcggtgag

SEQ ID NO: 51853 - DNA, 20 bp, Neisseria gonorrhoeae
gtaaataatggattgatggc

SEQ ID NO: 51854 - DNA, 20 bp, Neisseria gonorrhoeae
atggctttaggttttgtcgt

SEQ ID NO: 51855 - DNA, 20 bp, Neisseria gonorrhoeae
aggttttgtcgttatcggca

SEQ ID NO: 51856 - DNA, 20 bp, Neisseria gonorrhoeae
gcacaagacggttttttcgc

SEQ ID NO: 51857 - DNA, 20 bp, Neisseria gonorrhoeae
tttcgccgttgatggcgtag

SEQ ID NO: 51858 - DNA, 20 bp, Neisseria gonorrhoeae
ttcgccgttgatggcgtagc

SEQ ID NO: 51859 - DNA, 20 bp, Neisseria gonorrhoeae
tcgccgttgatggcgtagcg

SEQ ID NO: 51860 - DNA, 20 bp, Neisseria gonorrhoeae
cgccgttgatggcgtagcgg

SEQ ID NO: 51861 - DNA, 20 bp, Neisseria gonorrhoeae
ttccgcaggcgtgcagcatg

SEQ ID NO: 51862 - DNA, 20 bp, Neisseria gonorrhoeae
tccgcaggcgtgcagcatgg

SEQ ID NO: 51863 - DNA, 20 bp, Neisseria gonorrhoeae
ccgcaggcgtgcagcatggg

SEQ ID NO: 51864 - DNA, 20 bp, Neisseria gonorrhoeae
cgcaggcgtgcagcatgggt

SEQ ID NO: 51865 - DNA, 20 bp, Neisseria gonorrhoeae
gatgctgggtttgggttcgc

SEQ ID NO: 51866 - DNA, 20 bp, Neisseria gonorrhoeae
caccgcatccaaaccggtcg

SEQ ID NO: 51867 - DNA, 20 bp, Neisseria gonorrhoeae
cgcccgccgtgggtaaagat

SEQ ID NO: 51868 - DNA, 20 bp, Neisseria gonorrhoeae
cccagcgtgtgttttcgggg

SEQ ID NO: 51869 - DNA, 20 bp, Neisseria gonorrhoeae
ccagcgtgtgttttcggggt

SEQ ID NO: 51870 - DNA, 20 bp, Neisseria gonorrhoeae
tcggggttgacggctttggc

SEQ ID NO: 51871 - DNA, 20 bp, Neisseria gonorrhoeae
agcaggcggcggatgtcggc

SEQ ID NO: 51872 - DNA, 20 bp, Neisseria gonorrhoeae
ccggacaagtcttcatcccg

SEQ ID NO: 51873 - DNA, 20 bp, Neisseria gonorrhoeae
atcccgctgaccgtcggcgg

SEQ ID NO: 51874 - DNA, 20 bp, Neisseria gonorrhoeae
ccgacatccgccgcctgctc

SEQ ID NO: 51875 - DNA, 20 bp, Neisseria gonorrhoeae
ttcggcggcacacagggcgc

SEQ ID NO: 51876 - DNA, 20 bp, Neisseria gonorrhoeae
tcggcggcacacagggcgcg

SEQ ID NO: 51877 - DNA, 20 bp, Neisseria gonorrhoeae
cggcggcacacagggcgcgg

SEQ ID NO: 51878 - DNA, 20 bp, Neisseria gonorrhoeae
ggcggcacacagggcgcgga

SEQ ID NO: 51879 - DNA, 20 bp, Neisseria gonorrhoeae
gacgacatccgcgccctgtg

SEQ ID NO: 51880 - DNA, 20 bp, Neisseria gonorrhoeae
accggtttgcgcaggccttg

SEQ ID NO: 51881 - DNA, 20 bp, Neisseria gonorrhoeae
gcgcaggccttgcagcagcg

SEQ ID NO: 51882 - DNA, 20 bp, Neisseria gonorrhoeae
cgcaggccttgcagcagcgg

SEQ ID NO: 51883 - DNA, 20 bp, Neisseria gonorrhoeae
cagcagcgggccgacgctca

SEQ ID NO: 51884 - DNA, 20 bp, Neisseria gonorrhoeae
gcactgcgttggacggcttt

SEQ ID NO: 51885 - DNA, 20 bp, Neisseria gonorrhoeae
ggcaaggttcaattggtgtg

SEQ ID NO: 51886 - DNA, 20 bp, Neisseria gonorrhoeae
gcaaggttcaattggtgtgc

SEQ ID NO: 51887 - DNA, 20 bp, Neisseria gonorrhoeae
aattggtgtgccagcgcgtc

SEQ ID NO: 51888 - DNA, 20 bp, Neisseria gonorrhoeae
gtgtgccagcgcgtcggcat

SEQ ID NO: 51889 - DNA, 20 bp, Neisseria gonorrhoeae
tcggaacggacggcgaagac

SEQ ID NO: 51890 - DNA, 20 bp, Neisseria gonorrhoeae
gcggcatcgagtgcggcaac

SEQ ID NO: 51891 - DNA, 20 bp, Neisseria gonorrhoeae
gccgaccagtgcgtcgaacc

SEQ ID NO: 51892 - DNA, 20 bp, Neisseria gonorrhoeae
ccgaccagtgcgtcgaacca

SEQ ID NO: 51893 - DNA, 20 bp, Neisseria gonorrhoeae
tgccttgcgcgagcagggtt

SEQ ID NO: 51894 - DNA, 20 bp, Neisseria gonorrhoeae
gccttgcgcgagcagggttt

SEQ ID NO: 51895 - DNA, 20 bp, Neisseria gonorrhoeae
ggaaatgccggtcaattcca

SEQ ID NO: 51896 - DNA, 20 bp, Neisseria gonorrhoeae
caacatggcttcgatgcgct

SEQ ID NO: 51897 - DNA, 20 bp, Neisseria gonorrhoeae
gatgcgctgtcgctcttgcg

SEQ ID NO: 51898 - DNA, 20 bp, Neisseria gonorrhoeae
cgccgtcctgcctttgccgt

SEQ ID NO: 51899 - DNA, 20 bp, Neisseria gonorrhoeae
gccgttgccgagaccgtagg

SEQ ID NO: 51900 - DNA, 20 bp, Neisseria gonorrhoeae
catcagcttgaggaagacga

SEQ ID NO: 51901 - DNA, 20 bp, Neisseria gonorrhoeae
atcagcttgaggaagacgag

SEQ ID NO: 51902 - DNA, 20 bp, Neisseria gonorrhoeae
gcactcgtcttcctcaagct

SEQ ID NO: 51903 - DNA, 20 bp, Neisseria gonorrhoeae
ctcaagctgatgaaagagtt

SEQ ID NO: 51904 - DNA, 20 bp, Neisseria gonorrhoeae
accgccaccctgctgctgac

SEQ ID NO: 51905 - DNA, 20 bp, Neisseria gonorrhoeae
tttggcggcaaccggtacgc

SEQ ID NO: 51906 - DNA, 20 bp, Neisseria gonorrhoeae
ttggcggcaaccggtacgcc

SEQ ID NO: 51907 - DNA, 20 bp, Neisseria gonorrhoeae
tggcggcaaccggtacgcct

SEQ ID NO: 51908 - DNA, 20 bp, Neisseria gonorrhoeae
ggcggcaaccggtacgcctt

SEQ ID NO: 51909 - DNA, 20 bp, Neisseria gonorrhoeae
gcggcaaccggtacgccttt

SEQ ID NO: 51910 - DNA, 20 bp, Neisseria gonorrhoeae
acgcgtttgcgacagtcggc

SEQ ID NO: 51911 - DNA, 20 bp, Neisseria gonorrhoeae
gcgacagtcggccatgcgtt

SEQ ID NO: 51912 - DNA, 20 bp, Neisseria gonorrhoeae
cgacagtcggccatgcgttc

SEQ ID NO: 51913 - DNA, 20 bp, Neisseria gonorrhoeae
gaaatcgcgtccgagcattt

SEQ ID NO: 51914 - DNA, 20 bp, Neisseria gonorrhoeae
cgaacgcatggccgactgtc

SEQ ID NO: 51915 - DNA, 20 bp, Neisseria gonorrhoeae
gagggcgcgtcttcgggctt

SEQ ID NO: 51916 - DNA, 20 bp, Neisseria gonorrhoeae
gggcttgggtttttcgacaa

SEQ ID NO: 51917 - DNA, 20 bp, Neisseria gonorrhoeae
ggtttttcgacaatgccggt

SEQ ID NO: 51918 - DNA, 20 bp, Neisseria gonorrhoeae
ttcgacaatgccggtaatgc

SEQ ID NO: 51919 - DNA, 20 bp, Neisseria gonorrhoeae
tcgacaatgccggtaatgcg

SEQ ID NO: 51920 - DNA, 20 bp, Neisseria gonorrhoeae
ttccgccgcttcttccaagc

SEQ ID NO: 51921 - DNA, 20 bp, Neisseria gonorrhoeae
tccgccgcttcttccaagcc

SEQ ID NO: 51922 - DNA, 20 bp, Neisseria gonorrhoeae
ccgccgcttcttccaagccg

SEQ ID NO: 51923 - DNA, 20 bp, Neisseria gonorrhoeae
cgccgcttcttccaagccga

SEQ ID NO: 51924 - DNA, 20 bp, Neisseria gonorrhoeae
ttccaagccgaaccagccgt

SEQ ID NO: 51925 - DNA, 20 bp, Neisseria gonorrhoeae
aacggcactgcagatatcgt

SEQ ID NO: 51926 - DNA, 20 bp, Neisseria gonorrhoeae
ttaacgatatctgcagtgcc

SEQ ID NO: 51927 - DNA, 20 bp, Neisseria gonorrhoeae
taacgatatctgcagtgccg

SEQ ID NO: 51928 - DNA, 20 bp, Neisseria gonorrhoeae
aacgatatctgcagtgccgt

SEQ ID NO: 51929 - DNA, 20 bp, Neisseria gonorrhoeae
acgatatctgcagtgccgtt

SEQ ID NO: 51930 - DNA, 20 bp, Neisseria gonorrhoeae
ccagcgcgtgacagacggca

SEQ ID NO: 51931 - DNA, 20 bp, Neisseria gonorrhoeae
tgccgggatgggttggttcg

SEQ ID NO: 51932 - DNA, 20 bp, Neisseria gonorrhoeae
gccgggatgggttggttcga

SEQ ID NO: 51933 - DNA, 20 bp, Neisseria gonorrhoeae
ccgggatgggttggttcgat

SEQ ID NO: 51934 - DNA, 20 bp, Neisseria gonorrhoeae
gttcgatgccgtctgtcacg

SEQ ID NO: 51935 - DNA, 20 bp, Neisseria gonorrhoeae
tggcggcatatgctcaactg

SEQ ID NO: 51936 - DNA, 20 bp, Neisseria gonorrhoeae
ggcggcatatgctcaactgg

SEQ ID NO: 51937 - DNA, 20 bp, Neisseria gonorrhoeae
gcggcatatgctcaactggc

SEQ ID NO: 51938 - DNA, 20 bp, Neisseria gonorrhoeae
ccgtcgccatcctgcctatg

SEQ ID NO: 51939 - DNA, 20 bp, Neisseria gonorrhoeae
tcctttatcctgctgatacc

SEQ ID NO: 51940 - DNA, 20 bp, Neisseria gonorrhoeae
cctttatcctgctgataccc

SEQ ID NO: 51941 - DNA, 20 bp, Neisseria gonorrhoeae
ctttatcctgctgatacccg

SEQ ID NO: 51942 - DNA, 20 bp, Neisseria gonorrhoeae
atcctgctgatacccgccgc

SEQ ID NO: 51943 - DNA, 20 bp, Neisseria gonorrhoeae
tcctgctgatacccgccgcc

SEQ ID NO: 51944 - DNA, 20 bp, Neisseria gonorrhoeae
aagccgattttgccgagcag

SEQ ID NO: 51945 - DNA, 20 bp, Neisseria gonorrhoeae
tgccgagcagcgcggtcagt

SEQ ID NO: 51946 - DNA, 20 bp, Neisseria gonorrhoeae
gccgagcagcgcggtcagtt

SEQ ID NO: 51947 - DNA, 20 bp, Neisseria gonorrhoeae
ccgagcagcgcggtcagttc

SEQ ID NO: 51948 - DNA, 20 bp, Neisseria gonorrhoeae
gtcgaaacagccttggatgt

SEQ ID NO: 51949 - DNA, 20 bp, Neisseria gonorrhoeae
ctgcccgcggcttctccggc

SEQ ID NO: 51950 - DNA, 20 bp, Neisseria gonorrhoeae
tccggcgacgacgtagtcgg

SEQ ID NO: 51951 - DNA, 20 bp, Neisseria gonorrhoeae
ttttggacacgctgccggac

SEQ ID NO: 51952 - DNA, 20 bp, Neisseria gonorrhoeae
tttggacacgctgccggaca

SEQ ID NO: 51953 - DNA, 20 bp, Neisseria gonorrhoeae
ttggacacgctgccggacac

SEQ ID NO: 51954 - DNA, 20 bp, Neisseria gonorrhoeae
tggagcggaacggattcggt

SEQ ID NO: 51955 - DNA, 20 bp, Neisseria gonorrhoeae
ggtttgcttggcggacggtg

SEQ ID NO: 51956 - DNA, 20 bp, Neisseria gonorrhoeae
gcttggcggacggtgtttcg

SEQ ID NO: 51957 - DNA, 20 bp, Neisseria gonorrhoeae
cttggcggacggtgtttcgg

SEQ ID NO: 51958 - DNA, 20 bp, Neisseria gonorrhoeae
gcggacggtgtttcggcaaa

SEQ ID NO: 51959 - DNA, 20 bp, Neisseria gonorrhoeae
caacgcttcgagttcgcgga

SEQ ID NO: 51960 - DNA, 20 bp, Neisseria gonorrhoeae
gagttcgcggaacaggcggt

SEQ ID NO: 51961 - DNA, 20 bp, Neisseria gonorrhoeae
gcggaacaggcggtcgtatt

SEQ ID NO: 51962 - DNA, 20 bp, Neisseria gonorrhoeae
ggcatcgggtatgctgggcg

SEQ ID NO: 51963 - DNA, 20 bp, Neisseria gonorrhoeae
cgcgaactcgaagcgttgga

SEQ ID NO: 51964 - DNA, 20 bp, Neisseria gonorrhoeae
gataaaggcggcaaggtcgg

SEQ ID NO: 51965 - DNA, 20 bp, Neisseria gonorrhoeae
ccgcctttatcgaagtggct

SEQ ID NO: 51966 - DNA, 20 bp, Neisseria gonorrhoeae
atcgaagtggcttccgcact

SEQ ID NO: 51967 - DNA, 20 bp, Neisseria gonorrhoeae
tcgaagtggcttccgcactg

SEQ ID NO: 51968 - DNA, 20 bp, Neisseria gonorrhoeae
cgcactggacgcattctgcg

SEQ ID NO: 51969 - DNA, 20 bp, Neisseria gonorrhoeae
ggcaatctggaaatggtcgt

SEQ ID NO: 51970 - DNA, 20 bp, Neisseria gonorrhoeae
tcggctgcaccatggacgac

SEQ ID NO: 51971 - DNA, 20 bp, Neisseria gonorrhoeae
ccagattgccgaacccatcc

SEQ ID NO: 51972 - DNA, 20 bp, Neisseria gonorrhoeae
cagattgccgaacccatccc

SEQ ID NO: 51973 - DNA, 20 bp, Neisseria gonorrhoeae
ccgaacccatcccgggcatc

SEQ ID NO: 51974 - DNA, 20 bp, Neisseria gonorrhoeae
ggcaaacggttcgaaatcgc

SEQ ID NO: 51975 - DNA, 20 bp, Neisseria gonorrhoeae
gaaatcgcagccttccagtt

SEQ ID NO: 51976 - DNA, 20 bp, Neisseria gonorrhoeae
cagttcgatgccgatggaaa

SEQ ID NO: 51977 - DNA, 20 bp, Neisseria gonorrhoeae
gatgccgatggaaaacgcgt

SEQ ID NO: 51978 - DNA, 20 bp, Neisseria gonorrhoeae
cacttctcccgcccccgaaa

SEQ ID NO: 51979 - DNA, 20 bp, Neisseria gonorrhoeae
gcaaacagcttttccaccgc

SEQ ID NO: 51980 - DNA, 20 bp, Neisseria gonorrhoeae
tccaccgcatccgtgccgta

SEQ ID NO: 51981 - DNA, 20 bp, Neisseria gonorrhoeae
ccaccgcatccgtgccgtat

SEQ ID NO: 51982 - DNA, 20 bp, Neisseria gonorrhoeae
caccgcatccgtgccgtatt

SEQ ID NO: 51983 - DNA, 20 bp, Neisseria gonorrhoeae
gaacggcggcagcgaaatgt

SEQ ID NO: 51984 - DNA, 20 bp, Neisseria gonorrhoeae
gaccctgctgttggatgtgc

SEQ ID NO: 51985 - DNA, 20 bp, Neisseria gonorrhoeae
accctgctgttggatgtgcc

SEQ ID NO: 51986 - DNA, 20 bp, Neisseria gonorrhoeae
gatgtgccgctggaagtatc

SEQ ID NO: 51987 - DNA, 20 bp, Neisseria gonorrhoeae
gagcaggagcaggcggattt

SEQ ID NO: 51988 - DNA, 20 bp, Neisseria gonorrhoeae
ctcgcgcgcctgtccgatac

SEQ ID NO: 51989 - DNA, 20 bp, Neisseria gonorrhoeae
gctgctgttccgtaaaacag

SEQ ID NO: 51990 - DNA, 20 bp, Neisseria gonorrhoeae
ctgctgttccgtaaaacagg

SEQ ID NO: 51991 - DNA, 20 bp, Neisseria gonorrhoeae
cgtaaaacaggtgcgccgac

SEQ ID NO: 51992 - DNA, 20 bp, Neisseria gonorrhoeae
tacggaacagcagcaaaggc

SEQ ID NO: 51993 - DNA, 20 bp, Neisseria gonorrhoeae
acggaacagcagcaaaggct

SEQ ID NO: 51994 - DNA, 20 bp, Neisseria gonorrhoeae
tttggcggtttcgacggcga

SEQ ID NO: 51995 - DNA, 20 bp, Neisseria gonorrhoeae
ggcggtttcgacggcgatgg

SEQ ID NO: 51996 - DNA, 20 bp, Neisseria gonorrhoeae
gcggtttcgacggcgatggg

SEQ ID NO: 51997 - DNA, 20 bp, Neisseria gonorrhoeae
cgacggcgatggggtagccg

SEQ ID NO: 51998 - DNA, 20 bp, Neisseria gonorrhoeae
gacggcgatggggtagccgt

SEQ ID NO: 51999 - DNA, 20 bp, Neisseria gonorrhoeae
gatgggttcggttgtgggcg

SEQ ID NO: 52000 - DNA, 20 bp, Neisseria gonorrhoeae
ggttgtgggcgagcgtttcg

SEQ ID NO: 52001 - DNA, 20 bp, Neisseria gonorrhoeae
tgggcgagcgtttcgtacag

SEQ ID NO: 52002 - DNA, 20 bp, Neisseria gonorrhoeae
cgtacagggtgtccgccgtg

SEQ ID NO: 52003 - DNA, 20 bp, Neisseria gonorrhoeae
gtacagggtgtccgccgtgc

SEQ ID NO: 52004 - DNA, 20 bp, Neisseria gonorrhoeae
cctacaaagcgcgcattatg

SEQ ID NO: 52005 - DNA, 20 bp, Neisseria gonorrhoeae
tggcggcgttgcccgaaggc

SEQ ID NO: 52006 - DNA, 20 bp, Neisseria gonorrhoeae
cccgaaggcagcgcgtttga

SEQ ID NO: 52007 - DNA, 20 bp, Neisseria gonorrhoeae
gagccgctgatgacgcttta

SEQ ID NO: 52008 - DNA, 20 bp, Neisseria gonorrhoeae
agccgctgatgacgctttac

SEQ ID NO: 52009 - DNA, 20 bp, Neisseria gonorrhoeae
gaacacatcaccaccgccga

SEQ ID NO: 52010 - DNA, 20 bp, Neisseria gonorrhoeae
tggaagcgggcgacaacgtt

SEQ ID NO: 52011 - DNA, 20 bp, Neisseria gonorrhoeae
ggaagcgggcgacaacgttg

SEQ ID NO: 52012 - DNA, 20 bp, Neisseria gonorrhoeae
gaagcgggcgacaacgttgc

SEQ ID NO: 52013 - DNA, 20 bp, Neisseria gonorrhoeae
tcgcccgcttccaaaacgag

SEQ ID NO: 52014 - DNA, 20 bp, Neisseria gonorrhoeae
gtcgccgccgttaccggcga

SEQ ID NO: 52015 - DNA, 20 bp, Neisseria gonorrhoeae
ccggcgagaaggcgcacaaa

SEQ ID NO: 52016 - DNA, 20 bp, Neisseria gonorrhoeae
ttcctcggcaccgactccgc

SEQ ID NO: 52017 - DNA, 20 bp, Neisseria gonorrhoeae
ctcggcaccgactccgcgcc

SEQ ID NO: 52018 - DNA, 20 bp, Neisseria gonorrhoeae
ggcgtgcggcgcggagtcgg

SEQ ID NO: 52019 - DNA, 20 bp, Neisseria gonorrhoeae
agacggccttcgatactggc

SEQ ID NO: 52020 - DNA, 20 bp, Neisseria gonorrhoeae
gatactggcggacgcgatgg

SEQ ID NO: 52021 - DNA, 20 bp, Neisseria gonorrhoeae
gccgccgtcagcttcgatgc

SEQ ID NO: 52022 - DNA, 20 bp, Neisseria gonorrhoeae
ccgccgtcagcttcgatgcc

SEQ ID NO: 52023 - DNA, 20 bp, Neisseria gonorrhoeae
gatgccgatttcaacacggc

SEQ ID NO: 52024 - DNA, 20 bp, Neisseria gonorrhoeae
ccgaggcgctcggcggtgtg

SEQ ID NO: 52025 - DNA, 20 bp, Neisseria gonorrhoeae
tcgtcgtggaggcgatgcgc

SEQ ID NO: 52026 - DNA, 20 bp, Neisseria gonorrhoeae
cgtcgtggaggcgatgcgcc

SEQ ID NO: 52027 - DNA, 20 bp, Neisseria gonorrhoeae
gtcgtggaggcgatgcgcct

SEQ ID NO: 52028 - DNA, 20 bp, Neisseria gonorrhoeae
tgattcagcctgtcgttgag

SEQ ID NO: 52029 - DNA, 20 bp, Neisseria gonorrhoeae
cctttagacgcttccacgcc

SEQ ID NO: 52030 - DNA, 20 bp, Neisseria gonorrhoeae
agacgcttccacgccgccgg

SEQ ID NO: 52031 - DNA, 20 bp, Neisseria gonorrhoeae
gacgcttccacgccgccgga

SEQ ID NO: 52032 - DNA, 20 bp, Neisseria gonorrhoeae
cacgccgccggatacgtcga

SEQ ID NO: 52033 - DNA, 20 bp, Neisseria gonorrhoeae
cgctccggtgatgcggacgg

SEQ ID NO: 52034 - DNA, 20 bp, Neisseria gonorrhoeae
aaggcgacggattcggaggc

SEQ ID NO: 52035 - DNA, 20 bp, Neisseria gonorrhoeae
ggaggcgacggcataggatt

SEQ ID NO: 52036 - DNA, 20 bp, Neisseria gonorrhoeae
cctgccttcgctgtcggttt

SEQ ID NO: 52037 - DNA, 20 bp, Neisseria gonorrhoeae
ctgccttcgctgtcggtttg

SEQ ID NO: 52038 - DNA, 20 bp, Neisseria gonorrhoeae
gctgtcggtttgcgaaccca

SEQ ID NO: 52039 - DNA, 20 bp, Neisseria gonorrhoeae
tcttcgcctgccaagtcctg

SEQ ID NO: 52040 - DNA, 20 bp, Neisseria gonorrhoeae
gcctgccaagtcctgcggtt

SEQ ID NO: 52041 - DNA, 20 bp, Neisseria gonorrhoeae
gtcggcggcggtttccccgt

SEQ ID NO: 52042 - DNA, 20 bp, Neisseria gonorrhoeae
tcggcggcggtttccccgtt

SEQ ID NO: 52043 - DNA, 20 bp, Neisseria gonorrhoeae
ccccgttttcggcggcggat

SEQ ID NO: 52044 - DNA, 20 bp, Neisseria gonorrhoeae
gattgcaccaatgtccaccg

SEQ ID NO: 52045 - DNA, 20 bp, Neisseria gonorrhoeae
attgcaccaatgtccaccgg

SEQ ID NO: 52046 - DNA, 20 bp, Neisseria gonorrhoeae
caccaatgtccaccggcagt

SEQ ID NO: 52047 - DNA, 20 bp, Neisseria gonorrhoeae
caatacggtcaacgcgcagg

SEQ ID NO: 52048 - DNA, 20 bp, Neisseria gonorrhoeae
ctaacgccgcctgcgcgttg

SEQ ID NO: 52049 - DNA, 20 bp, Neisseria gonorrhoeae
gggcgcaccgattggcgtac

SEQ ID NO: 52050 - DNA, 20 bp, Neisseria gonorrhoeae
gcgtactgcacggcttccgc

SEQ ID NO: 52051 - DNA, 20 bp, Neisseria gonorrhoeae
cgcagctatctgatgcagga

SEQ ID NO: 52052 - DNA, 20 bp, Neisseria gonorrhoeae
gggacgcactctgtttccgc

SEQ ID NO: 52053 - DNA, 20 bp, Neisseria gonorrhoeae
gccgttttcgtcctgcatca

SEQ ID NO: 52054 - DNA, 20 bp, Neisseria gonorrhoeae
ccttgagttacgcttatttt

SEQ ID NO: 52055 - DNA, 20 bp, Neisseria gonorrhoeae
agttacgcttatttttccgt

SEQ ID NO: 52056 - DNA, 20 bp, Neisseria gonorrhoeae
cgcttatttttccgtttaaa

SEQ ID NO: 52057 - DNA, 20 bp, Neisseria gonorrhoeae
tttttccgtttaaattcgcg

SEQ ID NO: 52058 - DNA, 20 bp, Neisseria gonorrhoeae
ttccgtttaaattcgcgccg

SEQ ID NO: 52059 - DNA, 20 bp, Neisseria gonorrhoeae
tgctttggcgtgtttgacgc

SEQ ID NO: 52060 - DNA, 20 bp, Neisseria gonorrhoeae
ggcgtgtttgacgctgacgg

SEQ ID NO: 52061 - DNA, 20 bp, Neisseria gonorrhoeae
gcgtgtttgacgctgacggc

SEQ ID NO: 52062 - DNA, 20 bp, Neisseria gonorrhoeae
gacgctgacggcatattggg

SEQ ID NO: 52063 - DNA, 20 bp, Neisseria gonorrhoeae
acgctgacggcatattgggg

SEQ ID NO: 52064 - DNA, 20 bp, Neisseria gonorrhoeae
gcgcattgccccgagctgtc

SEQ ID NO: 52065 - DNA, 20 bp, Neisseria gonorrhoeae
ccccgagctgtcccaaattc

SEQ ID NO: 52066 - DNA, 20 bp, Neisseria gonorrhoeae
cgcgcgcgggcatcgtacac

SEQ ID NO: 52067 - DNA, 20 bp, Neisseria gonorrhoeae
ggacaaagaaaccagcgggc

SEQ ID NO: 52068 - DNA, 20 bp, Neisseria gonorrhoeae
ctttgtccaaacggtgtacg

SEQ ID NO: 52069 - DNA, 20 bp, Neisseria gonorrhoeae
ccggcgacccggtttacggc

SEQ ID NO: 52070 - DNA, 20 bp, Neisseria gonorrhoeae
ccgtaaaccgggtcgccggc

SEQ ID NO: 52071 - DNA, 20 bp, Neisseria gonorrhoeae
gcctcgcgcatatggacgcg

SEQ ID NO: 52072 - DNA, 20 bp, Neisseria gonorrhoeae
ggtgcgtcctgcccgttccg

SEQ ID NO: 52073 - DNA, 20 bp, Neisseria gonorrhoeae
gtgcgtcctgcccgttccga

SEQ ID NO: 52074 - DNA, 20 bp, Neisseria gonorrhoeae
gggtatcgaggcagacgcat

SEQ ID NO: 52075 - DNA, 20 bp, Neisseria gonorrhoeae
ggtatcgaggcagacgcatt

SEQ ID NO: 52076 - DNA, 20 bp, Neisseria gonorrhoeae
gcactgtttgccgagcgcgt

SEQ ID NO: 52077 - DNA, 20 bp, Neisseria gonorrhoeae
gccgagcgcgtggaaggcaa

SEQ ID NO: 52078 - DNA, 20 bp, Neisseria gonorrhoeae
ccgagcgcgtggaaggcaat

SEQ ID NO: 52079 - DNA, 20 bp, Neisseria gonorrhoeae
ccaatgttgcccgcttcgac

SEQ ID NO: 52080 - DNA, 20 bp, Neisseria gonorrhoeae
cccgcttcgacgcgttccaa

SEQ ID NO: 52081 - DNA, 20 bp, Neisseria gonorrhoeae
gacgcgttccaactggcagg

SEQ ID NO: 52082 - DNA, 20 bp, Neisseria gonorrhoeae
caactggcaggcgcgtggat

SEQ ID NO: 52083 - DNA, 20 bp, Neisseria gonorrhoeae
atccacgcgcctgccagttg

SEQ ID NO: 52084 - DNA, 20 bp, Neisseria gonorrhoeae
ggggcgacaaacagacgctc

SEQ ID NO: 52085 - DNA, 20 bp, Neisseria gonorrhoeae
gggcgacaaacagacgctcg

SEQ ID NO: 52086 - DNA, 20 bp, Neisseria gonorrhoeae
accgcaagcggtgcgagcgt

SEQ ID NO: 52087 - DNA, 20 bp, Neisseria gonorrhoeae
gtcgccccaaagcctgaggc

SEQ ID NO: 52088 - DNA, 20 bp, Neisseria gonorrhoeae
tcgccccaaagcctgaggct

SEQ ID NO: 52089 - DNA, 20 bp, Neisseria gonorrhoeae
ggcggcaagctggtgcagcg

SEQ ID NO: 52090 - DNA, 20 bp, Neisseria gonorrhoeae
aagccagcggctttccacaa

SEQ ID NO: 52091 - DNA, 20 bp, Neisseria gonorrhoeae
ccacaatgcggcggctcctg

SEQ ID NO: 52092 - DNA, 20 bp, Neisseria gonorrhoeae
cacaatgcggcggctcctgt

SEQ ID NO: 52093 - DNA, 20 bp, Neisseria gonorrhoeae
gacgacaggagccgccgcat

SEQ ID NO: 52094 - DNA, 20 bp, Neisseria gonorrhoeae
agcccgtagccgtcatagcc

SEQ ID NO: 52095 - DNA, 20 bp, Neisseria gonorrhoeae
ccatcgcgcgcggctatgac

SEQ ID NO: 52096 - DNA, 20 bp, Neisseria gonorrhoeae
catcgcgcgcggctatgacg

SEQ ID NO: 52097 - DNA, 20 bp, Neisseria gonorrhoeae
gcccgaacgtgcggtgttgt

SEQ ID NO: 52098 - DNA, 20 bp, Neisseria gonorrhoeae
cccgaacgtgcggtgttgtc

SEQ ID NO: 52099 - DNA, 20 bp, Neisseria gonorrhoeae
tcgatcgccaaaaccagcca

SEQ ID NO: 52100 - DNA, 20 bp, Neisseria gonorrhoeae
tggcgatcgacaacaccgca

SEQ ID NO: 52101 - DNA, 20 bp, Neisseria gonorrhoeae
ggcgatcgacaacaccgcac

SEQ ID NO: 52102 - DNA, 20 bp, Neisseria gonorrhoeae
tactggatacacactgccct

SEQ ID NO: 52103 - DNA, 20 bp, Neisseria gonorrhoeae
ccggcctgcccgacctctat

SEQ ID NO: 52104 - DNA, 20 bp, Neisseria gonorrhoeae
cggcctgcccgacctctatg

SEQ ID NO: 52105 - DNA, 20 bp, Neisseria gonorrhoeae
gacgatgacggcgacgattc

SEQ ID NO: 52106 - DNA, 20 bp, Neisseria gonorrhoeae
acgatgacggcgacgattcc

SEQ ID NO: 52107 - DNA, 20 bp, Neisseria gonorrhoeae
cgtacaccaaaacagtcatg

SEQ ID NO: 52108 - DNA, 20 bp, Neisseria gonorrhoeae
ccgccatcacgagcgagcgc

SEQ ID NO: 52109 - DNA, 20 bp, Neisseria gonorrhoeae
tggtgtacggaatcgtcgcc

SEQ ID NO: 52110 - DNA, 20 bp, Neisseria gonorrhoeae
aaggttgccatgcccaacaa

SEQ ID NO: 52111 - DNA, 20 bp, Neisseria gonorrhoeae
ccatgcccaacaagcccgaa

SEQ ID NO: 52112 - DNA, 20 bp, Neisseria gonorrhoeae
ggctggcggaaaaggaaatt

SEQ ID NO: 52113 - DNA, 20 bp, Neisseria gonorrhoeae
gctggcggaaaaggaaattg

SEQ ID NO: 52114 - DNA, 20 bp, Neisseria gonorrhoeae
tgacaatttccttttccgcc

SEQ ID NO: 52115 - DNA, 20 bp, Neisseria gonorrhoeae
cgggtgggcatcacgcagtc

SEQ ID NO: 52116 - DNA, 20 bp, Neisseria gonorrhoeae
cggcgtgcctacgcccatca

SEQ ID NO: 52117 - DNA, 20 bp, Neisseria gonorrhoeae
cctgatgggcgtaggcacgc

SEQ ID NO: 52118 - DNA, 20 bp, Neisseria gonorrhoeae
gactgcgtgatgcccacccg

SEQ ID NO: 52119 - DNA, 20 bp, Neisseria gonorrhoeae
aagagggcttttattacgac

SEQ ID NO: 52120 - DNA, 20 bp, Neisseria gonorrhoeae
tattacgacatcgccacgga

SEQ ID NO: 52121 - DNA, 20 bp, Neisseria gonorrhoeae
attacgacatcgccacggaa

SEQ ID NO: 52122 - DNA, 20 bp, Neisseria gonorrhoeae
ttacgacatcgccacggaaa

SEQ ID NO: 52123 - DNA, 20 bp, Neisseria gonorrhoeae
cgacatcgccacggaaaaac

SEQ ID NO: 52124 - DNA, 20 bp, Neisseria gonorrhoeae
cccaaaatggaaggccgtca

SEQ ID NO: 52125 - DNA, 20 bp, Neisseria gonorrhoeae
ccaaaatggaaggccgtcaa

SEQ ID NO: 52126 - DNA, 20 bp, Neisseria gonorrhoeae
cgccgaagaaaaaataaagc

SEQ ID NO: 52127 - DNA, 20 bp, Neisseria gonorrhoeae
tagctttattttttcttcgg

SEQ ID NO: 52128 - DNA, 20 bp, Neisseria gonorrhoeae
attttttcttcggcgcaatc

SEQ ID NO: 52129 - DNA, 20 bp, Neisseria gonorrhoeae
tggattgccaaaattgagcg

SEQ ID NO: 52130 - DNA, 20 bp, Neisseria gonorrhoeae
ggattgccaaaattgagcgc

SEQ ID NO: 52131 - DNA, 20 bp, Neisseria gonorrhoeae
gattgccaaaattgagcgca

SEQ ID NO: 52132 - DNA, 20 bp, Neisseria gonorrhoeae
ccaaaattgagcgcaatatc

SEQ ID NO: 52133 - DNA, 20 bp, Neisseria gonorrhoeae
agcgcaatatccaaagggat

SEQ ID NO: 52134 - DNA, 20 bp, Neisseria gonorrhoeae
ccgacgacttctggctgtac

SEQ ID NO: 52135 - DNA, 20 bp, Neisseria gonorrhoeae
tggctgtacgacaccccggg

SEQ ID NO: 52136 - DNA, 20 bp, Neisseria gonorrhoeae
tagccgctttcttcgacgat

SEQ ID NO: 52137 - DNA, 20 bp, Neisseria gonorrhoeae
cttcgacgatgattttcggc

SEQ ID NO: 52138 - DNA, 20 bp, Neisseria gonorrhoeae
ttcgacgatgattttcggcc

SEQ ID NO: 52139 - DNA, 20 bp, Neisseria gonorrhoeae
gtccgcgtatttgcctgagg

SEQ ID NO: 52140 - DNA, 20 bp, Neisseria gonorrhoeae
tccgcgtatttgcctgaggg

SEQ ID NO: 52141 - DNA, 20 bp, Neisseria gonorrhoeae
gcctgaggggtagggcggcg

SEQ ID NO: 52142 - DNA, 20 bp, Neisseria gonorrhoeae
cctgaggggtagggcggcga

SEQ ID NO: 52143 - DNA, 20 bp, Neisseria gonorrhoeae
gtttcgggcaggcaggggct

SEQ ID NO: 52144 - DNA, 20 bp, Neisseria gonorrhoeae
cctgatccaaacggtgcttc

SEQ ID NO: 52145 - DNA, 20 bp, Neisseria gonorrhoeae
agacggcattccgagtccga

SEQ ID NO: 52146 - DNA, 20 bp, Neisseria gonorrhoeae
cgagtccgaagcatcttgtg

SEQ ID NO: 52147 - DNA, 20 bp, Neisseria gonorrhoeae
tgcggtttgaaaatcgggaa

SEQ ID NO: 52148 - DNA, 20 bp, Neisseria gonorrhoeae
gaaaatcgggaatctgatta

SEQ ID NO: 52149 - DNA, 20 bp, Neisseria gonorrhoeae
tgcccaatgcatgggtggcg

SEQ ID NO: 52150 - DNA, 20 bp, Neisseria gonorrhoeae
tcgctgctcatcaggctaag

SEQ ID NO: 52151 - DNA, 20 bp, Neisseria gonorrhoeae
cgctgctcatcaggctaagg

SEQ ID NO: 52152 - DNA, 20 bp, Neisseria gonorrhoeae
gctgctcatcaggctaaggt

SEQ ID NO: 52153 - DNA, 20 bp, Neisseria gonorrhoeae
cacgtaaagaactgctgcac

SEQ ID NO: 52154 - DNA, 20 bp, Neisseria gonorrhoeae
agacggcatttttttcaaat

SEQ ID NO: 52155 - DNA, 20 bp, Neisseria gonorrhoeae
ttttcaaatcaacgttcttt

SEQ ID NO: 52156 - DNA, 20 bp, Neisseria gonorrhoeae
tttcaaatcaacgttcttta

SEQ ID NO: 52157 - DNA, 20 bp, Neisseria gonorrhoeae
ttcaaatcaacgttctttac

SEQ ID NO: 52158 - DNA, 20 bp, Neisseria gonorrhoeae
tcaaatcaacgttctttacg

SEQ ID NO: 52159 - DNA, 20 bp, Neisseria gonorrhoeae
cggggcgtgggcttcgacca

SEQ ID NO: 52160 - DNA, 20 bp, Neisseria gonorrhoeae
gaccagcttttggtggtcgg

SEQ ID NO: 52161 - DNA, 20 bp, Neisseria gonorrhoeae
tggtggtcgggtgttcggaa

SEQ ID NO: 52162 - DNA, 20 bp, Neisseria gonorrhoeae
ggtggtcgggtgttcggaaa

SEQ ID NO: 52163 - DNA, 20 bp, Neisseria gonorrhoeae
gtggtcgggtgttcggaaac

SEQ ID NO: 52164 - DNA, 20 bp, Neisseria gonorrhoeae
ttgcagatttggcataatgc

SEQ ID NO: 52165 - DNA, 20 bp, Neisseria gonorrhoeae
tgcagatttggcataatgct

SEQ ID NO: 52166 - DNA, 20 bp, Neisseria gonorrhoeae
gcagatttggcataatgctt

SEQ ID NO: 52167 - DNA, 20 bp, Neisseria gonorrhoeae
cagatttggcataatgcttt

SEQ ID NO: 52168 - DNA, 20 bp, Neisseria gonorrhoeae
ggcataatgctttaatcgga

SEQ ID NO: 52169 - DNA, 20 bp, Neisseria gonorrhoeae
gggcaggctgcaggcggcaa

SEQ ID NO: 52170 - DNA, 20 bp, Neisseria gonorrhoeae
ggcaggctgcaggcggcaag

SEQ ID NO: 52171 - DNA, 20 bp, Neisseria gonorrhoeae
atgtcggcggttgtgggcgt

SEQ ID NO: 52172 - DNA, 20 bp, Neisseria gonorrhoeae
tgggcgtggcgatgattgcc

SEQ ID NO: 52173 - DNA, 20 bp, Neisseria gonorrhoeae
ccggtgcggaattcggctac

SEQ ID NO: 52174 - DNA, 20 bp, Neisseria gonorrhoeae
atgacgcagtccggtgcgaa

SEQ ID NO: 52175 - DNA, 20 bp, Neisseria gonorrhoeae
acggataagccaagccgttg

SEQ ID NO: 52176 - DNA, 20 bp, Neisseria gonorrhoeae
caaccgccgcgttgaccttg

SEQ ID NO: 52177 - DNA, 20 bp, Neisseria gonorrhoeae
caacggcttggcttatccgt

SEQ ID NO: 52178 - DNA, 20 bp, Neisseria gonorrhoeae
gcttatccgtcaattcgcac

SEQ ID NO: 52179 - DNA, 20 bp, Neisseria gonorrhoeae
gcgtatctgcgcgacagggg

SEQ ID NO: 52180 - DNA, 20 bp, Neisseria gonorrhoeae
ccattcgggcgcgccgctgt

SEQ ID NO: 52181 - DNA, 20 bp, Neisseria gonorrhoeae
cattcgggcgcgccgctgtt

SEQ ID NO: 52182 - DNA, 20 bp, Neisseria gonorrhoeae
gggcgcgccgctgtttcagg

SEQ ID NO: 52183 - DNA, 20 bp, Neisseria gonorrhoeae
ctcctgaaacagcggcgcgc

SEQ ID NO: 52184 - DNA, 20 bp, Neisseria gonorrhoeae
tattgtgctgctatttttgc

SEQ ID NO: 52185 - DNA, 20 bp, Neisseria gonorrhoeae
attgtgctgctatttttgcc

SEQ ID NO: 52186 - DNA, 20 bp, Neisseria gonorrhoeae
ttgtgctgctatttttgcca

SEQ ID NO: 52187 - DNA, 20 bp, Neisseria gonorrhoeae
tgctgctatttttgccaatg

SEQ ID NO: 52188 - DNA, 20 bp, Neisseria gonorrhoeae
ttgccaatgcctaccgtttt

SEQ ID NO: 52189 - DNA, 20 bp, Neisseria gonorrhoeae
tgcgcctgccggtttggaac

SEQ ID NO: 52190 - DNA, 20 bp, Neisseria gonorrhoeae
gcgcctgccggtttggaaca

SEQ ID NO: 52191 - DNA, 20 bp, Neisseria gonorrhoeae
cgcctgccggtttggaacag

SEQ ID NO: 52192 - DNA, 20 bp, Neisseria gonorrhoeae
ggaacagtctgcccgaaggt

SEQ ID NO: 52193 - DNA, 20 bp, Neisseria gonorrhoeae
gaacagtctgcccgaaggtg

SEQ ID NO: 52194 - DNA, 20 bp, Neisseria gonorrhoeae
cgaaccggcaaacgaaaaca

SEQ ID NO: 52195 - DNA, 20 bp, Neisseria gonorrhoeae
cgaaccggctgccgcatcgg

SEQ ID NO: 52196 - DNA, 20 bp, Neisseria gonorrhoeae
acatccgatgcggcagccgg

SEQ ID NO: 52197 - DNA, 20 bp, Neisseria gonorrhoeae
ggaagctgtgttttcgtttg

SEQ ID NO: 52198 - DNA, 20 bp, Neisseria gonorrhoeae
tcgtttgccggttcggaagc

SEQ ID NO: 52199 - DNA, 20 bp, Neisseria gonorrhoeae
aaccggcgcgattacgaagc

SEQ ID NO: 52200 - DNA, 20 bp, Neisseria gonorrhoeae
cgaagcggcggaagccaatc

SEQ ID NO: 52201 - DNA, 20 bp, Neisseria gonorrhoeae
atgcggcggcgaagatgaat

SEQ ID NO: 52202 - DNA, 20 bp, Neisseria gonorrhoeae
cgcgcctcgtgcgtctgcaa

SEQ ID NO: 52203 - DNA, 20 bp, Neisseria gonorrhoeae
cagacgcacgaggcgcgtaa

SEQ ID NO: 52204 - DNA, 20 bp, Neisseria gonorrhoeae
ggggtaaggcaaaaggctac

SEQ ID NO: 52205 - DNA, 20 bp, Neisseria gonorrhoeae
gggtaaggcaaaaggctacc

SEQ ID NO: 52206 - DNA, 20 bp, Neisseria gonorrhoeae
aagcgagtattgcactgaag

SEQ ID NO: 52207 - DNA, 20 bp, Neisseria gonorrhoeae
cactgaagccgagtattccg

SEQ ID NO: 52208 - DNA, 20 bp, Neisseria gonorrhoeae
cggcgcgtttggtgttggca

SEQ ID NO: 52209 - DNA, 20 bp, Neisseria gonorrhoeae
aacctcggacacggcatcaa

SEQ ID NO: 52210 - DNA, 20 bp, Neisseria gonorrhoeae
gtcgacaccgtgcacgagct

SEQ ID NO: 52211 - DNA, 20 bp, Neisseria gonorrhoeae
tggcgtgttcggggtcggcg

SEQ ID NO: 52212 - DNA, 20 bp, Neisseria gonorrhoeae
ggcgtgttcggggtcggcgt

SEQ ID NO: 52213 - DNA, 20 bp, Neisseria gonorrhoeae
gcgtgttcggggtcggcgtg

SEQ ID NO: 52214 - DNA, 20 bp, Neisseria gonorrhoeae
tacgatgacatcgccgatat

SEQ ID NO: 52215 - DNA, 20 bp, Neisseria gonorrhoeae
ttacggaaactttcgcaagc

SEQ ID NO: 52216 - DNA, 20 bp, Neisseria gonorrhoeae
tacggaaactttcgcaagcc

SEQ ID NO: 52217 - DNA, 20 bp, Neisseria gonorrhoeae
acggaaactttcgcaagccc

SEQ ID NO: 52218 - DNA, 20 bp, Neisseria gonorrhoeae
cggaaactttcgcaagccca

SEQ ID NO: 52219 - DNA, 20 bp, Neisseria gonorrhoeae
caatcttgggcggcggacgc

SEQ ID NO: 52220 - DNA, 20 bp, Neisseria gonorrhoeae
ggcggcggacgcttcgaccg

SEQ ID NO: 52221 - DNA, 20 bp, Neisseria gonorrhoeae
gaccgtccaatccctctccg

SEQ ID NO: 52222 - DNA, 20 bp, Neisseria gonorrhoeae
ccgctgccgaagtgccgcgc

SEQ ID NO: 52223 - DNA, 20 bp, Neisseria gonorrhoeae
ggcagcggtaacggcggaga

SEQ ID NO: 52224 - DNA, 20 bp, Neisseria gonorrhoeae
tccgcgcagtttgaagtagc

SEQ ID NO: 52225 - DNA, 20 bp, Neisseria gonorrhoeae
gaagtagcgcgcggcggcaa

SEQ ID NO: 52226 - DNA, 20 bp, Neisseria gonorrhoeae
aagtagcgcgcggcggcaac

SEQ ID NO: 52227 - DNA, 20 bp, Neisseria gonorrhoeae
ccttcaggcactgatttacg

SEQ ID NO: 52228 - DNA, 20 bp, Neisseria gonorrhoeae
aggcactgatttacgccgtt

SEQ ID NO: 52229 - DNA, 20 bp, Neisseria gonorrhoeae
cgtttgagcatcgttatgcc

SEQ ID NO: 52230 - DNA, 20 bp, Neisseria gonorrhoeae
gagcatcgttatgccgtctt

SEQ ID NO: 52231 - DNA, 20 bp, Neisseria gonorrhoeae
agcatcgttatgccgtcttt

SEQ ID NO: 52232 - DNA, 20 bp, Neisseria gonorrhoeae
tgccgtctttttcacacgca

SEQ ID NO: 52233 - DNA, 20 bp, Neisseria gonorrhoeae
ttcacacgcataggtacggc

SEQ ID NO: 52234 - DNA, 20 bp, Neisseria gonorrhoeae
gcggattgtttcatcgcctt

SEQ ID NO: 52235 - DNA, 20 bp, Neisseria gonorrhoeae
tttcatcgccttgcgggttt

SEQ ID NO: 52236 - DNA, 20 bp, Neisseria gonorrhoeae
catcgccttgcgggttttcc

SEQ ID NO: 52237 - DNA, 20 bp, Neisseria gonorrhoeae
atcgccttgcgggttttccg

SEQ ID NO: 52238 - DNA, 20 bp, Neisseria gonorrhoeae
cgggttttccgtgccgtcga

SEQ ID NO: 52239 - DNA, 20 bp, Neisseria gonorrhoeae
gttgacggctgcgaagtaga

SEQ ID NO: 52240 - DNA, 20 bp, Neisseria gonorrhoeae
acggctgcgaagtagagcat

SEQ ID NO: 52241 - DNA, 20 bp, Neisseria gonorrhoeae
agtacgccgataccgctgtc

SEQ ID NO: 52242 - DNA, 20 bp, Neisseria gonorrhoeae
ccactcctatgctctacttc

SEQ ID NO: 52243 - DNA, 20 bp, Neisseria gonorrhoeae
gcagccgtcaacgaatgcgg

SEQ ID NO: 52244 - DNA, 20 bp, Neisseria gonorrhoeae
ttcgggcagccccatctgca

SEQ ID NO: 52245 - DNA, 20 bp, Neisseria gonorrhoeae
gggcagccccatctgcatag

SEQ ID NO: 52246 - DNA, 20 bp, Neisseria gonorrhoeae
tctccggcatcgctatgcag

SEQ ID NO: 52247 - DNA, 20 bp, Neisseria gonorrhoeae
ctccggcatcgctatgcaga

SEQ ID NO: 52248 - DNA, 20 bp, Neisseria gonorrhoeae
tccggcatcgctatgcagat

SEQ ID NO: 52249 - DNA, 20 bp, Neisseria gonorrhoeae
gaaatgccgaaggcggtttt

SEQ ID NO: 52250 - DNA, 20 bp, Neisseria gonorrhoeae
tgattttggagccgaatatc

SEQ ID NO: 52251 - DNA, 20 bp, Neisseria gonorrhoeae
gattttggagccgaatatcc

SEQ ID NO: 52252 - DNA, 20 bp, Neisseria gonorrhoeae
attttggagccgaatatcca

SEQ ID NO: 52253 - DNA, 20 bp, Neisseria gonorrhoeae
tggagccgaatatccacgcg

SEQ ID NO: 52254 - DNA, 20 bp, Neisseria gonorrhoeae
ctcgcctgacgatgacggtt

SEQ ID NO: 52255 - DNA, 20 bp, Neisseria gonorrhoeae
atctgcccgccgagcagaaa

SEQ ID NO: 52256 - DNA, 20 bp, Neisseria gonorrhoeae
tctgcccgccgagcagaaag

SEQ ID NO: 52257 - DNA, 20 bp, Neisseria gonorrhoeae
ctgctcggcgggcagataaa

SEQ ID NO: 52258 - DNA, 20 bp, Neisseria gonorrhoeae
tgctcggcgggcagataaac

SEQ ID NO: 52259 - DNA, 20 bp, Neisseria gonorrhoeae
gtccgatgcgcgggaacgca

SEQ ID NO: 52260 - DNA, 20 bp, Neisseria gonorrhoeae
ccgcgcatcggacgaattgg

SEQ ID NO: 52261 - DNA, 20 bp, Neisseria gonorrhoeae
gcacggattttcggcacgca

SEQ ID NO: 52262 - DNA, 20 bp, Neisseria gonorrhoeae
tcggcacgcaggcaggcatc

SEQ ID NO: 52263 - DNA, 20 bp, Neisseria gonorrhoeae
cggcacgcaggcaggcatcg

SEQ ID NO: 52264 - DNA, 20 bp, Neisseria gonorrhoeae
ggaacgccgttgtcgagcag

SEQ ID NO: 52265 - DNA, 20 bp, Neisseria gonorrhoeae
tcgagcaggtgttgttcggc

SEQ ID NO: 52266 - DNA, 20 bp, Neisseria gonorrhoeae
ttcggcggcaaggatttgtc

SEQ ID NO: 52267 - DNA, 20 bp, Neisseria gonorrhoeae
ggcggcaaggatttgtcggg

SEQ ID NO: 52268 - DNA, 20 bp, Neisseria gonorrhoeae
gtcgggcggactcggtttgc

SEQ ID NO: 52269 - DNA, 20 bp, Neisseria gonorrhoeae
atgtcgtccgaagtcaggct

SEQ ID NO: 52270 - DNA, 20 bp, Neisseria gonorrhoeae
tatggcggcgacgcggctgc

SEQ ID NO: 52271 - DNA, 20 bp, Neisseria gonorrhoeae
atggcggcgacgcggctgcc

SEQ ID NO: 52272 - DNA, 20 bp, Neisseria gonorrhoeae
tggcggcgacgcggctgccg

SEQ ID NO: 52273 - DNA, 20 bp, Neisseria gonorrhoeae
tgtgccagcggcaggccgag

SEQ ID NO: 52274 - DNA, 20 bp, Neisseria gonorrhoeae
gaccgaaccgtcgggctgcg

SEQ ID NO: 52275 - DNA, 20 bp, Neisseria gonorrhoeae
accgaaccgtcgggctgcgg

SEQ ID NO: 52276 - DNA, 20 bp, Neisseria gonorrhoeae
cagcggcatcccgatatgcc

SEQ ID NO: 52277 - DNA, 20 bp, Neisseria gonorrhoeae
ggtcaaactcgccgccggct

SEQ ID NO: 52278 - DNA, 20 bp, Neisseria gonorrhoeae
gtcggcgtgtttaagcgcga

SEQ ID NO: 52279 - DNA, 20 bp, Neisseria gonorrhoeae
aagcgcgataaaggcccggg

SEQ ID NO: 52280 - DNA, 20 bp, Neisseria gonorrhoeae
agcgcgataaaggcccgggc

SEQ ID NO: 52281 - DNA, 20 bp, Neisseria gonorrhoeae
atcgcgcttaaacacgccga

SEQ ID NO: 52282 - DNA, 20 bp, Neisseria gonorrhoeae
tcgcgcttaaacacgccgac

SEQ ID NO: 52283 - DNA, 20 bp, Neisseria gonorrhoeae
agtttcgacttacgcagctt

SEQ ID NO: 52284 - DNA, 20 bp, Neisseria gonorrhoeae
cgacttacgcagctttatcg

SEQ ID NO: 52285 - DNA, 20 bp, Neisseria gonorrhoeae
gacttacgcagctttatcgg

SEQ ID NO: 52286 - DNA, 20 bp, Neisseria gonorrhoeae
cgcagctttatcgggcgttt

SEQ ID NO: 52287 - DNA, 20 bp, Neisseria gonorrhoeae
atcgggcgtttgcccgccgt

SEQ ID NO: 52288 - DNA, 20 bp, Neisseria gonorrhoeae
gattgcttcatcggttcggg

SEQ ID NO: 52289 - DNA, 20 bp, Neisseria gonorrhoeae
cttcatcggttcgggcgttg

SEQ ID NO: 52290 - DNA, 20 bp, Neisseria gonorrhoeae
atcggttcgggcgttgtcgt

SEQ ID NO: 52291 - DNA, 20 bp, Neisseria gonorrhoeae
gggcgttgtcgtttcccccg

SEQ ID NO: 52292 - DNA, 20 bp, Neisseria gonorrhoeae
tcgtttcccccgaagccctg

SEQ ID NO: 52293 - DNA, 20 bp, Neisseria gonorrhoeae
gtcttcgtaggcagggccga

SEQ ID NO: 52294 - DNA, 20 bp, Neisseria gonorrhoeae
tcttcgtaggcagggccgat

SEQ ID NO: 52295 - DNA, 20 bp, Neisseria gonorrhoeae
gtaggcagggccgatgccgc

SEQ ID NO: 52296 - DNA, 20 bp, Neisseria gonorrhoeae
tgcctttgccgcgcgatgct

SEQ ID NO: 52297 - DNA, 20 bp, Neisseria gonorrhoeae
gcctttgccgcgcgatgctt

SEQ ID NO: 52298 - DNA, 20 bp, Neisseria gonorrhoeae
ccgacgtgcgccatttcgtg

SEQ ID NO: 52299 - DNA, 20 bp, Neisseria gonorrhoeae
cgtgcgccaacacggcttcc

SEQ ID NO: 52300 - DNA, 20 bp, Neisseria gonorrhoeae
gtgcgccaacacggcttcca

SEQ ID NO: 52301 - DNA, 20 bp, Neisseria gonorrhoeae
cacttcgtcgcgcgtcatat

SEQ ID NO: 52302 - DNA, 20 bp, Neisseria gonorrhoeae
gtcgcgcgtcatatggtcga

SEQ ID NO: 52303 - DNA, 20 bp, Neisseria gonorrhoeae
tgacacccgccgaagccttg

SEQ ID NO: 52304 - DNA, 20 bp, Neisseria gonorrhoeae
gcggcgggttcgacttatct

SEQ ID NO: 52305 - DNA, 20 bp, Neisseria gonorrhoeae
gacttatctggtgatgggcc

SEQ ID NO: 52306 - DNA, 20 bp, Neisseria gonorrhoeae
tctggtgatgggccgccccg

SEQ ID NO: 52307 - DNA, 20 bp, Neisseria gonorrhoeae
cccgagccgccgatccggtc

SEQ ID NO: 52308 - DNA, 20 bp, Neisseria gonorrhoeae
acggcaaaggcgaaatcttc

SEQ ID NO: 52309 - DNA, 20 bp, Neisseria gonorrhoeae
cggcaaaggcgaaatcttcc

SEQ ID NO: 52310 - DNA, 20 bp, Neisseria gonorrhoeae
cgcgaagagcgcgaactcga

SEQ ID NO: 52311 - DNA, 20 bp, Neisseria gonorrhoeae
atgtgtacggctactccaaa

SEQ ID NO: 52312 - DNA, 20 bp, Neisseria gonorrhoeae
ggagtagccgtacacattaa

SEQ ID NO: 52313 - DNA, 20 bp, Neisseria gonorrhoeae
ggcggcggcttcgagtgcgc

SEQ ID NO: 52314 - DNA, 20 bp, Neisseria gonorrhoeae
gagtgcgccttgcgtgtagc

SEQ ID NO: 52315 - DNA, 20 bp, Neisseria gonorrhoeae
cgtgtagcggacttggtgga

SEQ ID NO: 52316 - DNA, 20 bp, Neisseria gonorrhoeae
gtggaaggcttcgaacatcg

SEQ ID NO: 52317 - DNA, 20 bp, Neisseria gonorrhoeae
gaacatcggtttcaagccgc

SEQ ID NO: 52318 - DNA, 20 bp, Neisseria gonorrhoeae
ggtatgcaccatcgcccgct

SEQ ID NO: 52319 - DNA, 20 bp, Neisseria gonorrhoeae
gaagccgagcgtgggccggg

SEQ ID NO: 52320 - DNA, 20 bp, Neisseria gonorrhoeae
cgaccgtgtctaaaaggtgg

SEQ ID NO: 52321 - DNA, 20 bp, Neisseria gonorrhoeae
gaccgtgtctaaaaggtggt

SEQ ID NO: 52322 - DNA, 20 bp, Neisseria gonorrhoeae
ccgaccaccttttagacacg

SEQ ID NO: 52323 - DNA, 20 bp, Neisseria gonorrhoeae
acaaagaccaaatccgcgcc

SEQ ID NO: 52324 - DNA, 20 bp, Neisseria gonorrhoeae
ggtgtggttgccgaagacaa

SEQ ID NO: 52325 - DNA, 20 bp, Neisseria gonorrhoeae
ccgaagacaatgcccaattg

SEQ ID NO: 52326 - DNA, 20 bp, Neisseria gonorrhoeae
gaaaagggcagcctggtgat

SEQ ID NO: 52327 - DNA, 20 bp, Neisseria gonorrhoeae
cccgcccatcatcaccaggc

SEQ ID NO: 52328 - DNA, 20 bp, Neisseria gonorrhoeae
gaaacggatgcgttcgggca

SEQ ID NO: 52329 - DNA, 20 bp, Neisseria gonorrhoeae
aaacggatgcgttcgggcaa

SEQ ID NO: 52330 - DNA, 20 bp, Neisseria gonorrhoeae
gggcaaaatgcgccccggca

SEQ ID NO: 52331 - DNA, 20 bp, Neisseria gonorrhoeae
tttgaagtggcgcggcgcga

SEQ ID NO: 52332 - DNA, 20 bp, Neisseria gonorrhoeae
gaagtggcgcggcgcgattg

SEQ ID NO: 52333 - DNA, 20 bp, Neisseria gonorrhoeae
ttgccagccgcctcaaagac

SEQ ID NO: 52334 - DNA, 20 bp, Neisseria gonorrhoeae
ccagccgcctcaaagaccgt

SEQ ID NO: 52335 - DNA, 20 bp, Neisseria gonorrhoeae
ttaccgtccgaccatcgtgt

SEQ ID NO: 52336 - DNA, 20 bp, Neisseria gonorrhoeae
taccgtccgaccatcgtgtt

SEQ ID NO: 52337 - DNA, 20 bp, Neisseria gonorrhoeae
accgtccgaccatcgtgttt

SEQ ID NO: 52338 - DNA, 20 bp, Neisseria gonorrhoeae
gggggcagggctttgcgccg

SEQ ID NO: 52339 - DNA, 20 bp, Neisseria gonorrhoeae
ggggcagggctttgcgccgc

SEQ ID NO: 52340 - DNA, 20 bp, Neisseria gonorrhoeae
gcgccgccgagctttaccga

SEQ ID NO: 52341 - DNA, 20 bp, Neisseria gonorrhoeae
cgccgccgagctttaccgac

SEQ ID NO: 52342 - DNA, 20 bp, Neisseria gonorrhoeae
accgacgagttccacgtcgt

SEQ ID NO: 52343 - DNA, 20 bp, Neisseria gonorrhoeae
cggggcttcgggatgttggg

SEQ ID NO: 52344 - DNA, 20 bp, Neisseria gonorrhoeae
gggatgttgggcgcgggcat

SEQ ID NO: 52345 - DNA, 20 bp, Neisseria gonorrhoeae
ggcgcgggcatagtcgatga

SEQ ID NO: 52346 - DNA, 20 bp, Neisseria gonorrhoeae
gccttatccggcttttcctt

SEQ ID NO: 52347 - DNA, 20 bp, Neisseria gonorrhoeae
ccttatccggcttttccttc

SEQ ID NO: 52348 - DNA, 20 bp, Neisseria gonorrhoeae
atgtccacggcggtttggcg

SEQ ID NO: 52349 - DNA, 20 bp, Neisseria gonorrhoeae
ggcgcgtgtcgggcaggtag

SEQ ID NO: 52350 - DNA, 20 bp, Neisseria gonorrhoeae
gcgcgtgtcgggcaggtagg

SEQ ID NO: 52351 - DNA, 20 bp, Neisseria gonorrhoeae
ggcggcggttcgtttgcacg

SEQ ID NO: 52352 - DNA, 20 bp, Neisseria gonorrhoeae
gtttgcacgctggacagaca

SEQ ID NO: 52353 - DNA, 20 bp, Neisseria gonorrhoeae
ctgcaaatgcgcggaattcc

SEQ ID NO: 52354 - DNA, 20 bp, Neisseria gonorrhoeae
tgcaaatgcgcggaattccg

SEQ ID NO: 52355 - DNA, 20 bp, Neisseria gonorrhoeae
cggtctgtgcccacatcggt

SEQ ID NO: 52356 - DNA, 20 bp, Neisseria gonorrhoeae
gccttcggcggatataaagt

SEQ ID NO: 52357 - DNA, 20 bp, Neisseria gonorrhoeae
atatccgccgaaggcaaaca

SEQ ID NO: 52358 - DNA, 20 bp, Neisseria gonorrhoeae
acgctgttgggcggtgaaac

SEQ ID NO: 52359 - DNA, 20 bp, Neisseria gonorrhoeae
cgctgttgggcggtgaaacg

SEQ ID NO: 52360 - DNA, 20 bp, Neisseria gonorrhoeae
ggcggtgaaacggctttgca

SEQ ID NO: 52361 - DNA, 20 bp, Neisseria gonorrhoeae
gcagaaagggcaggcgggaa

SEQ ID NO: 52362 - DNA, 20 bp, Neisseria gonorrhoeae
cagaaagggcaggcgggaac

SEQ ID NO: 52363 - DNA, 20 bp, Neisseria gonorrhoeae
aaaaaagtgtccgcgccgga

SEQ ID NO: 52364 - DNA, 20 bp, Neisseria gonorrhoeae
gacaaaggcgtgctggcggc

SEQ ID NO: 52365 - DNA, 20 bp, Neisseria gonorrhoeae
ggcagccgccgcagccgcca

SEQ ID NO: 52366 - DNA, 20 bp, Neisseria gonorrhoeae
gtcgaacaggtattccggcg

SEQ ID NO: 52367 - DNA, 20 bp, Neisseria gonorrhoeae
tcgaacaggtattccggcgc

SEQ ID NO: 52368 - DNA, 20 bp, Neisseria gonorrhoeae
taaattgtgtgagtgtttca

SEQ ID NO: 52369 - DNA, 20 bp, Neisseria gonorrhoeae
tgtgagtgtttcagcctgcc

SEQ ID NO: 52370 - DNA, 20 bp, Neisseria gonorrhoeae
cagcctgccgattatacgct

SEQ ID NO: 52371 - DNA, 20 bp, Neisseria gonorrhoeae
agcctgccgattatacgctt

SEQ ID NO: 52372 - DNA, 20 bp, Neisseria gonorrhoeae
tacgcttagggtgtctgatc

SEQ ID NO: 52373 - DNA, 20 bp, Neisseria gonorrhoeae
tttgcgcactttggcatcca

SEQ ID NO: 52374 - DNA, 20 bp, Neisseria gonorrhoeae
gcgcactttggcatccagcg

SEQ ID NO: 52375 - DNA, 20 bp, Neisseria gonorrhoeae
cgcactttggcatccagcgc

SEQ ID NO: 52376 - DNA, 20 bp, Neisseria gonorrhoeae
ggcatccagcgcgccgaagg

SEQ ID NO: 52377 - DNA, 20 bp, Neisseria gonorrhoeae
gcatccagcgcgccgaaggg

SEQ ID NO: 52378 - DNA, 20 bp, Neisseria gonorrhoeae
ccggcagcagcacgcggcgg

SEQ ID NO: 52379 - DNA, 20 bp, Neisseria gonorrhoeae
cggcagcagcacgcggcgga

SEQ ID NO: 52380 - DNA, 20 bp, Neisseria gonorrhoeae
tgaaacggtttgcgcccaaa

SEQ ID NO: 52381 - DNA, 20 bp, Neisseria gonorrhoeae
gcgcccaaagtcgccgccgc

SEQ ID NO: 52382 - DNA, 20 bp, Neisseria gonorrhoeae
cgcccaaagtcgccgccgct

SEQ ID NO: 52383 - DNA, 20 bp, Neisseria gonorrhoeae
ccacacgtcgcaagtcaaga

SEQ ID NO: 52384 - DNA, 20 bp, Neisseria gonorrhoeae
tcagtggtcagcggagttgc

SEQ ID NO: 52385 - DNA, 20 bp, Neisseria gonorrhoeae
cagtggtcagcggagttgcc

SEQ ID NO: 52386 - DNA, 20 bp, Neisseria gonorrhoeae
agtggtcagcggagttgccg

SEQ ID NO: 52387 - DNA, 20 bp, Neisseria gonorrhoeae
ccgcgttggaagtggaaacc

SEQ ID NO: 52388 - DNA, 20 bp, Neisseria gonorrhoeae
gctttcggcgacaaaaacga

SEQ ID NO: 52389 - DNA, 20 bp, Neisseria gonorrhoeae
cggcgacaaaaacgacaata

SEQ ID NO: 52390 - DNA, 20 bp, Neisseria gonorrhoeae
ggcgacaaaaacgacaataa

SEQ ID NO: 52391 - DNA, 20 bp, Neisseria gonorrhoeae
tgcggatgtttttctccgta

SEQ ID NO: 52392 - DNA, 20 bp, Neisseria gonorrhoeae
ttctccgtaacgtggtattg

SEQ ID NO: 52393 - DNA, 20 bp, Neisseria gonorrhoeae
tctttttgcgcttttgaccg

SEQ ID NO: 52394 - DNA, 20 bp, Neisseria gonorrhoeae
ctttttgcgcttttgaccgg

SEQ ID NO: 52395 - DNA, 20 bp, Neisseria gonorrhoeae
tttttgcgcttttgaccggg

SEQ ID NO: 52396 - DNA, 20 bp, Neisseria gonorrhoeae
ttgcgcttttgaccgggcgg

SEQ ID NO: 52397 - DNA, 20 bp, Neisseria gonorrhoeae
tgcgcttttgaccgggcgga

SEQ ID NO: 52398 - DNA, 20 bp, Neisseria gonorrhoeae
tccggatgtttcggggtgta

SEQ ID NO: 52399 - DNA, 20 bp, Neisseria gonorrhoeae
cggggtgtagctcttcatct

SEQ ID NO: 52400 - DNA, 20 bp, Neisseria gonorrhoeae
ggggtgtagctcttcatctt

SEQ ID NO: 52401 - DNA, 20 bp, Neisseria gonorrhoeae
atcttgttgctgatggcgga

SEQ ID NO: 52402 - DNA, 20 bp, Neisseria gonorrhoeae
ttgctgatggcggaaatgtt

SEQ ID NO: 52403 - DNA, 20 bp, Neisseria gonorrhoeae
tttaccctccggcacttccg

SEQ ID NO: 52404 - DNA, 20 bp, Neisseria gonorrhoeae
accctccggcacttccgcat

SEQ ID NO: 52405 - DNA, 20 bp, Neisseria gonorrhoeae
ccctccggcacttccgcatc

SEQ ID NO: 52406 - DNA, 20 bp, Neisseria gonorrhoeae
cgcatcgccgtgcacccgcc

SEQ ID NO: 52407 - DNA, 20 bp, Neisseria gonorrhoeae
ttcttccgcattcaggtgcc

SEQ ID NO: 52408 - DNA, 20 bp, Neisseria gonorrhoeae
tctgcggctaaaatctacaa

SEQ ID NO: 52409 - DNA, 20 bp, Neisseria gonorrhoeae
ctatgcccgctatgaatttg

SEQ ID NO: 52410 - DNA, 20 bp, Neisseria gonorrhoeae
atagcgggcataggaatgcc

SEQ ID NO: 52411 - DNA, 20 bp, Neisseria gonorrhoeae
ttgtagattttagccgcaga

SEQ ID NO: 52412 - DNA, 20 bp, Neisseria gonorrhoeae
tgtagattttagccgcagat

SEQ ID NO: 52413 - DNA, 20 bp, Neisseria gonorrhoeae
caaaccgctggtgcgagatg

SEQ ID NO: 52414 - DNA, 20 bp, Neisseria gonorrhoeae
ccgtttggcgccgccgttcc

SEQ ID NO: 52415 - DNA, 20 bp, Neisseria gonorrhoeae
ggcgccgccgttcccagcat

SEQ ID NO: 52416 - DNA, 20 bp, Neisseria gonorrhoeae
gcgccgccgttcccagcatc

SEQ ID NO: 52417 - DNA, 20 bp, Neisseria gonorrhoeae
ccagcatctcgcaccagcgg

SEQ ID NO: 52418 - DNA, 20 bp, Neisseria gonorrhoeae
gcggcagtcggcaaagacgc

SEQ ID NO: 52419 - DNA, 20 bp, Neisseria gonorrhoeae
ggccagaccgttgaggattt

SEQ ID NO: 52420 - DNA, 20 bp, Neisseria gonorrhoeae
gtttcacgctttaccgcgtc

SEQ ID NO: 52421 - DNA, 20 bp, Neisseria gonorrhoeae
cacgctttaccgcgtctttg

SEQ ID NO: 52422 - DNA, 20 bp, Neisseria gonorrhoeae
acgctttaccgcgtctttgc

SEQ ID NO: 52423 - DNA, 20 bp, Neisseria gonorrhoeae
tcctgccttaccccgtatcg

SEQ ID NO: 52424 - DNA, 20 bp, Neisseria gonorrhoeae
ccccgtatcggcaaaccgtt

SEQ ID NO: 52425 - DNA, 20 bp, Neisseria gonorrhoeae
ttggcggatttggcgcaaca

SEQ ID NO: 52426 - DNA, 20 bp, Neisseria gonorrhoeae
gcggatttggcgcaacaggg

SEQ ID NO: 52427 - DNA, 20 bp, Neisseria gonorrhoeae
ggcgcaacagggcggtcagg

SEQ ID NO: 52428 - DNA, 20 bp, Neisseria gonorrhoeae
ccaaagccaacaaagacggc

SEQ ID NO: 52429 - DNA, 20 bp, Neisseria gonorrhoeae
ggacaacgccctgaaggttg

SEQ ID NO: 52430 - DNA, 20 bp, Neisseria gonorrhoeae
gacaacgccctgaaggttgc

SEQ ID NO: 52431 - DNA, 20 bp, Neisseria gonorrhoeae
cgctggacgcgcttcaaggc

SEQ ID NO: 52432 - DNA, 20 bp, Neisseria gonorrhoeae
aagcgcgtccagcgcaacct

SEQ ID NO: 52433 - DNA, 20 bp, Neisseria gonorrhoeae
cgttcggcatcggtgcgaag

SEQ ID NO: 52434 - DNA, 20 bp, Neisseria gonorrhoeae
gttcggcatcggtgcgaagt

SEQ ID NO: 52435 - DNA, 20 bp, Neisseria gonorrhoeae
ggcatcggtgcgaagtcgca

SEQ ID NO: 52436 - DNA, 20 bp, Neisseria gonorrhoeae
gcaggctgaaatcaggcggc

SEQ ID NO: 52437 - DNA, 20 bp, Neisseria gonorrhoeae
caggctgaaatcaggcggcg

SEQ ID NO: 52438 - DNA, 20 bp, Neisseria gonorrhoeae
cccgcgccgcaacccgccct

SEQ ID NO: 52439 - DNA, 20 bp, Neisseria gonorrhoeae
ggatggcccgcgcgccgtag

SEQ ID NO: 52440 - DNA, 20 bp, Neisseria gonorrhoeae
gatggcccgcgcgccgtagc

SEQ ID NO: 52441 - DNA, 20 bp, Neisseria gonorrhoeae
ccgcttatgggcagggcggg

SEQ ID NO: 52442 - DNA, 20 bp, Neisseria gonorrhoeae
tgggcagggcgggttgcggc

SEQ ID NO: 52443 - DNA, 20 bp, Neisseria gonorrhoeae
ctccaaaggaagttagaatg

SEQ ID NO: 52444 - DNA, 20 bp, Neisseria gonorrhoeae
tccaaaggaagttagaatga

SEQ ID NO: 52445 - DNA, 20 bp, Neisseria gonorrhoeae
gaatgaaatggcactagggc

SEQ ID NO: 52446 - DNA, 20 bp, Neisseria gonorrhoeae
gacgatgttgaaacatcagt

SEQ ID NO: 52447 - DNA, 20 bp, Neisseria gonorrhoeae
aaacatcagtaattcgcagt

SEQ ID NO: 52448 - DNA, 20 bp, Neisseria gonorrhoeae
ggcggctgcatcatcattga

SEQ ID NO: 52449 - DNA, 20 bp, Neisseria gonorrhoeae
acgacccgcacaaagcagat

SEQ ID NO: 52450 - DNA, 20 bp, Neisseria gonorrhoeae
tgaaaccagtcgatgacgtt

SEQ ID NO: 52451 - DNA, 20 bp, Neisseria gonorrhoeae
gaaaccagtcgatgacgttc

SEQ ID NO: 52452 - DNA, 20 bp, Neisseria gonorrhoeae
aaaccagtcgatgacgttct

SEQ ID NO: 52453 - DNA, 20 bp, Neisseria gonorrhoeae
caaacggcttggattttggc

SEQ ID NO: 52454 - DNA, 20 bp, Neisseria gonorrhoeae
gattttggcgattggtcggg

SEQ ID NO: 52455 - DNA, 20 bp, Neisseria gonorrhoeae
tggcgattggtcgggattgt

SEQ ID NO: 52456 - DNA, 20 bp, Neisseria gonorrhoeae
ggcgattggtcgggattgtc

SEQ ID NO: 52457 - DNA, 20 bp, Neisseria gonorrhoeae
gcgattggtcgggattgtcc

SEQ ID NO: 52458 - DNA, 20 bp, Neisseria gonorrhoeae
cggcaacgcacgcgcccgaa

SEQ ID NO: 52459 - DNA, 20 bp, Neisseria gonorrhoeae
ggcaacgcacgcgcccgaac

SEQ ID NO: 52460 - DNA, 20 bp, Neisseria gonorrhoeae
cccgaacggaaacggcgatg

SEQ ID NO: 52461 - DNA, 20 bp, Neisseria gonorrhoeae
cttcccagcctatcaggttg

SEQ ID NO: 52462 - DNA, 20 bp, Neisseria gonorrhoeae
ccagcctatcaggttgccca

SEQ ID NO: 52463 - DNA, 20 bp, Neisseria gonorrhoeae
aaatcaacgtggaagacgac

SEQ ID NO: 52464 - DNA, 20 bp, Neisseria gonorrhoeae
ttcggggcgcatatcgttga

SEQ ID NO: 52465 - DNA, 20 bp, Neisseria gonorrhoeae
tcggggcgcatatcgttgac

SEQ ID NO: 52466 - DNA, 20 bp, Neisseria gonorrhoeae
cggggcgcatatcgttgacc

SEQ ID NO: 52467 - DNA, 20 bp, Neisseria gonorrhoeae
ggggcgcatatcgttgaccc

SEQ ID NO: 52468 - DNA, 20 bp, Neisseria gonorrhoeae
cgtttccggtattgaggcag

SEQ ID NO: 52469 - DNA, 20 bp, Neisseria gonorrhoeae
ccggtattgaggcaggcaaa

SEQ ID NO: 52470 - DNA, 20 bp, Neisseria gonorrhoeae
cggtattgaggcaggcaaaa

SEQ ID NO: 52471 - DNA, 20 bp, Neisseria gonorrhoeae
aggcaggcaaaaaagtaacc

SEQ ID NO: 52472 - DNA, 20 bp, Neisseria gonorrhoeae
cggctgttcgcggcgcggtt

SEQ ID NO: 52473 - DNA, 20 bp, Neisseria gonorrhoeae
ttcagccttttcggcttcgg

SEQ ID NO: 52474 - DNA, 20 bp, Neisseria gonorrhoeae
agccttttcggcttcggcag

SEQ ID NO: 52475 - DNA, 20 bp, Neisseria gonorrhoeae
tcggcttcggcaggttcggc

SEQ ID NO: 52476 - DNA, 20 bp, Neisseria gonorrhoeae
cggcttcggcaggttcggct

SEQ ID NO: 52477 - DNA, 20 bp, Neisseria gonorrhoeae
ggcttcggcaggttcggctt

SEQ ID NO: 52478 - DNA, 20 bp, Neisseria gonorrhoeae
acggcgtgtcggcggcggcg

SEQ ID NO: 52479 - DNA, 20 bp, Neisseria gonorrhoeae
tgtcgggcggtacgacggca

SEQ ID NO: 52480 - DNA, 20 bp, Neisseria gonorrhoeae
ccgttgccgtcgtaccgccc

SEQ ID NO: 52481 - DNA, 20 bp, Neisseria gonorrhoeae
ccgtcgtaccgcccgacata

SEQ ID NO: 52482 - DNA, 20 bp, Neisseria gonorrhoeae
cgccgccgccgacacgccgt

SEQ ID NO: 52483 - DNA, 20 bp, Neisseria gonorrhoeae
cggcatcgcgcatgagtatg

SEQ ID NO: 52484 - DNA, 20 bp, Neisseria gonorrhoeae
cgcgggcagtgtcaacgtta

SEQ ID NO: 52485 - DNA, 20 bp, Neisseria gonorrhoeae
gcgggcagtgtcaacgttaa

SEQ ID NO: 52486 - DNA, 20 bp, Neisseria gonorrhoeae
aggcttcgctgcgccaggtc

SEQ ID NO: 52487 - DNA, 20 bp, Neisseria gonorrhoeae
gctgcgccaggtcaggcagg

SEQ ID NO: 52488 - DNA, 20 bp, Neisseria gonorrhoeae
gccgccgtgatggacgtttc

SEQ ID NO: 52489 - DNA, 20 bp, Neisseria gonorrhoeae
ccgccgtgatggacgtttcg

SEQ ID NO: 52490 - DNA, 20 bp, Neisseria gonorrhoeae
cgggcttgaaacgcagggag

SEQ ID NO: 52491 - DNA, 20 bp, Neisseria gonorrhoeae
gggcttgaaacgcagggagc

SEQ ID NO: 52492 - DNA, 20 bp, Neisseria gonorrhoeae
aaacgcagggagcaggaagc

SEQ ID NO: 52493 - DNA, 20 bp, Neisseria gonorrhoeae
agggcctgcaatgggcggag

SEQ ID NO: 52494 - DNA, 20 bp, Neisseria gonorrhoeae
gacggcgcgcgggtcaaaat

SEQ ID NO: 52495 - DNA, 20 bp, Neisseria gonorrhoeae
tttgatgccggactgcgccc

SEQ ID NO: 52496 - DNA, 20 bp, Neisseria gonorrhoeae
ttgatgccggactgcgcccc

SEQ ID NO: 52497 - DNA, 20 bp, Neisseria gonorrhoeae
tgatgccggactgcgccccg

SEQ ID NO: 52498 - DNA, 20 bp, Neisseria gonorrhoeae
tgaacgtttccagcccgcgc

SEQ ID NO: 52499 - DNA, 20 bp, Neisseria gonorrhoeae
gaacgtttccagcccgcgca

SEQ ID NO: 52500 - DNA, 20 bp, Neisseria gonorrhoeae
aacgtttccagcccgcgcaa

SEQ ID NO: 52501 - DNA, 20 bp, Neisseria gonorrhoeae
ccagcccgcgcaacatttat

SEQ ID NO: 52502 - DNA, 20 bp, Neisseria gonorrhoeae
cagcccgcgcaacatttatc

SEQ ID NO: 52503 - DNA, 20 bp, Neisseria gonorrhoeae
gcagggcgtgattaagtttg

SEQ ID NO: 52504 - DNA, 20 bp, Neisseria gonorrhoeae
agtttgcgggcgggcgcaac

SEQ ID NO: 52505 - DNA, 20 bp, Neisseria gonorrhoeae
gcgggcgggcgcaacgcggg

SEQ ID NO: 52506 - DNA, 20 bp, Neisseria gonorrhoeae
cgggcgggcgcaacgcgggt

SEQ ID NO: 52507 - DNA, 20 bp, Neisseria gonorrhoeae
gagcaggacggtcaaggcac

SEQ ID NO: 52508 - DNA, 20 bp, Neisseria gonorrhoeae
gctgacattgtgctacgtcg

SEQ ID NO: 52509 - DNA, 20 bp, Neisseria gonorrhoeae
ctgacattgtgctacgtcga

SEQ ID NO: 52510 - DNA, 20 bp, Neisseria gonorrhoeae
tgctacgtcgacggcgaatt

SEQ ID NO: 52511 - DNA, 20 bp, Neisseria gonorrhoeae
gccgtcgacgtagcacaatg

SEQ ID NO: 52512 - DNA, 20 bp, Neisseria gonorrhoeae
agacacacgcccgaagcatc

SEQ ID NO: 52513 - DNA, 20 bp, Neisseria gonorrhoeae
gaggcgcaatacacggtcaa

SEQ ID NO: 52514 - DNA, 20 bp, Neisseria gonorrhoeae
gcatcaaccttgaccgtgta

SEQ ID NO: 52515 - DNA, 20 bp, Neisseria gonorrhoeae
catcaaccttgaccgtgtat

SEQ ID NO: 52516 - DNA, 20 bp, Neisseria gonorrhoeae
accgtgtattgcgcctccaa

SEQ ID NO: 52517 - DNA, 20 bp, Neisseria gonorrhoeae
ggcatcggtgcggccgggaa

SEQ ID NO: 52518 - DNA, 20 bp, Neisseria gonorrhoeae
ccgttcgtggtggacacgca

SEQ ID NO: 52519 - DNA, 20 bp, Neisseria gonorrhoeae
gtggtggacacgcagaaaaa

SEQ ID NO: 52520 - DNA, 20 bp, Neisseria gonorrhoeae
gccgttgatgcccacgcggt

SEQ ID NO: 52521 - DNA, 20 bp, Neisseria gonorrhoeae
atgcccacgcggtttttctg

SEQ ID NO: 52522 - DNA, 20 bp, Neisseria gonorrhoeae
ccgcgccgagcagtgtggaa

SEQ ID NO: 52523 - DNA, 20 bp, Neisseria gonorrhoeae
ttgccgccgccgccctgcct

SEQ ID NO: 52524 - DNA, 20 bp, Neisseria gonorrhoeae
ccgccgccgccctgccttgt

SEQ ID NO: 52525 - DNA, 20 bp, Neisseria gonorrhoeae
tgaaatcgggcaggcgtaaa

SEQ ID NO: 52526 - DNA, 20 bp, Neisseria gonorrhoeae
gtttacgcctgcccgatttc

SEQ ID NO: 52527 - DNA, 20 bp, Neisseria gonorrhoeae
cttcccagccttccgcgcgc

SEQ ID NO: 52528 - DNA, 20 bp, Neisseria gonorrhoeae
ttcccagccttccgcgcgcg

SEQ ID NO: 52529 - DNA, 20 bp, Neisseria gonorrhoeae
ccagccttccgcgcgcggcg

SEQ ID NO: 52530 - DNA, 20 bp, Neisseria gonorrhoeae
cgcgcgcggcggggcggctt

SEQ ID NO: 52531 - DNA, 20 bp, Neisseria gonorrhoeae
gatgtatattcccgagcgag

SEQ ID NO: 52532 - DNA, 20 bp, Neisseria gonorrhoeae
gacgaaactcgaagcccccg

SEQ ID NO: 52533 - DNA, 20 bp, Neisseria gonorrhoeae
acgaaactcgaagcccccgc

SEQ ID NO: 52534 - DNA, 20 bp, Neisseria gonorrhoeae
gaccgcgatgcagccgtatg

SEQ ID NO: 52535 - DNA, 20 bp, Neisseria gonorrhoeae
accgcgatgcagccgtatgc

SEQ ID NO: 52536 - DNA, 20 bp, Neisseria gonorrhoeae
gagtttcgtcaaacccgaca

SEQ ID NO: 52537 - DNA, 20 bp, Neisseria gonorrhoeae
cggaacgcctcaaagccgcc

SEQ ID NO: 52538 - DNA, 20 bp, Neisseria gonorrhoeae
ggaacgcctcaaagccgccg

SEQ ID NO: 52539 - DNA, 20 bp, Neisseria gonorrhoeae
ggcgtgttcgaccgcggcgg

SEQ ID NO: 52540 - DNA, 20 bp, Neisseria gonorrhoeae
gaccgcggcggctttgaggc

SEQ ID NO: 52541 - DNA, 20 bp, Neisseria gonorrhoeae
gaggcgttccgaaacttccg

SEQ ID NO: 52542 - DNA, 20 bp, Neisseria gonorrhoeae
ggcaaatcatcacggaaacc

SEQ ID NO: 52543 - DNA, 20 bp, Neisseria gonorrhoeae
gcaaatcatcacggaaaccg

SEQ ID NO: 52544 - DNA, 20 bp, Neisseria gonorrhoeae
gacgggctgacaggccggct

SEQ ID NO: 52545 - DNA, 20 bp, Neisseria gonorrhoeae
acgggctgacaggccggctg

SEQ ID NO: 52546 - DNA, 20 bp, Neisseria gonorrhoeae
agccggcctgtcagcccgtc

SEQ ID NO: 52547 - DNA, 20 bp, Neisseria gonorrhoeae
gccccctttgccgccgccct

SEQ ID NO: 52548 - DNA, 20 bp, Neisseria gonorrhoeae
ccccctttgccgccgccctg

SEQ ID NO: 52549 - DNA, 20 bp, Neisseria gonorrhoeae
gccgccgccctgatttgcgc

SEQ ID NO: 52550 - DNA, 20 bp, Neisseria gonorrhoeae
ccgccgccctgatttgcgcc

SEQ ID NO: 52551 - DNA, 20 bp, Neisseria gonorrhoeae
gcgcccggctttttccgggc

SEQ ID NO: 52552 - DNA, 20 bp, Neisseria gonorrhoeae
gggcgggggcacgaacggac

SEQ ID NO: 52553 - DNA, 20 bp, Neisseria gonorrhoeae
ttcgcctgcgtccgttcgtg

SEQ ID NO: 52554 - DNA, 20 bp, Neisseria gonorrhoeae
gcctgcgtccgttcgtgccc

SEQ ID NO: 52555 - DNA, 20 bp, Neisseria gonorrhoeae
gtgcccccgccccaattcgc

SEQ ID NO: 52556 - DNA, 20 bp, Neisseria gonorrhoeae
gcccatttgggccttgagct

SEQ ID NO: 52557 - DNA, 20 bp, Neisseria gonorrhoeae
cggcaatggcggcaatgatg

SEQ ID NO: 52558 - DNA, 20 bp, Neisseria gonorrhoeae
atgggcggcggcggcggttc

SEQ ID NO: 52559 - DNA, 20 bp, Neisseria gonorrhoeae
tcaaacgaccacaaccacga

SEQ ID NO: 52560 - DNA, 20 bp, Neisseria gonorrhoeae
tggtcgtttgagaaccgccg

SEQ ID NO: 52561 - DNA, 20 bp, Neisseria gonorrhoeae
gagaaccgccgccgccgccc

SEQ ID NO: 52562 - DNA, 20 bp, Neisseria gonorrhoeae
gcccacttcgccgcgcggca

SEQ ID NO: 52563 - DNA, 20 bp, Neisseria gonorrhoeae
gccgcgcggcacttcgacca

SEQ ID NO: 52564 - DNA, 20 bp, Neisseria gonorrhoeae
gaccaattcttcatcgacgg

SEQ ID NO: 52565 - DNA, 20 bp, Neisseria gonorrhoeae
ttcatcgacggctttggctt

SEQ ID NO: 52566 - DNA, 20 bp, Neisseria gonorrhoeae
atcgacggctttggcttcca

SEQ ID NO: 52567 - DNA, 20 bp, Neisseria gonorrhoeae
ggcaaaccatttgccgaaca

SEQ ID NO: 52568 - DNA, 20 bp, Neisseria gonorrhoeae
gcaaaccatttgccgaacag

SEQ ID NO: 52569 - DNA, 20 bp, Neisseria gonorrhoeae
gccgaacaggtaagacgcgg

SEQ ID NO: 52570 - DNA, 20 bp, Neisseria gonorrhoeae
ccgaacaggtaagacgcggc

SEQ ID NO: 52571 - DNA, 20 bp, Neisseria gonorrhoeae
ccgcgtcttacctgttcggc

SEQ ID NO: 52572 - DNA, 20 bp, Neisseria gonorrhoeae
tccgaccatacgcccgagcg

SEQ ID NO: 52573 - DNA, 20 bp, Neisseria gonorrhoeae
cgctcgggcgtatggtcgga

SEQ ID NO: 52574 - DNA, 20 bp, Neisseria gonorrhoeae
gggctggcaggcgagttttc

SEQ ID NO: 52575 - DNA, 20 bp, Neisseria gonorrhoeae
ggctggcaggcgagttttct

SEQ ID NO: 52576 - DNA, 20 bp, Neisseria gonorrhoeae
tctgctgatcggcctgtgtt

SEQ ID NO: 52577 - DNA, 20 bp, Neisseria gonorrhoeae
gtgtagcaaaaagaacccct

SEQ ID NO: 52578 - DNA, 20 bp, Neisseria gonorrhoeae
ctgttgtcgctatttgcggc

SEQ ID NO: 52579 - DNA, 20 bp, Neisseria gonorrhoeae
tcgctatttgcggcagtttc

SEQ ID NO: 52580 - DNA, 20 bp, Neisseria gonorrhoeae
gcggcagtttcgctgaagat

SEQ ID NO: 52581 - DNA, 20 bp, Neisseria gonorrhoeae
cggcagtttcgctgaagatt

SEQ ID NO: 52582 - DNA, 20 bp, Neisseria gonorrhoeae
gtgattgaagccaaagggac

SEQ ID NO: 52583 - DNA, 20 bp, Neisseria gonorrhoeae
tgattgaagccaaagggact

SEQ ID NO: 52584 - DNA, 20 bp, Neisseria gonorrhoeae
aagccaaagggactgacggg

SEQ ID NO: 52585 - DNA, 20 bp, Neisseria gonorrhoeae
gcgaaaaagcgaagagcgga

SEQ ID NO: 52586 - DNA, 20 bp, Neisseria gonorrhoeae
cgaaaaagcgaagagcggaa

SEQ ID NO: 52587 - DNA, 20 bp, Neisseria gonorrhoeae
gacctgcccccgatactggg

SEQ ID NO: 52588 - DNA, 20 bp, Neisseria gonorrhoeae
acctgcccccgatactgggc

SEQ ID NO: 52589 - DNA, 20 bp, Neisseria gonorrhoeae
cctgtcccgggtagcagcct

SEQ ID NO: 52590 - DNA, 20 bp, Neisseria gonorrhoeae
ctgtcccgggtagcagcctt

SEQ ID NO: 52591 - DNA, 20 bp, Neisseria gonorrhoeae
tttgaagtgtacgccgccga

SEQ ID NO: 52592 - DNA, 20 bp, Neisseria gonorrhoeae
cgggggcgatgtgcaaaatg

SEQ ID NO: 52593 - DNA, 20 bp, Neisseria gonorrhoeae
gggggcgatgtgcaaaatgc

SEQ ID NO: 52594 - DNA, 20 bp, Neisseria gonorrhoeae
cgtcatcctgcaccatcggg

SEQ ID NO: 52595 - DNA, 20 bp, Neisseria gonorrhoeae
tgcacatcgcccccgaaacc

SEQ ID NO: 52596 - DNA, 20 bp, Neisseria gonorrhoeae
gcacatcgcccccgaaaccg

SEQ ID NO: 52597 - DNA, 20 bp, Neisseria gonorrhoeae
cgccagccagcggtcggttt

SEQ ID NO: 52598 - DNA, 20 bp, Neisseria gonorrhoeae
gggcaagcacgtcggcagtc

SEQ ID NO: 52599 - DNA, 20 bp, Neisseria gonorrhoeae
ggcaagcacgtcggcagtct

SEQ ID NO: 52600 - DNA, 20 bp, Neisseria gonorrhoeae
ggcagccgtttcaccgtttt

SEQ ID NO: 52601 - DNA, 20 bp, Neisseria gonorrhoeae
caccgttttcgggaaccatg

SEQ ID NO: 52602 - DNA, 20 bp, Neisseria gonorrhoeae
gggcacgatgtcgccggctt

SEQ ID NO: 52603 - DNA, 20 bp, Neisseria gonorrhoeae
gatggtgcggatggacatcg

SEQ ID NO: 52604 - DNA, 20 bp, Neisseria gonorrhoeae
cacgccgcgcgtgagggcgg

SEQ ID NO: 52605 - DNA, 20 bp, Neisseria gonorrhoeae
acgccgcgcgtgagggcggg

SEQ ID NO: 52606 - DNA, 20 bp, Neisseria gonorrhoeae
gtcttccgcccgccccgatc

SEQ ID NO: 52607 - DNA, 20 bp, Neisseria gonorrhoeae
tcttccgcccgccccgatcc

SEQ ID NO: 52608 - DNA, 20 bp, Neisseria gonorrhoeae
cgcccgccccgatcccttct

SEQ ID NO: 52609 - DNA, 20 bp, Neisseria gonorrhoeae
tacgacgtttggtattggtg

SEQ ID NO: 52610 - DNA, 20 bp, Neisseria gonorrhoeae
ggtattggtgtacccaacgc

SEQ ID NO: 52611 - DNA, 20 bp, Neisseria gonorrhoeae
gccgcccgctacgccaaact

SEQ ID NO: 52612 - DNA, 20 bp, Neisseria gonorrhoeae
atttggccgatgcgctgcaa

SEQ ID NO: 52613 - DNA, 20 bp, Neisseria gonorrhoeae
ggccgatgcgctgcaaaaac

SEQ ID NO: 52614 - DNA, 20 bp, Neisseria gonorrhoeae
gccgatgcgctgcaaaaacg

SEQ ID NO: 52615 - DNA, 20 bp, Neisseria gonorrhoeae
gtcccgtttttgcagcgcat

SEQ ID NO: 52616 - DNA, 20 bp, Neisseria gonorrhoeae
acgatgtcgtagcggccttt

SEQ ID NO: 52617 - DNA, 20 bp, Neisseria gonorrhoeae
ctcatagcccaaggcttcca

SEQ ID NO: 52618 - DNA, 20 bp, Neisseria gonorrhoeae
tcatagcccaaggcttccaa

SEQ ID NO: 52619 - DNA, 20 bp, Neisseria gonorrhoeae
caatgcaaggttggcgatga

SEQ ID NO: 52620 - DNA, 20 bp, Neisseria gonorrhoeae
gcgatgacttcgttggtgtt

SEQ ID NO: 52621 - DNA, 20 bp, Neisseria gonorrhoeae
tgacgagggagatatggttt

SEQ ID NO: 52622 - DNA, 20 bp, Neisseria gonorrhoeae
gacgagggagatatggtttc

SEQ ID NO: 52623 - DNA, 20 bp, Neisseria gonorrhoeae
acgagggagatatggtttcc

SEQ ID NO: 52624 - DNA, 20 bp, Neisseria gonorrhoeae
ccggccagccgcattaatgc

SEQ ID NO: 52625 - DNA, 20 bp, Neisseria gonorrhoeae
cggccagccgcattaatgcc

SEQ ID NO: 52626 - DNA, 20 bp, Neisseria gonorrhoeae
cgcagccataccgatggatt

SEQ ID NO: 52627 - DNA, 20 bp, Neisseria gonorrhoeae
gcccaaggtcgggtgcgggt

SEQ ID NO: 52628 - DNA, 20 bp, Neisseria gonorrhoeae
tgccgatgtctgccgcgtcg

SEQ ID NO: 52629 - DNA, 20 bp, Neisseria gonorrhoeae
gccgatgtctgccgcgtcgc

SEQ ID NO: 52630 - DNA, 20 bp, Neisseria gonorrhoeae
ccgatgtctgccgcgtcgca

SEQ ID NO: 52631 - DNA, 20 bp, Neisseria gonorrhoeae
gtgttgcagaccttcgccgt

SEQ ID NO: 52632 - DNA, 20 bp, Neisseria gonorrhoeae
cagaccttcgccgttcagcg

SEQ ID NO: 52633 - DNA, 20 bp, Neisseria gonorrhoeae
gccgttcagcgtcgtacggc

SEQ ID NO: 52634 - DNA, 20 bp, Neisseria gonorrhoeae
agcgtcgtacggccggcagt

SEQ ID NO: 52635 - DNA, 20 bp, Neisseria gonorrhoeae
ctgctgggcggtactgccgg

SEQ ID NO: 52636 - DNA, 20 bp, Neisseria gonorrhoeae
ctgccacagttcggcaggct

SEQ ID NO: 52637 - DNA, 20 bp, Neisseria gonorrhoeae
ggcaggctgcaccaccggca

SEQ ID NO: 52638 - DNA, 20 bp, Neisseria gonorrhoeae
gccagttgccgatcggagtg

SEQ ID NO: 52639 - DNA, 20 bp, Neisseria gonorrhoeae
ccagttgccgatcggagtgt

SEQ ID NO: 52640 - DNA, 20 bp, Neisseria gonorrhoeae
ccgatcggagtgtggacgac

SEQ ID NO: 52641 - DNA, 20 bp, Neisseria gonorrhoeae
cgtcgtccacactccgatcg

SEQ ID NO: 52642 - DNA, 20 bp, Neisseria gonorrhoeae
ccgccaccaaaaacctgatg

SEQ ID NO: 52643 - DNA, 20 bp, Neisseria gonorrhoeae
cgccaccaaaaacctgatga

SEQ ID NO: 52644 - DNA, 20 bp, Neisseria gonorrhoeae
ttggtggcggaaaggcgcat

SEQ ID NO: 52645 - DNA, 20 bp, Neisseria gonorrhoeae
tggtggcggaaaggcgcatc

SEQ ID NO: 52646 - DNA, 20 bp, Neisseria gonorrhoeae
ggtggcggaaaggcgcatct

SEQ ID NO: 52647 - DNA, 20 bp, Neisseria gonorrhoeae
ccatgcagtacgaacgcggc

SEQ ID NO: 52648 - DNA, 20 bp, Neisseria gonorrhoeae
catgcagtacgaacgcggcg

SEQ ID NO: 52649 - DNA, 20 bp, Neisseria gonorrhoeae
ggacttcaaacgcggcagct

SEQ ID NO: 52650 - DNA, 20 bp, Neisseria gonorrhoeae
gacttcaaacgcggcagctt

SEQ ID NO: 52651 - DNA, 20 bp, Neisseria gonorrhoeae
aaacgcggcagcttccgcgt

SEQ ID NO: 52652 - DNA, 20 bp, Neisseria gonorrhoeae
ctgcgctcccaccgcagcct

SEQ ID NO: 52653 - DNA, 20 bp, Neisseria gonorrhoeae
aaaccataggccgcgccgcg

SEQ ID NO: 52654 - DNA, 20 bp, Neisseria gonorrhoeae
acgttgcgcgcggcgcggcc

SEQ ID NO: 52655 - DNA, 20 bp, Neisseria gonorrhoeae
cgcgcggcgcggcctatggt

SEQ ID NO: 52656 - DNA, 20 bp, Neisseria gonorrhoeae
gaatcaggctgcggtgggag

SEQ ID NO: 52657 - DNA, 20 bp, Neisseria gonorrhoeae
ggcaacgtccgcaccgcctt

SEQ ID NO: 52658 - DNA, 20 bp, Neisseria gonorrhoeae
catggcgaagctgacgttgg

SEQ ID NO: 52659 - DNA, 20 bp, Neisseria gonorrhoeae
atggcgaagctgacgttggc

SEQ ID NO: 52660 - DNA, 20 bp, Neisseria gonorrhoeae
gcggcggcaagcgcgggcgc

SEQ ID NO: 52661 - DNA, 20 bp, Neisseria gonorrhoeae
ccgccgccaacgtcagcttc

SEQ ID NO: 52662 - DNA, 20 bp, Neisseria gonorrhoeae
ctccattgccgccgcgtctt

SEQ ID NO: 52663 - DNA, 20 bp, Neisseria gonorrhoeae
ccgccgcgtctttaaaccaa

SEQ ID NO: 52664 - DNA, 20 bp, Neisseria gonorrhoeae
aaaccaaatgccgtgtttca

SEQ ID NO: 52665 - DNA, 20 bp, Neisseria gonorrhoeae
aaccaaatgccgtgtttcac

SEQ ID NO: 52666 - DNA, 20 bp, Neisseria gonorrhoeae
caccgctttgcccatgccga

SEQ ID NO: 52667 - DNA, 20 bp, Neisseria gonorrhoeae
ggtcatcagcgcgcccgcca

SEQ ID NO: 52668 - DNA, 20 bp, Neisseria gonorrhoeae
gccgcccgcctttttctctt

SEQ ID NO: 52669 - DNA, 20 bp, Neisseria gonorrhoeae
ccgcccgcctttttctcttc

SEQ ID NO: 52670 - DNA, 20 bp, Neisseria gonorrhoeae
ttctcttcgggattggattc

SEQ ID NO: 52671 - DNA, 20 bp, Neisseria gonorrhoeae
tctcttcgggattggattcg

SEQ ID NO: 52672 - DNA, 20 bp, Neisseria gonorrhoeae
ggttccgttaccaatgccga

SEQ ID NO: 52673 - DNA, 20 bp, Neisseria gonorrhoeae
cgttaccaatgccgacattg

SEQ ID NO: 52674 - DNA, 20 bp, Neisseria gonorrhoeae
ccaatgccgacattgctgct

SEQ ID NO: 52675 - DNA, 20 bp, Neisseria gonorrhoeae
ctgctgcaatcgttgctgcc

SEQ ID NO: 52676 - DNA, 20 bp, Neisseria gonorrhoeae
ctgccggcatcgaagccgtg

SEQ ID NO: 52677 - DNA, 20 bp, Neisseria gonorrhoeae
atgggcggggaagccgcagt

SEQ ID NO: 52678 - DNA, 20 bp, Neisseria gonorrhoeae
tgggcggggaagccgcagtg

SEQ ID NO: 52679 - DNA, 20 bp, Neisseria gonorrhoeae
agaaggggacggaaagtgaa

SEQ ID NO: 52680 - DNA, 20 bp, Neisseria gonorrhoeae
actttccgtccccttcttaa

SEQ ID NO: 52681 - DNA, 20 bp, Neisseria gonorrhoeae
ccgtccccttcttaatccac

SEQ ID NO: 52682 - DNA, 20 bp, Neisseria gonorrhoeae
ggctgttggtcagccgcgcc

SEQ ID NO: 52683 - DNA, 20 bp, Neisseria gonorrhoeae
gctgttggtcagccgcgcca

SEQ ID NO: 52684 - DNA, 20 bp, Neisseria gonorrhoeae
gtcagccgcgccacgcgccc

SEQ ID NO: 52685 - DNA, 20 bp, Neisseria gonorrhoeae
ggggagcagctcgacagcct

SEQ ID NO: 52686 - DNA, 20 bp, Neisseria gonorrhoeae
ccgacatggtcagcttcggc

SEQ ID NO: 52687 - DNA, 20 bp, Neisseria gonorrhoeae
gtgtaccgccgccagtccgc

SEQ ID NO: 52688 - DNA, 20 bp, Neisseria gonorrhoeae
tgtaccgccgccagtccgcg

SEQ ID NO: 52689 - DNA, 20 bp, Neisseria gonorrhoeae
caccatgttcgggctgtttg

SEQ ID NO: 52690 - DNA, 20 bp, Neisseria gonorrhoeae
gggctgtttgccgccggctt

SEQ ID NO: 52691 - DNA, 20 bp, Neisseria gonorrhoeae
gccgccggctttatgtattt

SEQ ID NO: 52692 - DNA, 20 bp, Neisseria gonorrhoeae
gagtattttgtgctgggcgg

SEQ ID NO: 52693 - DNA, 20 bp, Neisseria gonorrhoeae
tgtgctgggcggaaaatatg

SEQ ID NO: 52694 - DNA, 20 bp, Neisseria gonorrhoeae
gtgctgggcggaaaatatgc

SEQ ID NO: 52695 - DNA, 20 bp, Neisseria gonorrhoeae
tgctgggcggaaaatatgcc

SEQ ID NO: 52696 - DNA, 20 bp, Neisseria gonorrhoeae
tccgcccagcacaaaatact

SEQ ID NO: 52697 - DNA, 20 bp, Neisseria gonorrhoeae
aataagttcgtatgcatgtt

SEQ ID NO: 52698 - DNA, 20 bp, Neisseria gonorrhoeae
gtatgcatgttgtgccttat

SEQ ID NO: 52699 - DNA, 20 bp, Neisseria gonorrhoeae
tgccttatcgttgacaccgt

SEQ ID NO: 52700 - DNA, 20 bp, Neisseria gonorrhoeae
tcgttgacaccgtccagcat

SEQ ID NO: 52701 - DNA, 20 bp, Neisseria gonorrhoeae
acaccgtccagcatcacata

SEQ ID NO: 52702 - DNA, 20 bp, Neisseria gonorrhoeae
tgatttcagacctgcgttta

SEQ ID NO: 52703 - DNA, 20 bp, Neisseria gonorrhoeae
cagacctgcgtttacggtaa

SEQ ID NO: 52704 - DNA, 20 bp, Neisseria gonorrhoeae
agacctgcgtttacggtaac

SEQ ID NO: 52705 - DNA, 20 bp, Neisseria gonorrhoeae
acggtaacgaagttttggtc

SEQ ID NO: 52706 - DNA, 20 bp, Neisseria gonorrhoeae
cggtaacgaagttttggtcg

SEQ ID NO: 52707 - DNA, 20 bp, Neisseria gonorrhoeae
cggtttgggtttcagacggc

SEQ ID NO: 52708 - DNA, 20 bp, Neisseria gonorrhoeae
gggtttcagacggcatggca

SEQ ID NO: 52709 - DNA, 20 bp, Neisseria gonorrhoeae
ggtttcagacggcatggcag

SEQ ID NO: 52710 - DNA, 20 bp, Neisseria gonorrhoeae
cagacggcatggcagtctgt

SEQ ID NO: 52711 - DNA, 20 bp, Neisseria gonorrhoeae
agacggcatggcagtctgtt

SEQ ID NO: 52712 - DNA, 20 bp, Neisseria gonorrhoeae
gatgtcggcaatgctcatgc

SEQ ID NO: 52713 - DNA, 20 bp, Neisseria gonorrhoeae
atgtcggcaatgctcatgcc

SEQ ID NO: 52714 - DNA, 20 bp, Neisseria gonorrhoeae
ccgtcgagatgtcggacagg

SEQ ID NO: 52715 - DNA, 20 bp, Neisseria gonorrhoeae
tggcggcaggcgtatagact

SEQ ID NO: 52716 - DNA, 20 bp, Neisseria gonorrhoeae
ggcggcaggcgtatagactt

SEQ ID NO: 52717 - DNA, 20 bp, Neisseria gonorrhoeae
tagcgttgggcaagggcgct

SEQ ID NO: 52718 - DNA, 20 bp, Neisseria gonorrhoeae
ggcaagggcgctttggcggc

SEQ ID NO: 52719 - DNA, 20 bp, Neisseria gonorrhoeae
ggcggctttggatatcggat

SEQ ID NO: 52720 - DNA, 20 bp, Neisseria gonorrhoeae
gcggctttggatatcggatt

SEQ ID NO: 52721 - DNA, 20 bp, Neisseria gonorrhoeae
ggatatcggattggaggtgg

SEQ ID NO: 52722 - DNA, 20 bp, Neisseria gonorrhoeae
gccgaggatttcgcctgcgc

SEQ ID NO: 52723 - DNA, 20 bp, Neisseria gonorrhoeae
cgcctgcgccgcggatttcc

SEQ ID NO: 52724 - DNA, 20 bp, Neisseria gonorrhoeae
gcctgcgccgcggatttcca

SEQ ID NO: 52725 - DNA, 20 bp, Neisseria gonorrhoeae
ccaaatcctgcatggcgagg

SEQ ID NO: 52726 - DNA, 20 bp, Neisseria gonorrhoeae
caaatcctgcatggcgaggg

SEQ ID NO: 52727 - DNA, 20 bp, Neisseria gonorrhoeae
tgcgcgtgctgctcgaccag

SEQ ID NO: 52728 - DNA, 20 bp, Neisseria gonorrhoeae
gcgcgtgctgctcgaccaga

SEQ ID NO: 52729 - DNA, 20 bp, Neisseria gonorrhoeae
cgcgtgctgctcgaccagaa

SEQ ID NO: 52730 - DNA, 20 bp, Neisseria gonorrhoeae
gccgcccatcaccgccacaa

SEQ ID NO: 52731 - DNA, 20 bp, Neisseria gonorrhoeae
ccgcccatcaccgccacaaa

SEQ ID NO: 52732 - DNA, 20 bp, Neisseria gonorrhoeae
gccttgttccacgcgccgct

SEQ ID NO: 52733 - DNA, 20 bp, Neisseria gonorrhoeae
ttccacgcgccgctgccgag

SEQ ID NO: 52734 - DNA, 20 bp, Neisseria gonorrhoeae
cacgcgccgctgccgagctt

SEQ ID NO: 52735 - DNA, 20 bp, Neisseria gonorrhoeae
tgcagggcgacgctttcatg

SEQ ID NO: 52736 - DNA, 20 bp, Neisseria gonorrhoeae
catgcgcctgaccggagtag

SEQ ID NO: 52737 - DNA, 20 bp, Neisseria gonorrhoeae
tgcatcgccgtggcaaccgg

SEQ ID NO: 52738 - DNA, 20 bp, Neisseria gonorrhoeae
taatctgccacaacgccgac

SEQ ID NO: 52739 - DNA, 20 bp, Neisseria gonorrhoeae
aatctgccacaacgccgaca

SEQ ID NO: 52740 - DNA, 20 bp, Neisseria gonorrhoeae
atctgccacaacgccgacag

SEQ ID NO: 52741 - DNA, 20 bp, Neisseria gonorrhoeae
tggcagattaaaagcggcgc

SEQ ID NO: 52742 - DNA, 20 bp, Neisseria gonorrhoeae
gtggatgtaggcggcgagga

SEQ ID NO: 52743 - DNA, 20 bp, Neisseria gonorrhoeae
tggatgtaggcggcgaggac

SEQ ID NO: 52744 - DNA, 20 bp, Neisseria gonorrhoeae
tacgcagcaagggattgaag

SEQ ID NO: 52745 - DNA, 20 bp, Neisseria gonorrhoeae
acgcagcaagggattgaagg

SEQ ID NO: 52746 - DNA, 20 bp, Neisseria gonorrhoeae
cgcagcaagggattgaaggg

SEQ ID NO: 52747 - DNA, 20 bp, Neisseria gonorrhoeae
ttcgaccgccgcgtagatga

SEQ ID NO: 52748 - DNA, 20 bp, Neisseria gonorrhoeae
gaccgccgcgtagatgaggg

SEQ ID NO: 52749 - DNA, 20 bp, Neisseria gonorrhoeae
cagcaggcgcggggcgatac

SEQ ID NO: 52750 - DNA, 20 bp, Neisseria gonorrhoeae
gatggcttcggatgccgtcc

SEQ ID NO: 52751 - DNA, 20 bp, Neisseria gonorrhoeae
ggatgccgtccagacagaca

SEQ ID NO: 52752 - DNA, 20 bp, Neisseria gonorrhoeae
cgcgccatcgaaatgctgtc

SEQ ID NO: 52753 - DNA, 20 bp, Neisseria gonorrhoeae
tgcggcgggatgttggtcgc

SEQ ID NO: 52754 - DNA, 20 bp, Neisseria gonorrhoeae
gtcgccataccgacggcgat

SEQ ID NO: 52755 - DNA, 20 bp, Neisseria gonorrhoeae
acgagcagtgtggggaaacg

SEQ ID NO: 52756 - DNA, 20 bp, Neisseria gonorrhoeae
tactgccgacccgtttcccc

SEQ ID NO: 52757 - DNA, 20 bp, Neisseria gonorrhoeae
ccccacactgctcgtcaacg

SEQ ID NO: 52758 - DNA, 20 bp, Neisseria gonorrhoeae
gtcgttgcggccaagcgcgc

SEQ ID NO: 52759 - DNA, 20 bp, Neisseria gonorrhoeae
cggccaagcgcgcgcaggac

SEQ ID NO: 52760 - DNA, 20 bp, Neisseria gonorrhoeae
gagcgaggcggaggtgcagg

SEQ ID NO: 52761 - DNA, 20 bp, Neisseria gonorrhoeae
gccgcaacgacgaactggcg

SEQ ID NO: 52762 - DNA, 20 bp, Neisseria gonorrhoeae
gtcggcatccagcaggtatt

SEQ ID NO: 52763 - DNA, 20 bp, Neisseria gonorrhoeae
tcggcatccagcaggtattg

SEQ ID NO: 52764 - DNA, 20 bp, Neisseria gonorrhoeae
ggcgaacttggccgcttcgc

SEQ ID NO: 52765 - DNA, 20 bp, Neisseria gonorrhoeae
gccgcttcgccgaagcagac

SEQ ID NO: 52766 - DNA, 20 bp, Neisseria gonorrhoeae
gccgaagcagacgggcaaaa

SEQ ID NO: 52767 - DNA, 20 bp, Neisseria gonorrhoeae
gcaggataatgaaaagcaac

SEQ ID NO: 52768 - DNA, 20 bp, Neisseria gonorrhoeae
aatttgcaggttatcactat

SEQ ID NO: 52769 - DNA, 20 bp, Neisseria gonorrhoeae
gcaggttatcactatgtgca

SEQ ID NO: 52770 - DNA, 20 bp, Neisseria gonorrhoeae
caggttatcactatgtgcat

SEQ ID NO: 52771 - DNA, 20 bp, Neisseria gonorrhoeae
tcactatgtgcataggcggc

SEQ ID NO: 52772 - DNA, 20 bp, Neisseria gonorrhoeae
ccaacctcgacgattatgtc

SEQ ID NO: 52773 - DNA, 20 bp, Neisseria gonorrhoeae
tgtcatcgggcaggggcagg

SEQ ID NO: 52774 - DNA, 20 bp, Neisseria gonorrhoeae
cggtttacaaccattacaaa

SEQ ID NO: 52775 - DNA, 20 bp, Neisseria gonorrhoeae
acaaccattacaaacgcctg

SEQ ID NO: 52776 - DNA, 20 bp, Neisseria gonorrhoeae
gtaatggttgtaaaccgcaa

SEQ ID NO: 52777 - DNA, 20 bp, Neisseria gonorrhoeae
ctgcccctgactgcggacgt

SEQ ID NO: 52778 - DNA, 20 bp, Neisseria gonorrhoeae
tgcccctgactgcggacgtt

SEQ ID NO: 52779 - DNA, 20 bp, Neisseria gonorrhoeae
tgcaaggtttccggcgcgtt

SEQ ID NO: 52780 - DNA, 20 bp, Neisseria gonorrhoeae
ccggcgcgttgatgatgtcg

SEQ ID NO: 52781 - DNA, 20 bp, Neisseria gonorrhoeae
cggcgcgttgatgatgtcga

SEQ ID NO: 52782 - DNA, 20 bp, Neisseria gonorrhoeae
aaatccctgctggtgcgcgc

SEQ ID NO: 52783 - DNA, 20 bp, Neisseria gonorrhoeae
gggcgtgcggactgatggta

SEQ ID NO: 52784 - DNA, 20 bp, Neisseria gonorrhoeae
gacaaaggcggtcagctgac

SEQ ID NO: 52785 - DNA, 20 bp, Neisseria gonorrhoeae
tgccaatgcgccgactttgg

SEQ ID NO: 52786 - DNA, 20 bp, Neisseria gonorrhoeae
gccaatgcgccgactttggt

SEQ ID NO: 52787 - DNA, 20 bp, Neisseria gonorrhoeae
ccaatgcgccgactttggtg

SEQ ID NO: 52788 - DNA, 20 bp, Neisseria gonorrhoeae
ggtggcgacgacttcgccgt

SEQ ID NO: 52789 - DNA, 20 bp, Neisseria gonorrhoeae
gcgcgatgtcgtaaccacct

SEQ ID NO: 52790 - DNA, 20 bp, Neisseria gonorrhoeae
cgcgatgtcgtaaccacctt

SEQ ID NO: 52791 - DNA, 20 bp, Neisseria gonorrhoeae
aaacgccgcgcgcccgaaat

SEQ ID NO: 52792 - DNA, 20 bp, Neisseria gonorrhoeae
atccggccgccgttcagggc

SEQ ID NO: 52793 - DNA, 20 bp, Neisseria gonorrhoeae
tccggccgccgttcagggcg

SEQ ID NO: 52794 - DNA, 20 bp, Neisseria gonorrhoeae
cgggcgtttaacgaagaacc

SEQ ID NO: 52795 - DNA, 20 bp, Neisseria gonorrhoeae
aacgaagaaccggtcgtgcg

SEQ ID NO: 52796 - DNA, 20 bp, Neisseria gonorrhoeae
acgaagaaccggtcgtgcgc

SEQ ID NO: 52797 - DNA, 20 bp, Neisseria gonorrhoeae
ccgtcgtcagcggcgtggga

SEQ ID NO: 52798 - DNA, 20 bp, Neisseria gonorrhoeae
gatggcgcgcacgaccggtt

SEQ ID NO: 52799 - DNA, 20 bp, Neisseria gonorrhoeae
tttccatgtacggcggcgga

SEQ ID NO: 52800 - DNA, 20 bp, Neisseria gonorrhoeae
ccatgtacggcggcggattt

SEQ ID NO: 52801 - DNA, 20 bp, Neisseria gonorrhoeae
catgtacggcggcggatttg

SEQ ID NO: 52802 - DNA, 20 bp, Neisseria gonorrhoeae
gccgccattcccgcctacct

SEQ ID NO: 52803 - DNA, 20 bp, Neisseria gonorrhoeae
ccgccattcccgcctacctg

SEQ ID NO: 52804 - DNA, 20 bp, Neisseria gonorrhoeae
ccttgtgggcgaaaaagttt

SEQ ID NO: 52805 - DNA, 20 bp, Neisseria gonorrhoeae
tgggcgaaaaagtttccggc

SEQ ID NO: 52806 - DNA, 20 bp, Neisseria gonorrhoeae
ccggcgacggcatatcggtc

SEQ ID NO: 52807 - DNA, 20 bp, Neisseria gonorrhoeae
cggcgacggcatatcggtct

SEQ ID NO: 52808 - DNA, 20 bp, Neisseria gonorrhoeae
ggcattggccgtcataccgc

SEQ ID NO: 52809 - DNA, 20 bp, Neisseria gonorrhoeae
ttgcggcacatgcgggcgca

SEQ ID NO: 52810 - DNA, 20 bp, Neisseria gonorrhoeae
cggcacatgcgggcgcaaac

SEQ ID NO: 52811 - DNA, 20 bp, Neisseria gonorrhoeae
gagctcggcggcagcaacgc

SEQ ID NO: 52812 - DNA, 20 bp, Neisseria gonorrhoeae
ctgccgccgagctccaacac

SEQ ID NO: 52813 - DNA, 20 bp, Neisseria gonorrhoeae
tcttgaggtttgcgcccgca

SEQ ID NO: 52814 - DNA, 20 bp, Neisseria gonorrhoeae
cacaggggtcggggtggttt

SEQ ID NO: 52815 - DNA, 20 bp, Neisseria gonorrhoeae
taccctgcgacggttttaga

SEQ ID NO: 52816 - DNA, 20 bp, Neisseria gonorrhoeae
accctgcgacggttttagac

SEQ ID NO: 52817 - DNA, 20 bp, Neisseria gonorrhoeae
ccctgcgacggttttagaca

SEQ ID NO: 52818 - DNA, 20 bp, Neisseria gonorrhoeae
tagacagggtaaatcctgcc

SEQ ID NO: 52819 - DNA, 20 bp, Neisseria gonorrhoeae
gcctgccagtcgtgcgatac

SEQ ID NO: 52820 - DNA, 20 bp, Neisseria gonorrhoeae
cctgccagtcgtgcgatacg

SEQ ID NO: 52821 - DNA, 20 bp, Neisseria gonorrhoeae
gctgccgatacgttcggggt

SEQ ID NO: 52822 - DNA, 20 bp, Neisseria gonorrhoeae
ggggtggatgttggtcagtc

SEQ ID NO: 52823 - DNA, 20 bp, Neisseria gonorrhoeae
gtcagtccggcacgggtcat

SEQ ID NO: 52824 - DNA, 20 bp, Neisseria gonorrhoeae
tccggcaggtcttgtgcggc

SEQ ID NO: 52825 - DNA, 20 bp, Neisseria gonorrhoeae
ccggcaggtcttgtgcggct

SEQ ID NO: 52826 - DNA, 20 bp, Neisseria gonorrhoeae
cggcaggtcttgtgcggcta

SEQ ID NO: 52827 - DNA, 20 bp, Neisseria gonorrhoeae
tgcggctaaggttgctttgc

SEQ ID NO: 52828 - DNA, 20 bp, Neisseria gonorrhoeae
ctttgccttgcgacgtatgc

SEQ ID NO: 52829 - DNA, 20 bp, Neisseria gonorrhoeae
gggcaccaaatcgcgcgggg

SEQ ID NO: 52830 - DNA, 20 bp, Neisseria gonorrhoeae
gcagcggcgcggtgatttcg

SEQ ID NO: 52831 - DNA, 20 bp, Neisseria gonorrhoeae
cagcggcgcggtgatttcgc

SEQ ID NO: 52832 - DNA, 20 bp, Neisseria gonorrhoeae
cgcggcggcggctggtcagg

SEQ ID NO: 52833 - DNA, 20 bp, Neisseria gonorrhoeae
gcggcggcggctggtcaggg

SEQ ID NO: 52834 - DNA, 20 bp, Neisseria gonorrhoeae
gtcccttttctttcaattgt

SEQ ID NO: 52835 - DNA, 20 bp, Neisseria gonorrhoeae
tcccttttctttcaattgtt

SEQ ID NO: 52836 - DNA, 20 bp, Neisseria gonorrhoeae
tctttcaattgtttaaaggc

SEQ ID NO: 52837 - DNA, 20 bp, Neisseria gonorrhoeae
ctttcaattgtttaaaggcg

SEQ ID NO: 52838 - DNA, 20 bp, Neisseria gonorrhoeae
tttcaattgtttaaaggcgg

SEQ ID NO: 52839 - DNA, 20 bp, Neisseria gonorrhoeae
aagaggcagtgtttgcggtg

SEQ ID NO: 52840 - DNA, 20 bp, Neisseria gonorrhoeae
agaggcagtgtttgcggtgt

SEQ ID NO: 52841 - DNA, 20 bp, Neisseria gonorrhoeae
gcggtgttcggtaatgtcga

SEQ ID NO: 52842 - DNA, 20 bp, Neisseria gonorrhoeae
cggtgttcggtaatgtcgaa

SEQ ID NO: 52843 - DNA, 20 bp, Neisseria gonorrhoeae
ggtaatgtcgaatgtgaatg

SEQ ID NO: 52844 - DNA, 20 bp, Neisseria gonorrhoeae
ttgtagcagttgttaaagaa

SEQ ID NO: 52845 - DNA, 20 bp, Neisseria gonorrhoeae
tgtagcagttgttaaagaag

SEQ ID NO: 52846 - DNA, 20 bp, Neisseria gonorrhoeae
gtagcagttgttaaagaaga

SEQ ID NO: 52847 - DNA, 20 bp, Neisseria gonorrhoeae
tagcagttgttaaagaagat

SEQ ID NO: 52848 - DNA, 20 bp, Neisseria gonorrhoeae
ttaaagaagatgtcggcgaa

SEQ ID NO: 52849 - DNA, 20 bp, Neisseria gonorrhoeae
gaccggatcggtttcttcgg

SEQ ID NO: 52850 - DNA, 20 bp, Neisseria gonorrhoeae
accggatcggtttcttcggc

SEQ ID NO: 52851 - DNA, 20 bp, Neisseria gonorrhoeae
cttcggcgggattcggcact

SEQ ID NO: 52852 - DNA, 20 bp, Neisseria gonorrhoeae
ttcggcgggattcggcactt

SEQ ID NO: 52853 - DNA, 20 bp, Neisseria gonorrhoeae
ggcgggattcggcactttgc

SEQ ID NO: 52854 - DNA, 20 bp, Neisseria gonorrhoeae
gacttcggaagtgccgatgc

SEQ ID NO: 52855 - DNA, 20 bp, Neisseria gonorrhoeae
ggaagtgccgatgccgtgtg

SEQ ID NO: 52856 - DNA, 20 bp, Neisseria gonorrhoeae
gcacacttccacccacggcg

SEQ ID NO: 52857 - DNA, 20 bp, Neisseria gonorrhoeae
cacccacggcgcattcggcg

SEQ ID NO: 52858 - DNA, 20 bp, Neisseria gonorrhoeae
ggcgcactggcacacggcat

SEQ ID NO: 52859 - DNA, 20 bp, Neisseria gonorrhoeae
ggcgcgctacctattgcagg

SEQ ID NO: 52860 - DNA, 20 bp, Neisseria gonorrhoeae
gcgcgctacctattgcagga

SEQ ID NO: 52861 - DNA, 20 bp, Neisseria gonorrhoeae
caggagttcggcagcttggg

SEQ ID NO: 52862 - DNA, 20 bp, Neisseria gonorrhoeae
ggcagcttggggaggctgat

SEQ ID NO: 52863 - DNA, 20 bp, Neisseria gonorrhoeae
gggaggctgatgagcgcgga

SEQ ID NO: 52864 - DNA, 20 bp, Neisseria gonorrhoeae
tctatccgtccgcaccgcaa

SEQ ID NO: 52865 - DNA, 20 bp, Neisseria gonorrhoeae
aggtagtgcagcgcatcgcc

SEQ ID NO: 52866 - DNA, 20 bp, Neisseria gonorrhoeae
gcggtgcggacggatagaca

SEQ ID NO: 52867 - DNA, 20 bp, Neisseria gonorrhoeae
cggtgcggacggatagacaa

SEQ ID NO: 52868 - DNA, 20 bp, Neisseria gonorrhoeae
gcccgcgggcagggattggt

SEQ ID NO: 52869 - DNA, 20 bp, Neisseria gonorrhoeae
gtggaaacccataatggcac

SEQ ID NO: 52870 - DNA, 20 bp, Neisseria gonorrhoeae
tggaaacccataatggcacg

SEQ ID NO: 52871 - DNA, 20 bp, Neisseria gonorrhoeae
gtgcgtgccattatgggttt

SEQ ID NO: 52872 - DNA, 20 bp, Neisseria gonorrhoeae
tgggtttccacaaagtcgga

SEQ ID NO: 52873 - DNA, 20 bp, Neisseria gonorrhoeae
ccacaaagtcggattggact

SEQ ID NO: 52874 - DNA, 20 bp, Neisseria gonorrhoeae
ccgccgccatcatcatgacc

SEQ ID NO: 52875 - DNA, 20 bp, Neisseria gonorrhoeae
atcgccggcatttacagcct

SEQ ID NO: 52876 - DNA, 20 bp, Neisseria gonorrhoeae
acagcctcgccaccaacgca

SEQ ID NO: 52877 - DNA, 20 bp, Neisseria gonorrhoeae
cagcctcgccaccaacgcag

SEQ ID NO: 52878 - DNA, 20 bp, Neisseria gonorrhoeae
gaaatacatcccctgccctg

SEQ ID NO: 52879 - DNA, 20 bp, Neisseria gonorrhoeae
tatgttgctgtgggggccgc

SEQ ID NO: 52880 - DNA, 20 bp, Neisseria gonorrhoeae
ctgtgggggccgccgggcgt

SEQ ID NO: 52881 - DNA, 20 bp, Neisseria gonorrhoeae
gcgcggattttggcgcagag

SEQ ID NO: 52882 - DNA, 20 bp, Neisseria gonorrhoeae
tggcgcagagtttcaatgcc

SEQ ID NO: 52883 - DNA, 20 bp, Neisseria gonorrhoeae
ggcgcagagtttcaatgccc

SEQ ID NO: 52884 - DNA, 20 bp, Neisseria gonorrhoeae
ctcgccgacagcttgggcgc

SEQ ID NO: 52885 - DNA, 20 bp, Neisseria gonorrhoeae
tcgccgacagcttgggcgcg

SEQ ID NO: 52886 - DNA, 20 bp, Neisseria gonorrhoeae
ggcgcgcaaatccgccgttt

SEQ ID NO: 52887 - DNA, 20 bp, Neisseria gonorrhoeae
cgacaaaggcggcgagagtt

SEQ ID NO: 52888 - DNA, 20 bp, Neisseria gonorrhoeae
gacaaaggcggcgagagttt

SEQ ID NO: 52889 - DNA, 20 bp, Neisseria gonorrhoeae
gtcaaagaaaacgccagcga

SEQ ID NO: 52890 - DNA, 20 bp, Neisseria gonorrhoeae
cgcaggtggacgggcacttc

SEQ ID NO: 52891 - DNA, 20 bp, Neisseria gonorrhoeae
gtcgctggcgttttctttga

SEQ ID NO: 52892 - DNA, 20 bp, Neisseria gonorrhoeae
tctttgacgaagcggcgcat

SEQ ID NO: 52893 - DNA, 20 bp, Neisseria gonorrhoeae
ctttgacgaagcggcgcatt

SEQ ID NO: 52894 - DNA, 20 bp, Neisseria gonorrhoeae
cggcctgttggacgcgatca

SEQ ID NO: 52895 - DNA, 20 bp, Neisseria gonorrhoeae
ggcctgttggacgcgatcaa

SEQ ID NO: 52896 - DNA, 20 bp, Neisseria gonorrhoeae
gacgcgatcaagggctttgg

SEQ ID NO: 52897 - DNA, 20 bp, Neisseria gonorrhoeae
gggcagcgaccaggaatggc

SEQ ID NO: 52898 - DNA, 20 bp, Neisseria gonorrhoeae
ggcagcgaccaggaatggcg

SEQ ID NO: 52899 - DNA, 20 bp, Neisseria gonorrhoeae
atgatttcgcagatgacggc

SEQ ID NO: 52900 - DNA, 20 bp, Neisseria gonorrhoeae
cgcagatgacggcggcggga

SEQ ID NO: 52901 - DNA, 20 bp, Neisseria gonorrhoeae
gcagatgacggcggcgggaa

SEQ ID NO: 52902 - DNA, 20 bp, Neisseria gonorrhoeae
atttgcgccaagtcgacgcc

SEQ ID NO: 52903 - DNA, 20 bp, Neisseria gonorrhoeae
gcgccaagtcgacgccggct

SEQ ID NO: 52904 - DNA, 20 bp, Neisseria gonorrhoeae
ttgtcggcaggaacagagga

SEQ ID NO: 52905 - DNA, 20 bp, Neisseria gonorrhoeae
tcggcaggaacagaggattt

SEQ ID NO: 52906 - DNA, 20 bp, Neisseria gonorrhoeae
agccgtttcaggcagcctga

SEQ ID NO: 52907 - DNA, 20 bp, Neisseria gonorrhoeae
gccgtttcaggcagcctgaa

SEQ ID NO: 52908 - DNA, 20 bp, Neisseria gonorrhoeae
caggcagcctgaacaatcaa

SEQ ID NO: 52909 - DNA, 20 bp, Neisseria gonorrhoeae
atgagtgcaggtatcggctt

SEQ ID NO: 52910 - DNA, 20 bp, Neisseria gonorrhoeae
actattggcagcaagacaaa

SEQ ID NO: 52911 - DNA, 20 bp, Neisseria gonorrhoeae
gcagcaagacaaacacacaa

SEQ ID NO: 52912 - DNA, 20 bp, Neisseria gonorrhoeae
gttttcttgtgtgtttgtct

SEQ ID NO: 52913 - DNA, 20 bp, Neisseria gonorrhoeae
tcttgtgtgtttgtcttgct

SEQ ID NO: 52914 - DNA, 20 bp, Neisseria gonorrhoeae
ggtgcgggcgggtcggaagc

SEQ ID NO: 52915 - DNA, 20 bp, Neisseria gonorrhoeae
ttcctccgcattcaggctgc

SEQ ID NO: 52916 - DNA, 20 bp, Neisseria gonorrhoeae
tcctccgcattcaggctgcc

SEQ ID NO: 52917 - DNA, 20 bp, Neisseria gonorrhoeae
cctccgcattcaggctgccg

SEQ ID NO: 52918 - DNA, 20 bp, Neisseria gonorrhoeae
ctccgcattcaggctgccgc

SEQ ID NO: 52919 - DNA, 20 bp, Neisseria gonorrhoeae
cgcgcgcggccgtaatagcc

SEQ ID NO: 52920 - DNA, 20 bp, Neisseria gonorrhoeae
gtcttgcggcgcggcggcaa

SEQ ID NO: 52921 - DNA, 20 bp, Neisseria gonorrhoeae
cggcgcggcggcaagcgtct

SEQ ID NO: 52922 - DNA, 20 bp, Neisseria gonorrhoeae
cttggaaaaattcccgaccg

SEQ ID NO: 52923 - DNA, 20 bp, Neisseria gonorrhoeae
ttggaaaaattcccgaccgt

SEQ ID NO: 52924 - DNA, 20 bp, Neisseria gonorrhoeae
attgcaggtgccggccctgt

SEQ ID NO: 52925 - DNA, 20 bp, Neisseria gonorrhoeae
caggtgccggccctgtcggt

SEQ ID NO: 52926 - DNA, 20 bp, Neisseria gonorrhoeae
cacatcgccgtattgcacgc

SEQ ID NO: 52927 - DNA, 20 bp, Neisseria gonorrhoeae
acatcgccgtattgcacgcc

SEQ ID NO: 52928 - DNA, 20 bp, Neisseria gonorrhoeae
cacgccgatttcgtgggcgg

SEQ ID NO: 52929 - DNA, 20 bp, Neisseria gonorrhoeae
gccgccaacgacttcggcag

SEQ ID NO: 52930 - DNA, 20 bp, Neisseria gonorrhoeae
ccgccaacgacttcggcagg

SEQ ID NO: 52931 - DNA, 20 bp, Neisseria gonorrhoeae
ggcagggaagagtttgagtg

SEQ ID NO: 52932 - DNA, 20 bp, Neisseria gonorrhoeae
gagtgtgtcgatgccgtgtt

SEQ ID NO: 52933 - DNA, 20 bp, Neisseria gonorrhoeae
agtgtgtcgatgccgtgttc

SEQ ID NO: 52934 - DNA, 20 bp, Neisseria gonorrhoeae
gcggccgcagccttgttggt

SEQ ID NO: 52935 - DNA, 20 bp, Neisseria gonorrhoeae
ttggttcgcgcccaaatcga

SEQ ID NO: 52936 - DNA, 20 bp, Neisseria gonorrhoeae
gttcgcgcccaaatcgatgc

SEQ ID NO: 52937 - DNA, 20 bp, Neisseria gonorrhoeae
gcgcccaaatcgatgcgctc

SEQ ID NO: 52938 - DNA, 20 bp, Neisseria gonorrhoeae
tcggacgttccattcggcct

SEQ ID NO: 52939 - DNA, 20 bp, Neisseria gonorrhoeae
gcctgacgcgccggacatac

SEQ ID NO: 52940 - DNA, 20 bp, Neisseria gonorrhoeae
cctgacgcgccggacatacg

SEQ ID NO: 52941 - DNA, 20 bp, Neisseria gonorrhoeae
gaagccgcggtcttgcagga

SEQ ID NO: 52942 - DNA, 20 bp, Neisseria gonorrhoeae
aagccgcggtcttgcaggat

SEQ ID NO: 52943 - DNA, 20 bp, Neisseria gonorrhoeae
ggcatcctgcaagaccgcgg

SEQ ID NO: 52944 - DNA, 20 bp, Neisseria gonorrhoeae
caactcgccgcgttcaaatg

SEQ ID NO: 52945 - DNA, 20 bp, Neisseria gonorrhoeae
aaatgccgccaacacttcgc

SEQ ID NO: 52946 - DNA, 20 bp, Neisseria gonorrhoeae
gcgctggtcgttgaacacga

SEQ ID NO: 52947 - DNA, 20 bp, Neisseria gonorrhoeae
aacacgatggcgggtgcttc

SEQ ID NO: 52948 - DNA, 20 bp, Neisseria gonorrhoeae
gatgatgcggcagccttcgc

SEQ ID NO: 52949 - DNA, 20 bp, Neisseria gonorrhoeae
gcgcgcgacggcaacaagtg

SEQ ID NO: 52950 - DNA, 20 bp, Neisseria gonorrhoeae
agacggcatcgggttcgcaa

SEQ ID NO: 52951 - DNA, 20 bp, Neisseria gonorrhoeae
gcaatgccgtctgaaggagg

SEQ ID NO: 52952 - DNA, 20 bp, Neisseria gonorrhoeae
agacggcattgcgaacccga

SEQ ID NO: 52953 - DNA, 20 bp, Neisseria gonorrhoeae
cgaacccgatgccgtctgaa

SEQ ID NO: 52954 - DNA, 20 bp, Neisseria gonorrhoeae
gtctccaacgtggacggctc

SEQ ID NO: 52955 - DNA, 20 bp, Neisseria gonorrhoeae
tccaaagtccacccggaaac

SEQ ID NO: 52956 - DNA, 20 bp, Neisseria gonorrhoeae
ccgggtggactttggacaat

SEQ ID NO: 52957 - DNA, 20 bp, Neisseria gonorrhoeae
cgggtggactttggacaata

SEQ ID NO: 52958 - DNA, 20 bp, Neisseria gonorrhoeae
ggacaatacgtcgcgcagtt

SEQ ID NO: 52959 - DNA, 20 bp, Neisseria gonorrhoeae
cctcgcttgaaaaacgcagc

SEQ ID NO: 52960 - DNA, 20 bp, Neisseria gonorrhoeae
aaaaacgcagcaacctgccc

SEQ ID NO: 52961 - DNA, 20 bp, Neisseria gonorrhoeae
ccaacgtctttgcacaagca

SEQ ID NO: 52962 - DNA, 20 bp, Neisseria gonorrhoeae
gcacaagcagaagcctttat

SEQ ID NO: 52963 - DNA, 20 bp, Neisseria gonorrhoeae
cacaagcagaagcctttatg

SEQ ID NO: 52964 - DNA, 20 bp, Neisseria gonorrhoeae
gggttccggattcccgcttt

SEQ ID NO: 52965 - DNA, 20 bp, Neisseria gonorrhoeae
ggttccggattcccgctttc

SEQ ID NO: 52966 - DNA, 20 bp, Neisseria gonorrhoeae
cggattcccgctttcgcggg

SEQ ID NO: 52967 - DNA, 20 bp, Neisseria gonorrhoeae
ccgctttcgcgggaatggcg

SEQ ID NO: 52968 - DNA, 20 bp, Neisseria gonorrhoeae
cgcgggaatggcgaagagtg

SEQ ID NO: 52969 - DNA, 20 bp, Neisseria gonorrhoeae
cgccagccttgacgcgtcca

SEQ ID NO: 52970 - DNA, 20 bp, Neisseria gonorrhoeae
acgcgtccagtgcgccgacg

SEQ ID NO: 52971 - DNA, 20 bp, Neisseria gonorrhoeae
gcggtttcgccgtgggactt

SEQ ID NO: 52972 - DNA, 20 bp, Neisseria gonorrhoeae
cgccgtgggactttatccgg

SEQ ID NO: 52973 - DNA, 20 bp, Neisseria gonorrhoeae
gccgtgggactttatccgga

SEQ ID NO: 52974 - DNA, 20 bp, Neisseria gonorrhoeae
ggcgatgtgggcgagggtgt

SEQ ID NO: 52975 - DNA, 20 bp, Neisseria gonorrhoeae
cccgcgtccgttttctgcgt

SEQ ID NO: 52976 - DNA, 20 bp, Neisseria gonorrhoeae
tctgcgtcggtcattggggt

SEQ ID NO: 52977 - DNA, 20 bp, Neisseria gonorrhoeae
ctgcgtcggtcattggggtt

SEQ ID NO: 52978 - DNA, 20 bp, Neisseria gonorrhoeae
tgcgtcggtcattggggttt

SEQ ID NO: 52979 - DNA, 20 bp, Neisseria gonorrhoeae
gggcggcatagatatggtag

SEQ ID NO: 52980 - DNA, 20 bp, Neisseria gonorrhoeae
cgtagccgcactcgtcccca

SEQ ID NO: 52981 - DNA, 20 bp, Neisseria gonorrhoeae
gatttcggctttggggacga

SEQ ID NO: 52982 - DNA, 20 bp, Neisseria gonorrhoeae
cggctttggggacgagtgcg

SEQ ID NO: 52983 - DNA, 20 bp, Neisseria gonorrhoeae
ggctttggggacgagtgcgg

SEQ ID NO: 52984 - DNA, 20 bp, Neisseria gonorrhoeae
ttttccgatagattcctgtg

SEQ ID NO: 52985 - DNA, 20 bp, Neisseria gonorrhoeae
tttccgatagattcctgtgg

SEQ ID NO: 52986 - DNA, 20 bp, Neisseria gonorrhoeae
ttccgatagattcctgtggt

SEQ ID NO: 52987 - DNA, 20 bp, Neisseria gonorrhoeae
tccgatagattcctgtggtt

SEQ ID NO: 52988 - DNA, 20 bp, Neisseria gonorrhoeae
ccgatagattcctgtggttt

SEQ ID NO: 52989 - DNA, 20 bp, Neisseria gonorrhoeae
tgcccacgccgcgcgtcccg

SEQ ID NO: 52990 - DNA, 20 bp, Neisseria gonorrhoeae
gcccacgccgcgcgtcccgg

SEQ ID NO: 52991 - DNA, 20 bp, Neisseria gonorrhoeae
cccacgccgcgcgtcccggt

SEQ ID NO: 52992 - DNA, 20 bp, Neisseria gonorrhoeae
gtccaaggcattttgcaggg

SEQ ID NO: 52993 - DNA, 20 bp, Neisseria gonorrhoeae
gacgaaggcaggctgcacca

SEQ ID NO: 52994 - DNA, 20 bp, Neisseria gonorrhoeae
gcgcgtgtgtcggcaagggc

SEQ ID NO: 52995 - DNA, 20 bp, Neisseria gonorrhoeae
gttgagcgtgtggaacacga

SEQ ID NO: 52996 - DNA, 20 bp, Neisseria gonorrhoeae
ttgagcgtgtggaacacgag

SEQ ID NO: 52997 - DNA, 20 bp, Neisseria gonorrhoeae
agcgtgtggaacacgagttg

SEQ ID NO: 52998 - DNA, 20 bp, Neisseria gonorrhoeae
gtgtacttgccggctgtcgc

SEQ ID NO: 52999 - DNA, 20 bp, Neisseria gonorrhoeae
acggcatggagcatgacttt

SEQ ID NO: 53000 - DNA, 20 bp, Neisseria gonorrhoeae
gtcgcggacaaaacgatggt

SEQ ID NO: 53001 - DNA, 20 bp, Neisseria gonorrhoeae
tcgcggacaaaacgatggtt

SEQ ID NO: 53002 - DNA, 20 bp, Neisseria gonorrhoeae
acgaagcaatattgtttatc

SEQ ID NO: 53003 - DNA, 20 bp, Neisseria gonorrhoeae
cttcgtcaaccatcgttttg

SEQ ID NO: 53004 - DNA, 20 bp, Neisseria gonorrhoeae
cggatgcccggcagtggcag

SEQ ID NO: 53005 - DNA, 20 bp, Neisseria gonorrhoeae
cggcccgctttcggcattgt

SEQ ID NO: 53006 - DNA, 20 bp, Neisseria gonorrhoeae
ggcccgctttcggcattgtg

SEQ ID NO: 53007 - DNA, 20 bp, Neisseria gonorrhoeae
cggcattgtgtaccgcagcc

SEQ ID NO: 53008 - DNA, 20 bp, Neisseria gonorrhoeae
ggcattgtgtaccgcagcca

SEQ ID NO: 53009 - DNA, 20 bp, Neisseria gonorrhoeae
gcgatgcggggcgtgccgcg

SEQ ID NO: 53010 - DNA, 20 bp, Neisseria gonorrhoeae
ggcgacttccatcgcgcctt

SEQ ID NO: 53011 - DNA, 20 bp, Neisseria gonorrhoeae
gcgacttccatcgcgccttc

SEQ ID NO: 53012 - DNA, 20 bp, Neisseria gonorrhoeae
catcgcgccttcttcgtcca

SEQ ID NO: 53013 - DNA, 20 bp, Neisseria gonorrhoeae
cgccgcgtgcgcgatttcgc

SEQ ID NO: 53014 - DNA, 20 bp, Neisseria gonorrhoeae
gtgccagccgcgcccggtcg

SEQ ID NO: 53015 - DNA, 20 bp, Neisseria gonorrhoeae
tgccagccgcgcccggtcga

SEQ ID NO: 53016 - DNA, 20 bp, Neisseria gonorrhoeae
gttcggcgataaggtgcgct

SEQ ID NO: 53017 - DNA, 20 bp, Neisseria gonorrhoeae
ttcggcgataaggtgcgctt

SEQ ID NO: 53018 - DNA, 20 bp, Neisseria gonorrhoeae
ggcgataaggtgcgcttttc

SEQ ID NO: 53019 - DNA, 20 bp, Neisseria gonorrhoeae
gtcgttttccaccatctgcc

SEQ ID NO: 53020 - DNA, 20 bp, Neisseria gonorrhoeae
tccaccatctgccgcatcag

SEQ ID NO: 53021 - DNA, 20 bp, Neisseria gonorrhoeae
ccaccatctgccgcatcagc

SEQ ID NO: 53022 - DNA, 20 bp, Neisseria gonorrhoeae
caccatctgccgcatcagct

SEQ ID NO: 53023 - DNA, 20 bp, Neisseria gonorrhoeae
atggtttcttcggcgatttc

SEQ ID NO: 53024 - DNA, 20 bp, Neisseria gonorrhoeae
cccgtgccgccgtatcgggc

SEQ ID NO: 53025 - DNA, 20 bp, Neisseria gonorrhoeae
tttgaccggtttccggacga

SEQ ID NO: 53026 - DNA, 20 bp, Neisseria gonorrhoeae
gaccggtttccggacgaact

SEQ ID NO: 53027 - DNA, 20 bp, Neisseria gonorrhoeae
accggtttccggacgaactg

SEQ ID NO: 53028 - DNA, 20 bp, Neisseria gonorrhoeae
ccggacgaactggaacattc

SEQ ID NO: 53029 - DNA, 20 bp, Neisseria gonorrhoeae
gaaatttgaaacatcaaaca

SEQ ID NO: 53030 - DNA, 20 bp, Neisseria gonorrhoeae
gaaacatcaaacaaatttgc

SEQ ID NO: 53031 - DNA, 20 bp, Neisseria gonorrhoeae
aaacatcaaacaaatttgca

SEQ ID NO: 53032 - DNA, 20 bp, Neisseria gonorrhoeae
gcagcattcgcaggcttaag

SEQ ID NO: 53033 - DNA, 20 bp, Neisseria gonorrhoeae
cagcattcgcaggcttaagc

SEQ ID NO: 53034 - DNA, 20 bp, Neisseria gonorrhoeae
ccgaaagtgaaaaccgcatc

SEQ ID NO: 53035 - DNA, 20 bp, Neisseria gonorrhoeae
ccggtttggcttggacggaa

SEQ ID NO: 53036 - DNA, 20 bp, Neisseria gonorrhoeae
ggcttggacggaagtcggcg

SEQ ID NO: 53037 - DNA, 20 bp, Neisseria gonorrhoeae
gcttggacggaagtcggcgg

SEQ ID NO: 53038 - DNA, 20 bp, Neisseria gonorrhoeae
gacggaagtcggcggcgaat

SEQ ID NO: 53039 - DNA, 20 bp, Neisseria gonorrhoeae
ggagagcagggcggttgaag

SEQ ID NO: 53040 - DNA, 20 bp, Neisseria gonorrhoeae
aagcgagcaacgccaaaatg

SEQ ID NO: 53041 - DNA, 20 bp, Neisseria gonorrhoeae
tggcttttgcttttttgcgc

SEQ ID NO: 53042 - DNA, 20 bp, Neisseria gonorrhoeae
ggcttttgcttttttgcgcg

SEQ ID NO: 53043 - DNA, 20 bp, Neisseria gonorrhoeae
gcttttgcttttttgcgcgc

SEQ ID NO: 53044 - DNA, 20 bp, Neisseria gonorrhoeae
gatagacaggaagtccattt

SEQ ID NO: 53045 - DNA, 20 bp, Neisseria gonorrhoeae
tgtccttggtcatagtgact

SEQ ID NO: 53046 - DNA, 20 bp, Neisseria gonorrhoeae
gtccttggtcatagtgactg

SEQ ID NO: 53047 - DNA, 20 bp, Neisseria gonorrhoeae
tccttggtcatagtgactgg

SEQ ID NO: 53048 - DNA, 20 bp, Neisseria gonorrhoeae
gtcatagtgactgggttatc

SEQ ID NO: 53049 - DNA, 20 bp, Neisseria gonorrhoeae
ccataatggtttcaatgaat

SEQ ID NO: 53050 - DNA, 20 bp, Neisseria gonorrhoeae
cataatggtttcaatgaatg

SEQ ID NO: 53051 - DNA, 20 bp, Neisseria gonorrhoeae
caatgaatggtttacgcttg

SEQ ID NO: 53052 - DNA, 20 bp, Neisseria gonorrhoeae
aatgaatggtttacgcttgg

SEQ ID NO: 53053 - DNA, 20 bp, Neisseria gonorrhoeae
acgcttggcggttgagaagc

SEQ ID NO: 53054 - DNA, 20 bp, Neisseria gonorrhoeae
tggcaagccattgtctgaca

SEQ ID NO: 53055 - DNA, 20 bp, Neisseria gonorrhoeae
tctgacatgtgaaggaacca

SEQ ID NO: 53056 - DNA, 20 bp, Neisseria gonorrhoeae
aaagaatgtccaggcgattt

SEQ ID NO: 53057 - DNA, 20 bp, Neisseria gonorrhoeae
cggcatgtgtactgtaagca

SEQ ID NO: 53058 - DNA, 20 bp, Neisseria gonorrhoeae
ggcatgtgtactgtaagcag

SEQ ID NO: 53059 - DNA, 20 bp, Neisseria gonorrhoeae
cggatttgaaaggtatcaag

SEQ ID NO: 53060 - DNA, 20 bp, Neisseria gonorrhoeae
gaaaggtatcaagcaccgtg

SEQ ID NO: 53061 - DNA, 20 bp, Neisseria gonorrhoeae
aaaggtatcaagcaccgtgt

SEQ ID NO: 53062 - DNA, 20 bp, Neisseria gonorrhoeae
gtgattacggaaatgcaaaa

SEQ ID NO: 53063 - DNA, 20 bp, Neisseria gonorrhoeae
cggaaatgcaaaaatcaagg

SEQ ID NO: 53064 - DNA, 20 bp, Neisseria gonorrhoeae
ttacggtagccacagtagtc

SEQ ID NO: 53065 - DNA, 20 bp, Neisseria gonorrhoeae
tacggtagccacagtagtcc

SEQ ID NO: 53066 - DNA, 20 bp, Neisseria gonorrhoeae
acggtagccacagtagtcca

SEQ ID NO: 53067 - DNA, 20 bp, Neisseria gonorrhoeae
cggtagccacagtagtccaa

SEQ ID NO: 53068 - DNA, 20 bp, Neisseria gonorrhoeae
cacgggcaataacttcccct

SEQ ID NO: 53069 - DNA, 20 bp, Neisseria gonorrhoeae
ggcattgcgtttgaaattag

SEQ ID NO: 53070 - DNA, 20 bp, Neisseria gonorrhoeae
cgtttgaaattaggtgaggc

SEQ ID NO: 53071 - DNA, 20 bp, Neisseria gonorrhoeae
gaaattaggtgaggcaactg

SEQ ID NO: 53072 - DNA, 20 bp, Neisseria gonorrhoeae
aaattaggtgaggcaactga

SEQ ID NO: 53073 - DNA, 20 bp, Neisseria gonorrhoeae
ggtgaggcaactgaaaaatt

SEQ ID NO: 53074 - DNA, 20 bp, Neisseria gonorrhoeae
tgattcatacacccaaacag

SEQ ID NO: 53075 - DNA, 20 bp, Neisseria gonorrhoeae
atacacccaaacagacaatg

SEQ ID NO: 53076 - DNA, 20 bp, Neisseria gonorrhoeae
taggcagaatctcttgctca

SEQ ID NO: 53077 - DNA, 20 bp, Neisseria gonorrhoeae
ctcaacagcagatttcaact

SEQ ID NO: 53078 - DNA, 20 bp, Neisseria gonorrhoeae
tcgaagttgaaatctgctgt

SEQ ID NO: 53079 - DNA, 20 bp, Neisseria gonorrhoeae
ggcttctttcggctcatcct

SEQ ID NO: 53080 - DNA, 20 bp, Neisseria gonorrhoeae
tttcggctcatcctctgcat

SEQ ID NO: 53081 - DNA, 20 bp, Neisseria gonorrhoeae
cggctcatcctctgcatcag

SEQ ID NO: 53082 - DNA, 20 bp, Neisseria gonorrhoeae
ggctcatcctctgcatcagc

SEQ ID NO: 53083 - DNA, 20 bp, Neisseria gonorrhoeae
agtaccatttactttggctg

SEQ ID NO: 53084 - DNA, 20 bp, Neisseria gonorrhoeae
gggggcggtgttggagccga

SEQ ID NO: 53085 - DNA, 20 bp, Neisseria gonorrhoeae
gagccgaatatcaaaagctg

SEQ ID NO: 53086 - DNA, 20 bp, Neisseria gonorrhoeae
ggatagcgaaggcgcaaggc

SEQ ID NO: 53087 - DNA, 20 bp, Neisseria gonorrhoeae
gatagcgaaggcgcaaggct

SEQ ID NO: 53088 - DNA, 20 bp, Neisseria gonorrhoeae
cgccttcgctatccaaagca

SEQ ID NO: 53089 - DNA, 20 bp, Neisseria gonorrhoeae
gaaaaacaagacatcctcta

SEQ ID NO: 53090 - DNA, 20 bp, Neisseria gonorrhoeae
aaaaacaagacatcctctac

SEQ ID NO: 53091 - DNA, 20 bp, Neisseria gonorrhoeae
ccgccttcttccacgacatc

SEQ ID NO: 53092 - DNA, 20 bp, Neisseria gonorrhoeae
ttccacgacatcgccaaagg

SEQ ID NO: 53093 - DNA, 20 bp, Neisseria gonorrhoeae
cacgacatcgccaaaggacg

SEQ ID NO: 53094 - DNA, 20 bp, Neisseria gonorrhoeae
ggatttggttgccgccggcg

SEQ ID NO: 53095 - DNA, 20 bp, Neisseria gonorrhoeae
gatttggttgccgccggcgc

SEQ ID NO: 53096 - DNA, 20 bp, Neisseria gonorrhoeae
ggttgccgccggcgcggatg

SEQ ID NO: 53097 - DNA, 20 bp, Neisseria gonorrhoeae
gttgccgccggcgcggatgc

SEQ ID NO: 53098 - DNA, 20 bp, Neisseria gonorrhoeae
ccgccggcgcggatgccgtc

SEQ ID NO: 53099 - DNA, 20 bp, Neisseria gonorrhoeae
ccgaagccctcaaaggcacg

SEQ ID NO: 53100 - DNA, 20 bp, Neisseria gonorrhoeae
cgctgattgccgacggcggc

SEQ ID NO: 53101 - DNA, 20 bp, Neisseria gonorrhoeae
ccgacggcggcatccgcttc

SEQ ID NO: 53102 - DNA, 20 bp, Neisseria gonorrhoeae
tccggcgacatcgccaaagc

SEQ ID NO: 53103 - DNA, 20 bp, Neisseria gonorrhoeae
ggcgatgtcgccggagaagc

SEQ ID NO: 53104 - DNA, 20 bp, Neisseria gonorrhoeae
cttgggcgcgatgagccaag

SEQ ID NO: 53105 - DNA, 20 bp, Neisseria gonorrhoeae
ggcgcgatgagccaaggttc

SEQ ID NO: 53106 - DNA, 20 bp, Neisseria gonorrhoeae
tgccgaccgctacttccaag

SEQ ID NO: 53107 - DNA, 20 bp, Neisseria gonorrhoeae
caagacaaaaccgacagcac

SEQ ID NO: 53108 - DNA, 20 bp, Neisseria gonorrhoeae
gtcggtgctgtcggttttgt

SEQ ID NO: 53109 - DNA, 20 bp, Neisseria gonorrhoeae
ccgaggctatcaggggcgca

SEQ ID NO: 53110 - DNA, 20 bp, Neisseria gonorrhoeae
cgaggctatcaggggcgcat

SEQ ID NO: 53111 - DNA, 20 bp, Neisseria gonorrhoeae
ggtcaccgtcgggcaaaccg

SEQ ID NO: 53112 - DNA, 20 bp, Neisseria gonorrhoeae
ggttcgatgcggacggtttg

SEQ ID NO: 53113 - DNA, 20 bp, Neisseria gonorrhoeae
gatgcggacggtttgcccga

SEQ ID NO: 53114 - DNA, 20 bp, Neisseria gonorrhoeae
cggcgatttcgccatacgga

SEQ ID NO: 53115 - DNA, 20 bp, Neisseria gonorrhoeae
ggcgatttcgccatacggac

SEQ ID NO: 53116 - DNA, 20 bp, Neisseria gonorrhoeae
cgccatacggacgggcatcg

SEQ ID NO: 53117 - DNA, 20 bp, Neisseria gonorrhoeae
gccatacggacgggcatcgt

SEQ ID NO: 53118 - DNA, 20 bp, Neisseria gonorrhoeae
gatgcgcccgtcgatttttg

SEQ ID NO: 53119 - DNA, 20 bp, Neisseria gonorrhoeae
gtctccggcggcccgatgga

SEQ ID NO: 53120 - DNA, 20 bp, Neisseria gonorrhoeae
gggttggatgtttgccacgc

SEQ ID NO: 53121 - DNA, 20 bp, Neisseria gonorrhoeae
gatgtttgccacgccgatga

SEQ ID NO: 53122 - DNA, 20 bp, Neisseria gonorrhoeae
gccacgccgatgaccttgcc

SEQ ID NO: 53123 - DNA, 20 bp, Neisseria gonorrhoeae
ccacgccgatgaccttgccc

SEQ ID NO: 53124 - DNA, 20 bp, Neisseria gonorrhoeae
gggtatgtttacggcaaact

SEQ ID NO: 53125 - DNA, 20 bp, Neisseria gonorrhoeae
acggcaaactcgatgaactg

SEQ ID NO: 53126 - DNA, 20 bp, Neisseria gonorrhoeae
cggcaaactcgatgaactgc

SEQ ID NO: 53127 - DNA, 20 bp, Neisseria gonorrhoeae
gtatttggcgacccacgcag

SEQ ID NO: 53128 - DNA, 20 bp, Neisseria gonorrhoeae
ccgggcagggacagaccgag

SEQ ID NO: 53129 - DNA, 20 bp, Neisseria gonorrhoeae
accggccgcgcgcgcgtgtt

SEQ ID NO: 53130 - DNA, 20 bp, Neisseria gonorrhoeae
ctggctttcaaacacgcgcg

SEQ ID NO: 53131 - DNA, 20 bp, Neisseria gonorrhoeae
caaacacgcgcgcgcggccg

SEQ ID NO: 53132 - DNA, 20 bp, Neisseria gonorrhoeae
aaacacgcgcgcgcggccgg

SEQ ID NO: 53133 - DNA, 20 bp, Neisseria gonorrhoeae
gaggatgctctcgtccacgc

SEQ ID NO: 53134 - DNA, 20 bp, Neisseria gonorrhoeae
catggtgttggaacgcggct

SEQ ID NO: 53135 - DNA, 20 bp, Neisseria gonorrhoeae
atggtgttggaacgcggctc

SEQ ID NO: 53136 - DNA, 20 bp, Neisseria gonorrhoeae
gaacgcggctcgaggacggc

SEQ ID NO: 53137 - DNA, 20 bp, Neisseria gonorrhoeae
gcgcaaaccttgaatcgtgg

SEQ ID NO: 53138 - DNA, 20 bp, Neisseria gonorrhoeae
aatcgtggtttcgatggcgg

SEQ ID NO: 53139 - DNA, 20 bp, Neisseria gonorrhoeae
caagacccaggcgagcatgg

SEQ ID NO: 53140 - DNA, 20 bp, Neisseria gonorrhoeae
gaatatgccggactcgcgcc

SEQ ID NO: 53141 - DNA, 20 bp, Neisseria gonorrhoeae
ctcatcggcggtgtaccgga

SEQ ID NO: 53142 - DNA, 20 bp, Neisseria gonorrhoeae
cctttcggattttggacggc

SEQ ID NO: 53143 - DNA, 20 bp, Neisseria gonorrhoeae
cggattttggacggcttcgt

SEQ ID NO: 53144 - DNA, 20 bp, Neisseria gonorrhoeae
ggattttggacggcttcgtc

SEQ ID NO: 53145 - DNA, 20 bp, Neisseria gonorrhoeae
tggacggcttcgtccctcac

SEQ ID NO: 53146 - DNA, 20 bp, Neisseria gonorrhoeae
ggacggcttcgtccctcacc

SEQ ID NO: 53147 - DNA, 20 bp, Neisseria gonorrhoeae
ggcgaccacgcgtccgcaca

SEQ ID NO: 53148 - DNA, 20 bp, Neisseria gonorrhoeae
tgggcaggggttgtgcggac

SEQ ID NO: 53149 - DNA, 20 bp, Neisseria gonorrhoeae
gggcaggggttgtgcggacg

SEQ ID NO: 53150 - DNA, 20 bp, Neisseria gonorrhoeae
ggcaggggttgtgcggacgc

SEQ ID NO: 53151 - DNA, 20 bp, Neisseria gonorrhoeae
tgcggacgcgtggtcgccca

SEQ ID NO: 53152 - DNA, 20 bp, Neisseria gonorrhoeae
tcgggatgttctttttcttc

SEQ ID NO: 53153 - DNA, 20 bp, Neisseria gonorrhoeae
cgggatgttctttttcttca

SEQ ID NO: 53154 - DNA, 20 bp, Neisseria gonorrhoeae
gggatgttctttttcttcat

SEQ ID NO: 53155 - DNA, 20 bp, Neisseria gonorrhoeae
tttttcttcatacaccggca

SEQ ID NO: 53156 - DNA, 20 bp, Neisseria gonorrhoeae
ttcttcatacaccggcaata

SEQ ID NO: 53157 - DNA, 20 bp, Neisseria gonorrhoeae
acggcatcggtcaggctttc

SEQ ID NO: 53158 - DNA, 20 bp, Neisseria gonorrhoeae
cggcttcgaccacggcttcg

SEQ ID NO: 53159 - DNA, 20 bp, Neisseria gonorrhoeae
ggcttcgaccacggcttcgg

SEQ ID NO: 53160 - DNA, 20 bp, Neisseria gonorrhoeae
gaccacggcttcggcgcggg

SEQ ID NO: 53161 - DNA, 20 bp, Neisseria gonorrhoeae
ggcgcgggcgcgtgccgcca

SEQ ID NO: 53162 - DNA, 20 bp, Neisseria gonorrhoeae
cgcgggatgattttttccgc

SEQ ID NO: 53163 - DNA, 20 bp, Neisseria gonorrhoeae
tttccgccaagccgccgtag

SEQ ID NO: 53164 - DNA, 20 bp, Neisseria gonorrhoeae
ttccgccaagccgccgtagg

SEQ ID NO: 53165 - DNA, 20 bp, Neisseria gonorrhoeae
tccgccaagccgccgtaggt

SEQ ID NO: 53166 - DNA, 20 bp, Neisseria gonorrhoeae
ccgccaagccgccgtaggtt

SEQ ID NO: 53167 - DNA, 20 bp, Neisseria gonorrhoeae
tccagcccgtaggcgattgc

SEQ ID NO: 53168 - DNA, 20 bp, Neisseria gonorrhoeae
cggcggcggtaggttcgttg

SEQ ID NO: 53169 - DNA, 20 bp, Neisseria gonorrhoeae
gttgagcaggcgcaatacgt

SEQ ID NO: 53170 - DNA, 20 bp, Neisseria gonorrhoeae
agcaggcgcaatacgttcaa

SEQ ID NO: 53171 - DNA, 20 bp, Neisseria gonorrhoeae
aaaccggccagacgcgcggc

SEQ ID NO: 53172 - DNA, 20 bp, Neisseria gonorrhoeae
tggcggcggtttattacgcg

SEQ ID NO: 53173 - DNA, 20 bp, Neisseria gonorrhoeae
ttgggcttttttatcggcat

SEQ ID NO: 53174 - DNA, 20 bp, Neisseria gonorrhoeae
tgggcttttttatcggcatc

SEQ ID NO: 53175 - DNA, 20 bp, Neisseria gonorrhoeae
gggcttttttatcggcatca

SEQ ID NO: 53176 - DNA, 20 bp, Neisseria gonorrhoeae
ggcttttttatcggcatcag

SEQ ID NO: 53177 - DNA, 20 bp, Neisseria gonorrhoeae
gatgccgccatacttgccac

SEQ ID NO: 53178 - DNA, 20 bp, Neisseria gonorrhoeae
ccaccgcgccctaccacgcc

SEQ ID NO: 53179 - DNA, 20 bp, Neisseria gonorrhoeae
gggcaggagcgcggcggcgt

SEQ ID NO: 53180 - DNA, 20 bp, Neisseria gonorrhoeae
gccgttgacgaggacttttc

SEQ ID NO: 53181 - DNA, 20 bp, Neisseria gonorrhoeae
acgaggacttttccgtccgg

SEQ ID NO: 53182 - DNA, 20 bp, Neisseria gonorrhoeae
cactgaccggctgtgcgacc

SEQ ID NO: 53183 - DNA, 20 bp, Neisseria gonorrhoeae
actgaccggctgtgcgaccg

SEQ ID NO: 53184 - DNA, 20 bp, Neisseria gonorrhoeae
caaaagtcgcctcctgcaat

SEQ ID NO: 53185 - DNA, 20 bp, Neisseria gonorrhoeae
cgtattgcaggaggcgactt

SEQ ID NO: 53186 - DNA, 20 bp, Neisseria gonorrhoeae
caggaggcgacttttgcaac

SEQ ID NO: 53187 - DNA, 20 bp, Neisseria gonorrhoeae
ctgccggttttttccccttc

SEQ ID NO: 53188 - DNA, 20 bp, Neisseria gonorrhoeae
tttccccttccctgcggacg

SEQ ID NO: 53189 - DNA, 20 bp, Neisseria gonorrhoeae
ttccccttccctgcggacgg

SEQ ID NO: 53190 - DNA, 20 bp, Neisseria gonorrhoeae
tccccttccctgcggacggt

SEQ ID NO: 53191 - DNA, 20 bp, Neisseria gonorrhoeae
ccccttccctgcggacggtt

SEQ ID NO: 53192 - DNA, 20 bp, Neisseria gonorrhoeae
ggcagacataatctcgtaag

SEQ ID NO: 53193 - DNA, 20 bp, Neisseria gonorrhoeae
cgcggtgtttcagcaccccg

SEQ ID NO: 53194 - DNA, 20 bp, Neisseria gonorrhoeae
gcggtgtttcagcaccccgt

SEQ ID NO: 53195 - DNA, 20 bp, Neisseria gonorrhoeae
cagcaccccgtcctgatgga

SEQ ID NO: 53196 - DNA, 20 bp, Neisseria gonorrhoeae
agcaccccgtcctgatggat

SEQ ID NO: 53197 - DNA, 20 bp, Neisseria gonorrhoeae
cccgcctgacggatgtcccg

SEQ ID NO: 53198 - DNA, 20 bp, Neisseria gonorrhoeae
atttggtaatggttttcgca

SEQ ID NO: 53199 - DNA, 20 bp, Neisseria gonorrhoeae
ggtaatggttttcgcaatcg

SEQ ID NO: 53200 - DNA, 20 bp, Neisseria gonorrhoeae
gtaatggttttcgcaatcgc

SEQ ID NO: 53201 - DNA, 20 bp, Neisseria gonorrhoeae
tcgcaatcgcattgaccgcc

SEQ ID NO: 53202 - DNA, 20 bp, Neisseria gonorrhoeae
caatccgcacgcgccatcgt

SEQ ID NO: 53203 - DNA, 20 bp, Neisseria gonorrhoeae
aatccgcacgcgccatcgtt

SEQ ID NO: 53204 - DNA, 20 bp, Neisseria gonorrhoeae
ccgccctgaaaacggggttg

SEQ ID NO: 53205 - DNA, 20 bp, Neisseria gonorrhoeae
gtgccaaccccgttttcagg

SEQ ID NO: 53206 - DNA, 20 bp, Neisseria gonorrhoeae
tgccaaccccgttttcaggg

SEQ ID NO: 53207 - DNA, 20 bp, Neisseria gonorrhoeae
tcggcaggtgttcggatacc

SEQ ID NO: 53208 - DNA, 20 bp, Neisseria gonorrhoeae
ggataccgcaccggtctctt

SEQ ID NO: 53209 - DNA, 20 bp, Neisseria gonorrhoeae
cgattggaacgccccttcat

SEQ ID NO: 53210 - DNA, 20 bp, Neisseria gonorrhoeae
gaacgccccttcatccgctt

SEQ ID NO: 53211 - DNA, 20 bp, Neisseria gonorrhoeae
atccgcttccgtatccgata

SEQ ID NO: 53212 - DNA, 20 bp, Neisseria gonorrhoeae
agacggcataggcagacaaa

SEQ ID NO: 53213 - DNA, 20 bp, Neisseria gonorrhoeae
ccaacatcctccccctttcc

SEQ ID NO: 53214 - DNA, 20 bp, Neisseria gonorrhoeae
caacatcctccccctttcca

SEQ ID NO: 53215 - DNA, 20 bp, Neisseria gonorrhoeae
ccatcggtgcaatattcggc

SEQ ID NO: 53216 - DNA, 20 bp, Neisseria gonorrhoeae
catcggtgcaatattcggca

SEQ ID NO: 53217 - DNA, 20 bp, Neisseria gonorrhoeae
cctccgccaattctcgcagc

SEQ ID NO: 53218 - DNA, 20 bp, Neisseria gonorrhoeae
ctccgccaattctcgcagcg

SEQ ID NO: 53219 - DNA, 20 bp, Neisseria gonorrhoeae
tcgcagcgcacacgctgcca

SEQ ID NO: 53220 - DNA, 20 bp, Neisseria gonorrhoeae
gcggaggaaacgccttatgt

SEQ ID NO: 53221 - DNA, 20 bp, Neisseria gonorrhoeae
attgccgttgggcagcctga

SEQ ID NO: 53222 - DNA, 20 bp, Neisseria gonorrhoeae
ccgttgggcagcctgacctt

SEQ ID NO: 53223 - DNA, 20 bp, Neisseria gonorrhoeae
ggcagcctgaccttatccct

SEQ ID NO: 53224 - DNA, 20 bp, Neisseria gonorrhoeae
gtacaatctcgaaggcagcg

SEQ ID NO: 53225 - DNA, 20 bp, Neisseria gonorrhoeae
tacaatctcgaaggcagcga

SEQ ID NO: 53226 - DNA, 20 bp, Neisseria gonorrhoeae
tgcgcctgtcggagcagggc

SEQ ID NO: 53227 - DNA, 20 bp, Neisseria gonorrhoeae
gcgcctgtcggagcagggcg

SEQ ID NO: 53228 - DNA, 20 bp, Neisseria gonorrhoeae
cgcctgtcggagcagggcga

SEQ ID NO: 53229 - DNA, 20 bp, Neisseria gonorrhoeae
tgctgtccgtcgtttccgcc

SEQ ID NO: 53230 - DNA, 20 bp, Neisseria gonorrhoeae
gctgtccgtcgtttccgcct

SEQ ID NO: 53231 - DNA, 20 bp, Neisseria gonorrhoeae
ctgtccgtcgtttccgcctg

SEQ ID NO: 53232 - DNA, 20 bp, Neisseria gonorrhoeae
ccgcctgtaccgaaatcaac

SEQ ID NO: 53233 - DNA, 20 bp, Neisseria gonorrhoeae
cgcctgtaccgaaatcaacg

SEQ ID NO: 53234 - DNA, 20 bp, Neisseria gonorrhoeae
cgccgccatgaccactcgcg

SEQ ID NO: 53235 - DNA, 20 bp, Neisseria gonorrhoeae
aacgaaaccgacgctcgcgt

SEQ ID NO: 53236 - DNA, 20 bp, Neisseria gonorrhoeae
acgaaaccgacgctcgcgta

SEQ ID NO: 53237 - DNA, 20 bp, Neisseria gonorrhoeae
tcgaacttggttgccgatgt

SEQ ID NO: 53238 - DNA, 20 bp, Neisseria gonorrhoeae
gacaatacgcgagcgtcggt

SEQ ID NO: 53239 - DNA, 20 bp, Neisseria gonorrhoeae
acggaaactaaacgcccgat

SEQ ID NO: 53240 - DNA, 20 bp, Neisseria gonorrhoeae
cggaaactaaacgcccgatg

SEQ ID NO: 53241 - DNA, 20 bp, Neisseria gonorrhoeae
ccatacaaaatgccgtctga

SEQ ID NO: 53242 - DNA, 20 bp, Neisseria gonorrhoeae
catacaaaatgccgtctgaa

SEQ ID NO: 53243 - DNA, 20 bp, Neisseria gonorrhoeae
tccagacggcattttttgtt

SEQ ID NO: 53244 - DNA, 20 bp, Neisseria gonorrhoeae
cgccaaagctgcgccatccc

SEQ ID NO: 53245 - DNA, 20 bp, Neisseria gonorrhoeae
ggcgcaactgggtgcggatg

SEQ ID NO: 53246 - DNA, 20 bp, Neisseria gonorrhoeae
gcgcaactgggtgcggatgt

SEQ ID NO: 53247 - DNA, 20 bp, Neisseria gonorrhoeae
gaggcgttcgcgggcgcgtt

SEQ ID NO: 53248 - DNA, 20 bp, Neisseria gonorrhoeae
gcgggcgcgttcgtagctgt

SEQ ID NO: 53249 - DNA, 20 bp, Neisseria gonorrhoeae
ccgacttactgcattcggaa

SEQ ID NO: 53250 - DNA, 20 bp, Neisseria gonorrhoeae
ctgcattcggaaacggtttc

SEQ ID NO: 53251 - DNA, 20 bp, Neisseria gonorrhoeae
ggaaacggtttcggaaagat

SEQ ID NO: 53252 - DNA, 20 bp, Neisseria gonorrhoeae
cggaaagattacccggtcag

SEQ ID NO: 53253 - DNA, 20 bp, Neisseria gonorrhoeae
ggaaagattacccggtcaga

SEQ ID NO: 53254 - DNA, 20 bp, Neisseria gonorrhoeae
cacaaaaccgcattcaggaa

SEQ ID NO: 53255 - DNA, 20 bp, Neisseria gonorrhoeae
aggaaaaagcgtggatacgc

SEQ ID NO: 53256 - DNA, 20 bp, Neisseria gonorrhoeae
caaaccgcgccgtatcaggc

SEQ ID NO: 53257 - DNA, 20 bp, Neisseria gonorrhoeae
gcaaggccgaagacattact

SEQ ID NO: 53258 - DNA, 20 bp, Neisseria gonorrhoeae
caaggccgaagacattactg

SEQ ID NO: 53259 - DNA, 20 bp, Neisseria gonorrhoeae
ggagcgaaccggcgcaagaa

SEQ ID NO: 53260 - DNA, 20 bp, Neisseria gonorrhoeae
gagcgaaccggcgcaagaac

SEQ ID NO: 53261 - DNA, 20 bp, Neisseria gonorrhoeae
ttgcgccggttcgctccaaa

SEQ ID NO: 53262 - DNA, 20 bp, Neisseria gonorrhoeae
cgccggttcgctccaaaggt

SEQ ID NO: 53263 - DNA, 20 bp, Neisseria gonorrhoeae
gctccaaaggtattcgagat

SEQ ID NO: 53264 - DNA, 20 bp, Neisseria gonorrhoeae
tttgccgatttcgcgcaaga

SEQ ID NO: 53265 - DNA, 20 bp, Neisseria gonorrhoeae
gccgatttcgcgcaagacgg

SEQ ID NO: 53266 - DNA, 20 bp, Neisseria gonorrhoeae
ccgatttcgcgcaagacggc

SEQ ID NO: 53267 - DNA, 20 bp, Neisseria gonorrhoeae
cgcgcaagacggcgattcgt

SEQ ID NO: 53268 - DNA, 20 bp, Neisseria gonorrhoeae
gcgcaagacggcgattcgtg

SEQ ID NO: 53269 - DNA, 20 bp, Neisseria gonorrhoeae
cgccaatgcggcttgggggt

SEQ ID NO: 53270 - DNA, 20 bp, Neisseria gonorrhoeae
ggggttggcggcttcgactg

SEQ ID NO: 53271 - DNA, 20 bp, Neisseria gonorrhoeae
gcggcttcgactgtttcggg

SEQ ID NO: 53272 - DNA, 20 bp, Neisseria gonorrhoeae
gactgtttcgggcaattcgg

SEQ ID NO: 53273 - DNA, 20 bp, Neisseria gonorrhoeae
cgggcaattcggtatagccg

SEQ ID NO: 53274 - DNA, 20 bp, Neisseria gonorrhoeae
ttgggcatcgaagacggcaa

SEQ ID NO: 53275 - DNA, 20 bp, Neisseria gonorrhoeae
ggcatcgaagacggcaaaag

SEQ ID NO: 53276 - DNA, 20 bp, Neisseria gonorrhoeae
ggcatcttcgggcgcggcgg

SEQ ID NO: 53277 - DNA, 20 bp, Neisseria gonorrhoeae
gggcgcggcggggttgtgga

SEQ ID NO: 53278 - DNA, 20 bp, Neisseria gonorrhoeae
tggatgatggggatgctttt

SEQ ID NO: 53279 - DNA, 20 bp, Neisseria gonorrhoeae
ggcgttttcggacaaatcgc

SEQ ID NO: 53280 - DNA, 20 bp, Neisseria gonorrhoeae
tcggacaaatcgccgtgcga

SEQ ID NO: 53281 - DNA, 20 bp, Neisseria gonorrhoeae
cggacaaatcgccgtgcgat

SEQ ID NO: 53282 - DNA, 20 bp, Neisseria gonorrhoeae
ggacaaatcgccgtgcgatc

SEQ ID NO: 53283 - DNA, 20 bp, Neisseria gonorrhoeae
ggcaatcgcttcgatcactt

SEQ ID NO: 53284 - DNA, 20 bp, Neisseria gonorrhoeae
ggtcgatgcgttgcggattg

SEQ ID NO: 53285 - DNA, 20 bp, Neisseria gonorrhoeae
gtcgatgcgttgcggattgc

SEQ ID NO: 53286 - DNA, 20 bp, Neisseria gonorrhoeae
cggattgccggcgccgatgt

SEQ ID NO: 53287 - DNA, 20 bp, Neisseria gonorrhoeae
ccggcgccgatgtcgaatat

SEQ ID NO: 53288 - DNA, 20 bp, Neisseria gonorrhoeae
gttgccgagatattcgacat

SEQ ID NO: 53289 - DNA, 20 bp, Neisseria gonorrhoeae
ggggcgaaaacttcgtcgaa

SEQ ID NO: 53290 - DNA, 20 bp, Neisseria gonorrhoeae
gggcgaaaacttcgtcgaag

SEQ ID NO: 53291 - DNA, 20 bp, Neisseria gonorrhoeae
gtcgaagtctcgcgcccgaa

SEQ ID NO: 53292 - DNA, 20 bp, Neisseria gonorrhoeae
gatttggatgcgaaccatat

SEQ ID NO: 53293 - DNA, 20 bp, Neisseria gonorrhoeae
atttggatgcgaaccatatc

SEQ ID NO: 53294 - DNA, 20 bp, Neisseria gonorrhoeae
ctgcgagccttgtgtgcggc

SEQ ID NO: 53295 - DNA, 20 bp, Neisseria gonorrhoeae
tgtgcggccgatgtggctga

SEQ ID NO: 53296 - DNA, 20 bp, Neisseria gonorrhoeae
gatttgccggactgtctgtt

SEQ ID NO: 53297 - DNA, 20 bp, Neisseria gonorrhoeae
gccggactgtctgtttgggt

SEQ ID NO: 53298 - DNA, 20 bp, Neisseria gonorrhoeae
ccggactgtctgtttgggtt

SEQ ID NO: 53299 - DNA, 20 bp, Neisseria gonorrhoeae
tgtttgtcgagggtaacgcg

SEQ ID NO: 53300 - DNA, 20 bp, Neisseria gonorrhoeae
gtcgagggtaacgcggtagg

SEQ ID NO: 53301 - DNA, 20 bp, Neisseria gonorrhoeae
tcgagggtaacgcggtaggc

SEQ ID NO: 53302 - DNA, 20 bp, Neisseria gonorrhoeae
gggtgtggtatcggcgaggg

SEQ ID NO: 53303 - DNA, 20 bp, Neisseria gonorrhoeae
tgcgattttggggctttcga

SEQ ID NO: 53304 - DNA, 20 bp, Neisseria gonorrhoeae
tgggcggaatggcttgccca

SEQ ID NO: 53305 - DNA, 20 bp, Neisseria gonorrhoeae
cccagtagcggtcgaagtcg

SEQ ID NO: 53306 - DNA, 20 bp, Neisseria gonorrhoeae
gccgacgacgctgccggtgg

SEQ ID NO: 53307 - DNA, 20 bp, Neisseria gonorrhoeae
gaccgctactgggcaagcca

SEQ ID NO: 53308 - DNA, 20 bp, Neisseria gonorrhoeae
cgcccacaacgccacgcgca

SEQ ID NO: 53309 - DNA, 20 bp, Neisseria gonorrhoeae
tcggcggtaaaggatttgtt

SEQ ID NO: 53310 - DNA, 20 bp, Neisseria gonorrhoeae
gttgtgcatgcggcggttga

SEQ ID NO: 53311 - DNA, 20 bp, Neisseria gonorrhoeae
ttgtgcatgcggcggttgag

SEQ ID NO: 53312 - DNA, 20 bp, Neisseria gonorrhoeae
tgcatgcggcggttgaggcg

SEQ ID NO: 53313 - DNA, 20 bp, Neisseria gonorrhoeae
aggcgggggaagtcggtcag

SEQ ID NO: 53314 - DNA, 20 bp, Neisseria gonorrhoeae
catgagcggtgcaatcagcg

SEQ ID NO: 53315 - DNA, 20 bp, Neisseria gonorrhoeae
atgagcggtgcaatcagcgg

SEQ ID NO: 53316 - DNA, 20 bp, Neisseria gonorrhoeae
gaccagcagcgaagacaggg

SEQ ID NO: 53317 - DNA, 20 bp, Neisseria gonorrhoeae
accagcagcgaagacagggc

SEQ ID NO: 53318 - DNA, 20 bp, Neisseria gonorrhoeae
gctgctggtcaaaccgctga

SEQ ID NO: 53319 - DNA, 20 bp, Neisseria gonorrhoeae
acgctcgcttacggtgcgca

SEQ ID NO: 53320 - DNA, 20 bp, Neisseria gonorrhoeae
cggtgcgcacggtccgcgtg

SEQ ID NO: 53321 - DNA, 20 bp, Neisseria gonorrhoeae
ggtcatcctcgccattttgc

SEQ ID NO: 53322 - DNA, 20 bp, Neisseria gonorrhoeae
gtcatcctcgccattttgcc

SEQ ID NO: 53323 - DNA, 20 bp, Neisseria gonorrhoeae
gtaagcatcgccatttttac

SEQ ID NO: 53324 - DNA, 20 bp, Neisseria gonorrhoeae
ttaccggcaaaggaagcagt

SEQ ID NO: 53325 - DNA, 20 bp, Neisseria gonorrhoeae
taccggcaaaggaagcagta

SEQ ID NO: 53326 - DNA, 20 bp, Neisseria gonorrhoeae
accggcaaaggaagcagtac

SEQ ID NO: 53327 - DNA, 20 bp, Neisseria gonorrhoeae
ccggcaaaggaagcagtacc

SEQ ID NO: 53328 - DNA, 20 bp, Neisseria gonorrhoeae
tccgttgacgacgatgctgt

SEQ ID NO: 53329 - DNA, 20 bp, Neisseria gonorrhoeae
acgacgatgctgtctttgtc

SEQ ID NO: 53330 - DNA, 20 bp, Neisseria gonorrhoeae
gtccaaatgcacgccgaagg

SEQ ID NO: 53331 - DNA, 20 bp, Neisseria gonorrhoeae
tccaaatgcacgccgaaggg

SEQ ID NO: 53332 - DNA, 20 bp, Neisseria gonorrhoeae
tgcggcggcaatcaagagtt

SEQ ID NO: 53333 - DNA, 20 bp, Neisseria gonorrhoeae
ccacatgtccagccactttg

SEQ ID NO: 53334 - DNA, 20 bp, Neisseria gonorrhoeae
gcccaaacatcgccccgata

SEQ ID NO: 53335 - DNA, 20 bp, Neisseria gonorrhoeae
cccaaacatcgccccgatag

SEQ ID NO: 53336 - DNA, 20 bp, Neisseria gonorrhoeae
gggggcgtttttttcgggca

SEQ ID NO: 53337 - DNA, 20 bp, Neisseria gonorrhoeae
ttttcgggcagcaccagccg

SEQ ID NO: 53338 - DNA, 20 bp, Neisseria gonorrhoeae
aagtctattacctgaccggc

SEQ ID NO: 53339 - DNA, 20 bp, Neisseria gonorrhoeae
cctgaccggcaggccgatga

SEQ ID NO: 53340 - DNA, 20 bp, Neisseria gonorrhoeae
gaagggcagggtgtgttcgg

SEQ ID NO: 53341 - DNA, 20 bp, Neisseria gonorrhoeae
gggctgtccgttcaggtgcg

SEQ ID NO: 53342 - DNA, 20 bp, Neisseria gonorrhoeae
aggtgcgcgctcatcggcct

SEQ ID NO: 53343 - DNA, 20 bp, Neisseria gonorrhoeae
gcattgatgtttgccggaac

SEQ ID NO: 53344 - DNA, 20 bp, Neisseria gonorrhoeae
atgtttgccggaacatggct

SEQ ID NO: 53345 - DNA, 20 bp, Neisseria gonorrhoeae
gccggaacatggctgcttgc

SEQ ID NO: 53346 - DNA, 20 bp, Neisseria gonorrhoeae
ccggaacatggctgcttgcc

SEQ ID NO: 53347 - DNA, 20 bp, Neisseria gonorrhoeae
cctatgccggcggctatcaa

SEQ ID NO: 53348 - DNA, 20 bp, Neisseria gonorrhoeae
accattgcaatctgcccgac

SEQ ID NO: 53349 - DNA, 20 bp, Neisseria gonorrhoeae
ccattgcaatctgcccgaca

SEQ ID NO: 53350 - DNA, 20 bp, Neisseria gonorrhoeae
caatctgcccgacagcacgg

SEQ ID NO: 53351 - DNA, 20 bp, Neisseria gonorrhoeae
gcgtgtcaggcggcgcatac

SEQ ID NO: 53352 - DNA, 20 bp, Neisseria gonorrhoeae
gttgcccatcacccacgccg

SEQ ID NO: 53353 - DNA, 20 bp, Neisseria gonorrhoeae
cccaagccgccgaaaaagcc

SEQ ID NO: 53354 - DNA, 20 bp, Neisseria gonorrhoeae
ccaagccgccgaaaaagccg

SEQ ID NO: 53355 - DNA, 20 bp, Neisseria gonorrhoeae
caacaaaccttcccaagaag

SEQ ID NO: 53356 - DNA, 20 bp, Neisseria gonorrhoeae
ttgggaaggtttgttgtaat

SEQ ID NO: 53357 - DNA, 20 bp, Neisseria gonorrhoeae
ggaaggtttgttgtaatagg

SEQ ID NO: 53358 - DNA, 20 bp, Neisseria gonorrhoeae
ttaccgtagccgccaacgcc

SEQ ID NO: 53359 - DNA, 20 bp, Neisseria gonorrhoeae
ccgtagccgccaacgccgcc

SEQ ID NO: 53360 - DNA, 20 bp, Neisseria gonorrhoeae
gccgatatgtgccgtgccgc

SEQ ID NO: 53361 - DNA, 20 bp, Neisseria gonorrhoeae
ccgatatgtgccgtgccgcg

SEQ ID NO: 53362 - DNA, 20 bp, Neisseria gonorrhoeae
gcgtgcaagggcaatgtcgc

SEQ ID NO: 53363 - DNA, 20 bp, Neisseria gonorrhoeae
gggcaggcagaaatatccga

SEQ ID NO: 53364 - DNA, 20 bp, Neisseria gonorrhoeae
acaggctgggggcttttaaa

SEQ ID NO: 53365 - DNA, 20 bp, Neisseria gonorrhoeae
caggctgggggcttttaaaa

SEQ ID NO: 53366 - DNA, 20 bp, Neisseria gonorrhoeae
caaaatcttttaaaagcccc

SEQ ID NO: 53367 - DNA, 20 bp, Neisseria gonorrhoeae
aaaatcttttaaaagccccc

SEQ ID NO: 53368 - DNA, 20 bp, Neisseria gonorrhoeae
cgtgcgccaacgcaaccaga

SEQ ID NO: 53369 - DNA, 20 bp, Neisseria gonorrhoeae
gtgcgccaacgcaaccagac

SEQ ID NO: 53370 - DNA, 20 bp, Neisseria gonorrhoeae
gtttcgccgctcatggcgga

SEQ ID NO: 53371 - DNA, 20 bp, Neisseria gonorrhoeae
cgccgctcatggcggatacg

SEQ ID NO: 53372 - DNA, 20 bp, Neisseria gonorrhoeae
gccgctcatggcggatacga

SEQ ID NO: 53373 - DNA, 20 bp, Neisseria gonorrhoeae
ttggcaaccagcaggtgttt

SEQ ID NO: 53374 - DNA, 20 bp, Neisseria gonorrhoeae
gcaaccagcaggtgtttgac

SEQ ID NO: 53375 - DNA, 20 bp, Neisseria gonorrhoeae
gacggtatttcccacaccca

SEQ ID NO: 53376 - DNA, 20 bp, Neisseria gonorrhoeae
acggtatttcccacacccag

SEQ ID NO: 53377 - DNA, 20 bp, Neisseria gonorrhoeae
cccacacccagttcccgggc

SEQ ID NO: 53378 - DNA, 20 bp, Neisseria gonorrhoeae
ggcggcatcgccagactcta

SEQ ID NO: 53379 - DNA, 20 bp, Neisseria gonorrhoeae
acgcacttttcacaggcaca

SEQ ID NO: 53380 - DNA, 20 bp, Neisseria gonorrhoeae
tcacaggcacacgtctgcgt

SEQ ID NO: 53381 - DNA, 20 bp, Neisseria gonorrhoeae
cacaggcacacgtctgcgtg

SEQ ID NO: 53382 - DNA, 20 bp, Neisseria gonorrhoeae
acaggcacacgtctgcgtgg

SEQ ID NO: 53383 - DNA, 20 bp, Neisseria gonorrhoeae
ggacgcgctgccgcgtgcgg

SEQ ID NO: 53384 - DNA, 20 bp, Neisseria gonorrhoeae
gacgcgctgccgcgtgcggg

SEQ ID NO: 53385 - DNA, 20 bp, Neisseria gonorrhoeae
cgcgtgggcttacctgccgc

SEQ ID NO: 53386 - DNA, 20 bp, Neisseria gonorrhoeae
gcgtgggcttacctgccgct

SEQ ID NO: 53387 - DNA, 20 bp, Neisseria gonorrhoeae
cctgccgctggaaattgcag

SEQ ID NO: 53388 - DNA, 20 bp, Neisseria gonorrhoeae
cggagaaatccgaatcagcc

SEQ ID NO: 53389 - DNA, 20 bp, Neisseria gonorrhoeae
ggagaaatccgaatcagcct

SEQ ID NO: 53390 - DNA, 20 bp, Neisseria gonorrhoeae
agacggcattttcggcacac

SEQ ID NO: 53391 - DNA, 20 bp, Neisseria gonorrhoeae
tcggcacacggggcgggcgc

SEQ ID NO: 53392 - DNA, 20 bp, Neisseria gonorrhoeae
cggcacacggggcgggcgcg

SEQ ID NO: 53393 - DNA, 20 bp, Neisseria gonorrhoeae
acctcgccaaaaaactcggc

SEQ ID NO: 53394 - DNA, 20 bp, Neisseria gonorrhoeae
cctcgccaaaaaactcggca

SEQ ID NO: 53395 - DNA, 20 bp, Neisseria gonorrhoeae
tttggcgaggtaaacgttgc

SEQ ID NO: 53396 - DNA, 20 bp, Neisseria gonorrhoeae
ttggcgaggtaaacgttgct

SEQ ID NO: 53397 - DNA, 20 bp, Neisseria gonorrhoeae
tggcgaggtaaacgttgctt

SEQ ID NO: 53398 - DNA, 20 bp, Neisseria gonorrhoeae
gggcgttgccctgaccgacg

SEQ ID NO: 53399 - DNA, 20 bp, Neisseria gonorrhoeae
ggcgttgccctgaccgacgt

SEQ ID NO: 53400 - DNA, 20 bp, Neisseria gonorrhoeae
ccctgaccgacgtggtcggt

SEQ ID NO: 53401 - DNA, 20 bp, Neisseria gonorrhoeae
ctgcgcgatttcgacctcta

SEQ ID NO: 53402 - DNA, 20 bp, Neisseria gonorrhoeae
gcgaaatagaggtcgaaatc

SEQ ID NO: 53403 - DNA, 20 bp, Neisseria gonorrhoeae
ctcgcctacctgcgccaagt

SEQ ID NO: 53404 - DNA, 20 bp, Neisseria gonorrhoeae
gcgcaggtaggcgaggaagg

SEQ ID NO: 53405 - DNA, 20 bp, Neisseria gonorrhoeae
ttggtcatggttttgcccgg

SEQ ID NO: 53406 - DNA, 20 bp, Neisseria gonorrhoeae
gtcatggttttgcccggcga

SEQ ID NO: 53407 - DNA, 20 bp, Neisseria gonorrhoeae
tgcccggcgagtcggagagc

SEQ ID NO: 53408 - DNA, 20 bp, Neisseria gonorrhoeae
ctcgcccaatctggcgaagg

SEQ ID NO: 53409 - DNA, 20 bp, Neisseria gonorrhoeae
ccttcgccagattgggcgag

SEQ ID NO: 53410 - DNA, 20 bp, Neisseria gonorrhoeae
cttcgccagattgggcgagg

SEQ ID NO: 53411 - DNA, 20 bp, Neisseria gonorrhoeae
gccagattgggcgaggaata

SEQ ID NO: 53412 - DNA, 20 bp, Neisseria gonorrhoeae
ggcgaggaatagtcgatgac

SEQ ID NO: 53413 - DNA, 20 bp, Neisseria gonorrhoeae
accaagccgccaccctgttc

SEQ ID NO: 53414 - DNA, 20 bp, Neisseria gonorrhoeae
ccaagccgccaccctgttca

SEQ ID NO: 53415 - DNA, 20 bp, Neisseria gonorrhoeae
agccgcttctacgaagcttg

SEQ ID NO: 53416 - DNA, 20 bp, Neisseria gonorrhoeae
tacgaagcttgcccgatttt

SEQ ID NO: 53417 - DNA, 20 bp, Neisseria gonorrhoeae
cccgattttgaaagccgaag

SEQ ID NO: 53418 - DNA, 20 bp, Neisseria gonorrhoeae
tgggttttggcactgctgac

SEQ ID NO: 53419 - DNA, 20 bp, Neisseria gonorrhoeae
gggttttggcactgctgacc

SEQ ID NO: 53420 - DNA, 20 bp, Neisseria gonorrhoeae
ggttttggcactgctgaccg

SEQ ID NO: 53421 - DNA, 20 bp, Neisseria gonorrhoeae
tggcactgctgaccgccacc

SEQ ID NO: 53422 - DNA, 20 bp, Neisseria gonorrhoeae
ggcactgctgaccgccaccg

SEQ ID NO: 53423 - DNA, 20 bp, Neisseria gonorrhoeae
tcgagtacgccggtgatttt

SEQ ID NO: 53424 - DNA, 20 bp, Neisseria gonorrhoeae
cgagtacgccggtgattttg

SEQ ID NO: 53425 - DNA, 20 bp, Neisseria gonorrhoeae
gagtacgccggtgattttgt

SEQ ID NO: 53426 - DNA, 20 bp, Neisseria gonorrhoeae
tgttgatttcatcttccatc

SEQ ID NO: 53427 - DNA, 20 bp, Neisseria gonorrhoeae
gttgatttcatcttccatcg

SEQ ID NO: 53428 - DNA, 20 bp, Neisseria gonorrhoeae
atggtcgaaccggtaccgat

SEQ ID NO: 53429 - DNA, 20 bp, Neisseria gonorrhoeae
gttttcgggtacgaattcga

SEQ ID NO: 53430 - DNA, 20 bp, Neisseria gonorrhoeae
tcgggtacgaattcgactgc

SEQ ID NO: 53431 - DNA, 20 bp, Neisseria gonorrhoeae
cgggtacgaattcgactgct

SEQ ID NO: 53432 - DNA, 20 bp, Neisseria gonorrhoeae
gggtacgaattcgactgctt

SEQ ID NO: 53433 - DNA, 20 bp, Neisseria gonorrhoeae
tcggtttccgccgccaaacc

SEQ ID NO: 53434 - DNA, 20 bp, Neisseria gonorrhoeae
ccgccgccaaaccggtttcc

SEQ ID NO: 53435 - DNA, 20 bp, Neisseria gonorrhoeae
cgccgccaaaccggtttcca

SEQ ID NO: 53436 - DNA, 20 bp, Neisseria gonorrhoeae
ccaacagttttgccacaccg

SEQ ID NO: 53437 - DNA, 20 bp, Neisseria gonorrhoeae
caacagttttgccacaccgt

SEQ ID NO: 53438 - DNA, 20 bp, Neisseria gonorrhoeae
gaaaggcagtcaatacgatg

SEQ ID NO: 53439 - DNA, 20 bp, Neisseria gonorrhoeae
aaaggcagtcaatacgatgc

SEQ ID NO: 53440 - DNA, 20 bp, Neisseria gonorrhoeae
gctgaaccaaaatttaacta

SEQ ID NO: 53441 - DNA, 20 bp, Neisseria gonorrhoeae
ctgaaccaaaatttaactat

SEQ ID NO: 53442 - DNA, 20 bp, Neisseria gonorrhoeae
aactatgctgtctaaattta

SEQ ID NO: 53443 - DNA, 20 bp, Neisseria gonorrhoeae
aagacacgcacgaattggat

SEQ ID NO: 53444 - DNA, 20 bp, Neisseria gonorrhoeae
gatttgcccaagcacccaaa

SEQ ID NO: 53445 - DNA, 20 bp, Neisseria gonorrhoeae
gcccaagcacccaaatcatg

SEQ ID NO: 53446 - DNA, 20 bp, Neisseria gonorrhoeae
cccaagcacccaaatcatgt

SEQ ID NO: 53447 - DNA, 20 bp, Neisseria gonorrhoeae
tttataaaacaggtggacat

SEQ ID NO: 53448 - DNA, 20 bp, Neisseria gonorrhoeae
tctatccgcgctcaataccg

SEQ ID NO: 53449 - DNA, 20 bp, Neisseria gonorrhoeae
gacttcggttcacgccaatg

SEQ ID NO: 53450 - DNA, 20 bp, Neisseria gonorrhoeae
acttcggttcacgccaatga

SEQ ID NO: 53451 - DNA, 20 bp, Neisseria gonorrhoeae
ggttcacgccaatgacgcgc

SEQ ID NO: 53452 - DNA, 20 bp, Neisseria gonorrhoeae
acgccaatgacgcgcaatcg

SEQ ID NO: 53453 - DNA, 20 bp, Neisseria gonorrhoeae
tttgaccgaacacgcatgac

SEQ ID NO: 53454 - DNA, 20 bp, Neisseria gonorrhoeae
ttgaccgaacacgcatgact

SEQ ID NO: 53455 - DNA, 20 bp, Neisseria gonorrhoeae
tgaccgaacacgcatgactg

SEQ ID NO: 53456 - DNA, 20 bp, Neisseria gonorrhoeae
gaccgaacacgcatgactga

SEQ ID NO: 53457 - DNA, 20 bp, Neisseria gonorrhoeae
accgaacacgcatgactgaa

SEQ ID NO: 53458 - DNA, 20 bp, Neisseria gonorrhoeae
gttattttgctgacggcaca

SEQ ID NO: 53459 - DNA, 20 bp, Neisseria gonorrhoeae
ttttgctgacggcacaccgt

SEQ ID NO: 53460 - DNA, 20 bp, Neisseria gonorrhoeae
tgctgacggcacaccgtctg

SEQ ID NO: 53461 - DNA, 20 bp, Neisseria gonorrhoeae
gctgacggcacaccgtctgc

SEQ ID NO: 53462 - DNA, 20 bp, Neisseria gonorrhoeae
ctgacggcacaccgtctgcc

SEQ ID NO: 53463 - DNA, 20 bp, Neisseria gonorrhoeae
aattaaaggttttcacaaaa

SEQ ID NO: 53464 - DNA, 20 bp, Neisseria gonorrhoeae
attaaaggttttcacaaaaa

SEQ ID NO: 53465 - DNA, 20 bp, Neisseria gonorrhoeae
aaggttttcacaaaaaagac

SEQ ID NO: 53466 - DNA, 20 bp, Neisseria gonorrhoeae
tcacaaaaaagacggtggca

SEQ ID NO: 53467 - DNA, 20 bp, Neisseria gonorrhoeae
cacaaaaaagacggtggcac

SEQ ID NO: 53468 - DNA, 20 bp, Neisseria gonorrhoeae
gtctgaaaatgaccaaaagc

SEQ ID NO: 53469 - DNA, 20 bp, Neisseria gonorrhoeae
tctgaaaatgaccaaaagcc

SEQ ID NO: 53470 - DNA, 20 bp, Neisseria gonorrhoeae
tcagcagagtaggtggtttg

SEQ ID NO: 53471 - DNA, 20 bp, Neisseria gonorrhoeae
gcccgagtgttgttgtttgc

SEQ ID NO: 53472 - DNA, 20 bp, Neisseria gonorrhoeae
cccgagtgttgttgtttgct

SEQ ID NO: 53473 - DNA, 20 bp, Neisseria gonorrhoeae
tgtttcacgcaatggcgaaa

SEQ ID NO: 53474 - DNA, 20 bp, Neisseria gonorrhoeae
cacgcaatggcgaaattgca

SEQ ID NO: 53475 - DNA, 20 bp, Neisseria gonorrhoeae
acgcaatggcgaaattgcac

SEQ ID NO: 53476 - DNA, 20 bp, Neisseria gonorrhoeae
cactggaaaaccaagacggc

SEQ ID NO: 53477 - DNA, 20 bp, Neisseria gonorrhoeae
ttcatggtaaacgagcggta

SEQ ID NO: 53478 - DNA, 20 bp, Neisseria gonorrhoeae
ttcaaccgctgcctttgccg

SEQ ID NO: 53479 - DNA, 20 bp, Neisseria gonorrhoeae
tcaaccgctgcctttgccgg

SEQ ID NO: 53480 - DNA, 20 bp, Neisseria gonorrhoeae
caaccgctgcctttgccggg

SEQ ID NO: 53481 - DNA, 20 bp, Neisseria gonorrhoeae
aaccgctgcctttgccgggg

SEQ ID NO: 53482 - DNA, 20 bp, Neisseria gonorrhoeae
gccgggggcgcattcacgct

SEQ ID NO: 53483 - DNA, 20 bp, Neisseria gonorrhoeae
cgagcggaccaccgacggta

SEQ ID NO: 53484 - DNA, 20 bp, Neisseria gonorrhoeae
gaagcgcgcgctgaaacggg

SEQ ID NO: 53485 - DNA, 20 bp, Neisseria gonorrhoeae
aagcgcgcgctgaaacggga

SEQ ID NO: 53486 - DNA, 20 bp, Neisseria gonorrhoeae
cagcgcgcgcttcaaagagc

SEQ ID NO: 53487 - DNA, 20 bp, Neisseria gonorrhoeae
agcgcgcgcttcaaagagct

SEQ ID NO: 53488 - DNA, 20 bp, Neisseria gonorrhoeae
ccgttcaaataaatcgctct

SEQ ID NO: 53489 - DNA, 20 bp, Neisseria gonorrhoeae
aaataaatcgctctacataa

SEQ ID NO: 53490 - DNA, 20 bp, Neisseria gonorrhoeae
gagataacgcattgattttt

SEQ ID NO: 53491 - DNA, 20 bp, Neisseria gonorrhoeae
agataacgcattgattttta

SEQ ID NO: 53492 - DNA, 20 bp, Neisseria gonorrhoeae
atttttatgtagagcgattt

SEQ ID NO: 53493 - DNA, 20 bp, Neisseria gonorrhoeae
tagtcggctttgatttgcgg

SEQ ID NO: 53494 - DNA, 20 bp, Neisseria gonorrhoeae
gatttgcggaatgctctcgg

SEQ ID NO: 53495 - DNA, 20 bp, Neisseria gonorrhoeae
atttgcggaatgctctcggg

SEQ ID NO: 53496 - DNA, 20 bp, Neisseria gonorrhoeae
gcggaatgctctcgggctgg

SEQ ID NO: 53497 - DNA, 20 bp, Neisseria gonorrhoeae
cggaatgctctcgggctggt

SEQ ID NO: 53498 - DNA, 20 bp, Neisseria gonorrhoeae
ccgtcaacgactacctcgcc

SEQ ID NO: 53499 - DNA, 20 bp, Neisseria gonorrhoeae
acggtaacgacgtgcacgcc

SEQ ID NO: 53500 - DNA, 20 bp, Neisseria gonorrhoeae
gccggccagcgcgttgagat

SEQ ID NO: 53501 - DNA, 20 bp, Neisseria gonorrhoeae
ccggccagcgcgttgagata

SEQ ID NO: 53502 - DNA, 20 bp, Neisseria gonorrhoeae
agatagacggcgagggtggc

SEQ ID NO: 53503 - DNA, 20 bp, Neisseria gonorrhoeae
ccctgcgcggtcaaacagtt

SEQ ID NO: 53504 - DNA, 20 bp, Neisseria gonorrhoeae
tccgcccacgcctgcgcgtt

SEQ ID NO: 53505 - DNA, 20 bp, Neisseria gonorrhoeae
tgaatcaaagcacattgacg

SEQ ID NO: 53506 - DNA, 20 bp, Neisseria gonorrhoeae
tgcccgcgtcaatgtgcttt

SEQ ID NO: 53507 - DNA, 20 bp, Neisseria gonorrhoeae
gattcacaacgcgcaggcgt

SEQ ID NO: 53508 - DNA, 20 bp, Neisseria gonorrhoeae
cttgaaggcttcaaaggttt

SEQ ID NO: 53509 - DNA, 20 bp, Neisseria gonorrhoeae
aaggcttcaaaggttttttc

SEQ ID NO: 53510 - DNA, 20 bp, Neisseria gonorrhoeae
aaaggttttttcagacggcg

SEQ ID NO: 53511 - DNA, 20 bp, Neisseria gonorrhoeae
tttcagacggcgtaaacggt

SEQ ID NO: 53512 - DNA, 20 bp, Neisseria gonorrhoeae
ttcagacggcgtaaacggtt

SEQ ID NO: 53513 - DNA, 20 bp, Neisseria gonorrhoeae
ttttgcgcgccatccgcatc

SEQ ID NO: 53514 - DNA, 20 bp, Neisseria gonorrhoeae
tttgcgcgccatccgcatct

SEQ ID NO: 53515 - DNA, 20 bp, Neisseria gonorrhoeae
ttgcgcgccatccgcatctg

SEQ ID NO: 53516 - DNA, 20 bp, Neisseria gonorrhoeae
tgcgcgccatccgcatctgt

SEQ ID NO: 53517 - DNA, 20 bp, Neisseria gonorrhoeae
gcgcgccatccgcatctgtt

SEQ ID NO: 53518 - DNA, 20 bp, Neisseria gonorrhoeae
agcagcaggcgcaggaattg

SEQ ID NO: 53519 - DNA, 20 bp, Neisseria gonorrhoeae
ggcatcagccttgccacgct

SEQ ID NO: 53520 - DNA, 20 bp, Neisseria gonorrhoeae
ccacgctataccgcaagctg

SEQ ID NO: 53521 - DNA, 20 bp, Neisseria gonorrhoeae
acgctgaccgcctccagctt

SEQ ID NO: 53522 - DNA, 20 bp, Neisseria gonorrhoeae
cggtatagcgtggcaaggct

SEQ ID NO: 53523 - DNA, 20 bp, Neisseria gonorrhoeae
aaaccccgcgtcgaggcaga

SEQ ID NO: 53524 - DNA, 20 bp, Neisseria gonorrhoeae
cgggtagtgtttgaggatga

SEQ ID NO: 53525 - DNA, 20 bp, Neisseria gonorrhoeae
gaggatgaccgacactgcct

SEQ ID NO: 53526 - DNA, 20 bp, Neisseria gonorrhoeae
aggatgaccgacactgcctg

SEQ ID NO: 53527 - DNA, 20 bp, Neisseria gonorrhoeae
ccagtcgccgccgtctgcct

SEQ ID NO: 53528 - DNA, 20 bp, Neisseria gonorrhoeae
gtgggttttgaagcgggtgt

SEQ ID NO: 53529 - DNA, 20 bp, Neisseria gonorrhoeae
tgaagcgggtgttttccagg

SEQ ID NO: 53530 - DNA, 20 bp, Neisseria gonorrhoeae
gaagcgggtgttttccaggc

SEQ ID NO: 53531 - DNA, 20 bp, Neisseria gonorrhoeae
aagcgggtgttttccaggcg

SEQ ID NO: 53532 - DNA, 20 bp, Neisseria gonorrhoeae
tccaggcgtccccagttgtg

SEQ ID NO: 53533 - DNA, 20 bp, Neisseria gonorrhoeae
cgtccgcaagggtttgcgtg

SEQ ID NO: 53534 - DNA, 20 bp, Neisseria gonorrhoeae
gcgtgtcggcgcggtcaaaa

SEQ ID NO: 53535 - DNA, 20 bp, Neisseria gonorrhoeae
cgtgtcggcgcggtcaaaac

SEQ ID NO: 53536 - DNA, 20 bp, Neisseria gonorrhoeae
gacggcggcttggggctgcg

SEQ ID NO: 53537 - DNA, 20 bp, Neisseria gonorrhoeae
gggctgcgggcaaacctgcg

SEQ ID NO: 53538 - DNA, 20 bp, Neisseria gonorrhoeae
gattcagcttcggatggaaa

SEQ ID NO: 53539 - DNA, 20 bp, Neisseria gonorrhoeae
attcagcttcggatggaaaa

SEQ ID NO: 53540 - DNA, 20 bp, Neisseria gonorrhoeae
agcttcggatggaaaaggcg

SEQ ID NO: 53541 - DNA, 20 bp, Neisseria gonorrhoeae
ggatggaaaaggcgcacgtt

SEQ ID NO: 53542 - DNA, 20 bp, Neisseria gonorrhoeae
ttctttttcaacgtgcgcct

SEQ ID NO: 53543 - DNA, 20 bp, Neisseria gonorrhoeae
gcacgggcggcacatacggc

SEQ ID NO: 53544 - DNA, 20 bp, Neisseria gonorrhoeae
cacgggcggcacatacggcg

SEQ ID NO: 53545 - DNA, 20 bp, Neisseria gonorrhoeae
gcggcaggagcggcattgta

SEQ ID NO: 53546 - DNA, 20 bp, Neisseria gonorrhoeae
tacggcgttgcgccataagg

SEQ ID NO: 53547 - DNA, 20 bp, Neisseria gonorrhoeae
tggcgcaacgccgtacaatg

SEQ ID NO: 53548 - DNA, 20 bp, Neisseria gonorrhoeae
ccagcagttgggacagcagg

SEQ ID NO: 53549 - DNA, 20 bp, Neisseria gonorrhoeae
cagcagttgggacagcaggt

SEQ ID NO: 53550 - DNA, 20 bp, Neisseria gonorrhoeae
ggacagcaggtcttttttgt

SEQ ID NO: 53551 - DNA, 20 bp, Neisseria gonorrhoeae
tttgttgatgtagcccaacg

SEQ ID NO: 53552 - DNA, 20 bp, Neisseria gonorrhoeae
ttgttgatgtagcccaacgg

SEQ ID NO: 53553 - DNA, 20 bp, Neisseria gonorrhoeae
attttgctgatgttggcggt

SEQ ID NO: 53554 - DNA, 20 bp, Neisseria gonorrhoeae
ttttgctgatgttggcggta

SEQ ID NO: 53555 - DNA, 20 bp, Neisseria gonorrhoeae
tgctgatgttggcggtaatt

SEQ ID NO: 53556 - DNA, 20 bp, Neisseria gonorrhoeae
gctgatgttggcggtaattt

SEQ ID NO: 53557 - DNA, 20 bp, Neisseria gonorrhoeae
ctgatgttggcggtaattta

SEQ ID NO: 53558 - DNA, 20 bp, Neisseria gonorrhoeae
ggctgggggctgctggatgc

SEQ ID NO: 53559 - DNA, 20 bp, Neisseria gonorrhoeae
atggccttacccgcatccag

SEQ ID NO: 53560 - DNA, 20 bp, Neisseria gonorrhoeae
cccgcatccagcagccccca

SEQ ID NO: 53561 - DNA, 20 bp, Neisseria gonorrhoeae
ctgtccactccgactgcacc

SEQ ID NO: 53562 - DNA, 20 bp, Neisseria gonorrhoeae
ggcagcggcacattccgcgc

SEQ ID NO: 53563 - DNA, 20 bp, Neisseria gonorrhoeae
cgcgcccgccggtctgaaac

SEQ ID NO: 53564 - DNA, 20 bp, Neisseria gonorrhoeae
tccagattgctgccgccctg

SEQ ID NO: 53565 - DNA, 20 bp, Neisseria gonorrhoeae
ccagattgctgccgccctgt

SEQ ID NO: 53566 - DNA, 20 bp, Neisseria gonorrhoeae
cagattgctgccgccctgtt

SEQ ID NO: 53567 - DNA, 20 bp, Neisseria gonorrhoeae
tgccttcgacaccgccctgt

SEQ ID NO: 53568 - DNA, 20 bp, Neisseria gonorrhoeae
gccttcgacaccgccctgtt

SEQ ID NO: 53569 - DNA, 20 bp, Neisseria gonorrhoeae
ccttcgacaccgccctgttc

SEQ ID NO: 53570 - DNA, 20 bp, Neisseria gonorrhoeae
gacaccgccctgttcccacg

SEQ ID NO: 53571 - DNA, 20 bp, Neisseria gonorrhoeae
ccacgttccaccgtcctgtt

SEQ ID NO: 53572 - DNA, 20 bp, Neisseria gonorrhoeae
atcctcctcacgaaaatacg

SEQ ID NO: 53573 - DNA, 20 bp, Neisseria gonorrhoeae
tcctcctcacgaaaatacgc

SEQ ID NO: 53574 - DNA, 20 bp, Neisseria gonorrhoeae
ctttcttgatgggcgtcttg

SEQ ID NO: 53575 - DNA, 20 bp, Neisseria gonorrhoeae
cttgatgggcgtcttgcgta

SEQ ID NO: 53576 - DNA, 20 bp, Neisseria gonorrhoeae
ttgatgggcgtcttgcgtat

SEQ ID NO: 53577 - DNA, 20 bp, Neisseria gonorrhoeae
aaaacccacgaagcctcatt

SEQ ID NO: 53578 - DNA, 20 bp, Neisseria gonorrhoeae
ggcgtgcgctaccgcttctg

SEQ ID NO: 53579 - DNA, 20 bp, Neisseria gonorrhoeae
tgattccccgataccgatgc

SEQ ID NO: 53580 - DNA, 20 bp, Neisseria gonorrhoeae
cccgataccgatgccgtctg

SEQ ID NO: 53581 - DNA, 20 bp, Neisseria gonorrhoeae
agacggcatcggtatcgggg

SEQ ID NO: 53582 - DNA, 20 bp, Neisseria gonorrhoeae
ccgcgcaggcggaaatccgg

SEQ ID NO: 53583 - DNA, 20 bp, Neisseria gonorrhoeae
cagtcatttccgatagattc

SEQ ID NO: 53584 - DNA, 20 bp, Neisseria gonorrhoeae
agtcatttccgatagattcc

SEQ ID NO: 53585 - DNA, 20 bp, Neisseria gonorrhoeae
ccgatagattcccgccgcgt

SEQ ID NO: 53586 - DNA, 20 bp, Neisseria gonorrhoeae
cgatagattcccgccgcgtc

SEQ ID NO: 53587 - DNA, 20 bp, Neisseria gonorrhoeae
tggctcgacgaaaaccgtcc

SEQ ID NO: 53588 - DNA, 20 bp, Neisseria gonorrhoeae
ccgaattggataccaacggc

SEQ ID NO: 53589 - DNA, 20 bp, Neisseria gonorrhoeae
gtatccaattcggcaaggta

SEQ ID NO: 53590 - DNA, 20 bp, Neisseria gonorrhoeae
ggcaaggtaggctttgactt

SEQ ID NO: 53591 - DNA, 20 bp, Neisseria gonorrhoeae
gactttggcgagcagactct

SEQ ID NO: 53592 - DNA, 20 bp, Neisseria gonorrhoeae
ggactcattgggcgaattcc

SEQ ID NO: 53593 - DNA, 20 bp, Neisseria gonorrhoeae
ggcgaattcctcgcgcttgc

SEQ ID NO: 53594 - DNA, 20 bp, Neisseria gonorrhoeae
ctcgcgcttgccgtatcgtt

SEQ ID NO: 53595 - DNA, 20 bp, Neisseria gonorrhoeae
ccgtatcgtttgaacatctg

SEQ ID NO: 53596 - DNA, 20 bp, Neisseria gonorrhoeae
gaacatctggcgcaaaaaac

SEQ ID NO: 53597 - DNA, 20 bp, Neisseria gonorrhoeae
acactgcacacgggcttgac

SEQ ID NO: 53598 - DNA, 20 bp, Neisseria gonorrhoeae
acaggcgaagtgttggacgc

SEQ ID NO: 53599 - DNA, 20 bp, Neisseria gonorrhoeae
gacgcaccgcccaaagccga

SEQ ID NO: 53600 - DNA, 20 bp, Neisseria gonorrhoeae
cggctcggctttgggcggtg

SEQ ID NO: 53601 - DNA, 20 bp, Neisseria gonorrhoeae
ggctcggctttgggcggtgc

SEQ ID NO: 53602 - DNA, 20 bp, Neisseria gonorrhoeae
gagttccgaagcgcccgcct

SEQ ID NO: 53603 - DNA, 20 bp, Neisseria gonorrhoeae
cgaagcgcccgccttttcca

SEQ ID NO: 53604 - DNA, 20 bp, Neisseria gonorrhoeae
tccaaagcctccgtatcatc

SEQ ID NO: 53605 - DNA, 20 bp, Neisseria gonorrhoeae
ccaaagcctccgtatcatcc

SEQ ID NO: 53606 - DNA, 20 bp, Neisseria gonorrhoeae
caaagcctccgtatcatccg

SEQ ID NO: 53607 - DNA, 20 bp, Neisseria gonorrhoeae
cgccgtagtcggtaatttcc

SEQ ID NO: 53608 - DNA, 20 bp, Neisseria gonorrhoeae
ccttcgcacccccgccgaca

SEQ ID NO: 53609 - DNA, 20 bp, Neisseria gonorrhoeae
cttcgcacccccgccgacat

SEQ ID NO: 53610 - DNA, 20 bp, Neisseria gonorrhoeae
gcacccccgccgacatccac

SEQ ID NO: 53611 - DNA, 20 bp, Neisseria gonorrhoeae
tcgccacaccgcgtatcgta

SEQ ID NO: 53612 - DNA, 20 bp, Neisseria gonorrhoeae
gtcatcgtgccgccgccgtc

SEQ ID NO: 53613 - DNA, 20 bp, Neisseria gonorrhoeae
acacgcaaacccgcctccga

SEQ ID NO: 53614 - DNA, 20 bp, Neisseria gonorrhoeae
gcgtgtgaatcaggcgcgtt

SEQ ID NO: 53615 - DNA, 20 bp, Neisseria gonorrhoeae
cgtgtgaatcaggcgcgttt

SEQ ID NO: 53616 - DNA, 20 bp, Neisseria gonorrhoeae
ccccgttgacggcggcggca

SEQ ID NO: 53617 - DNA, 20 bp, Neisseria gonorrhoeae
gccaacacctcgcccgcctt

SEQ ID NO: 53618 - DNA, 20 bp, Neisseria gonorrhoeae
tccccgaaagtgtccgccaa

SEQ ID NO: 53619 - DNA, 20 bp, Neisseria gonorrhoeae
cgcaacgccgcttccgcatc

SEQ ID NO: 53620 - DNA, 20 bp, Neisseria gonorrhoeae
cgcaatatgttggcggacac

SEQ ID NO: 53621 - DNA, 20 bp, Neisseria gonorrhoeae
gcggacactttcggggataa

SEQ ID NO: 53622 - DNA, 20 bp, Neisseria gonorrhoeae
ttcgcctgttcgaaagccgc

SEQ ID NO: 53623 - DNA, 20 bp, Neisseria gonorrhoeae
tcgcctgttcgaaagccgcg

SEQ ID NO: 53624 - DNA, 20 bp, Neisseria gonorrhoeae
cgcctgttcgaaagccgcgt

SEQ ID NO: 53625 - DNA, 20 bp, Neisseria gonorrhoeae
gcctgttcgaaagccgcgtc

SEQ ID NO: 53626 - DNA, 20 bp, Neisseria gonorrhoeae
gaaagccgcgtcgctgtccg

SEQ ID NO: 53627 - DNA, 20 bp, Neisseria gonorrhoeae
gccgccatcaccggataagc

SEQ ID NO: 53628 - DNA, 20 bp, Neisseria gonorrhoeae
ccgtctgcgacaggttcaca

SEQ ID NO: 53629 - DNA, 20 bp, Neisseria gonorrhoeae
acaaccgcagaagcgggcga

SEQ ID NO: 53630 - DNA, 20 bp, Neisseria gonorrhoeae
tgcggttgtgaacctgtcgc

SEQ ID NO: 53631 - DNA, 20 bp, Neisseria gonorrhoeae
tgaacctgtcgcagacggca

SEQ ID NO: 53632 - DNA, 20 bp, Neisseria gonorrhoeae
ggatataatcccgggacttc

SEQ ID NO: 53633 - DNA, 20 bp, Neisseria gonorrhoeae
atcacgggcgaaaccttaaa

SEQ ID NO: 53634 - DNA, 20 bp, Neisseria gonorrhoeae
aaccccggcccgaaatcagc

SEQ ID NO: 53635 - DNA, 20 bp, Neisseria gonorrhoeae
cgggccggggtttaaggttt

SEQ ID NO: 53636 - DNA, 20 bp, Neisseria gonorrhoeae
gggccggggtttaaggtttc

SEQ ID NO: 53637 - DNA, 20 bp, Neisseria gonorrhoeae
tcaaaacgctccttcaggcg

SEQ ID NO: 53638 - DNA, 20 bp, Neisseria gonorrhoeae
aggcggcgcaccgtttccgc

SEQ ID NO: 53639 - DNA, 20 bp, Neisseria gonorrhoeae
tgacaacgagctgggcggtg

SEQ ID NO: 53640 - DNA, 20 bp, Neisseria gonorrhoeae
gacaacgagctgggcggtgt

SEQ ID NO: 53641 - DNA, 20 bp, Neisseria gonorrhoeae
acaacgagctgggcggtgtg

SEQ ID NO: 53642 - DNA, 20 bp, Neisseria gonorrhoeae
cctgacaaccttgtccgcct

SEQ ID NO: 53643 - DNA, 20 bp, Neisseria gonorrhoeae
tccgcctccgtaaccgcctt

SEQ ID NO: 53644 - DNA, 20 bp, Neisseria gonorrhoeae
ttcgcatccgcgccgaagag

SEQ ID NO: 53645 - DNA, 20 bp, Neisseria gonorrhoeae
gcatccgcgccgaagagttc

SEQ ID NO: 53646 - DNA, 20 bp, Neisseria gonorrhoeae
cgacaaacgcccgtattcct

SEQ ID NO: 53647 - DNA, 20 bp, Neisseria gonorrhoeae
cccgtcctgccgtcaaacca

SEQ ID NO: 53648 - DNA, 20 bp, Neisseria gonorrhoeae
tccggcgccgtttcggacac

SEQ ID NO: 53649 - DNA, 20 bp, Neisseria gonorrhoeae
cggacacggcggcgacatcc

SEQ ID NO: 53650 - DNA, 20 bp, Neisseria gonorrhoeae
ggacacggcggcgacatcca

SEQ ID NO: 53651 - DNA, 20 bp, Neisseria gonorrhoeae
tcgcagcgtgtggagggctg

SEQ ID NO: 53652 - DNA, 20 bp, Neisseria gonorrhoeae
cttaggcgataccctgcccg

SEQ ID NO: 53653 - DNA, 20 bp, Neisseria gonorrhoeae
ttaggcgataccctgcccgc

SEQ ID NO: 53654 - DNA, 20 bp, Neisseria gonorrhoeae
ggcgataccctgcccgccga

SEQ ID NO: 53655 - DNA, 20 bp, Neisseria gonorrhoeae
cgcaacctgcggattcaata

SEQ ID NO: 53656 - DNA, 20 bp, Neisseria gonorrhoeae
aataccggcaacaccgtatc

SEQ ID NO: 53657 - DNA, 20 bp, Neisseria gonorrhoeae
cggatgttgcgcacggtaag

SEQ ID NO: 53658 - DNA, 20 bp, Neisseria gonorrhoeae
cgcacggtaagcgcgtacag

SEQ ID NO: 53659 - DNA, 20 bp, Neisseria gonorrhoeae
cgccaaaccctcaggataat

SEQ ID NO: 53660 - DNA, 20 bp, Neisseria gonorrhoeae
tcctgagggtttggcggaat

SEQ ID NO: 53661 - DNA, 20 bp, Neisseria gonorrhoeae
ggcggaatcggccggggctg

SEQ ID NO: 53662 - DNA, 20 bp, Neisseria gonorrhoeae
tcgtcccattccccgtttgc

SEQ ID NO: 53663 - DNA, 20 bp, Neisseria gonorrhoeae
cccgtttgccagccccgtac

SEQ ID NO: 53664 - DNA, 20 bp, Neisseria gonorrhoeae
gccagccccgtacccaaata

SEQ ID NO: 53665 - DNA, 20 bp, Neisseria gonorrhoeae
ccagccccgtacccaaatac

SEQ ID NO: 53666 - DNA, 20 bp, Neisseria gonorrhoeae
gcgggcgagtatttgggtac

SEQ ID NO: 53667 - DNA, 20 bp, Neisseria gonorrhoeae
gtgctgggcacgtcttccaa

SEQ ID NO: 53668 - DNA, 20 bp, Neisseria gonorrhoeae
caaagccactttcagccgta

SEQ ID NO: 53669 - DNA, 20 bp, Neisseria gonorrhoeae
cagccgtatgttttgcaggt

SEQ ID NO: 53670 - DNA, 20 bp, Neisseria gonorrhoeae
agccgtatgttttgcaggtc

SEQ ID NO: 53671 - DNA, 20 bp, Neisseria gonorrhoeae
ggaagacgtgcccagcacca

SEQ ID NO: 53672 - DNA, 20 bp, Neisseria gonorrhoeae
ttttgtcgcgcaggcagtct

SEQ ID NO: 53673 - DNA, 20 bp, Neisseria gonorrhoeae
tttgtcgcgcaggcagtctg

SEQ ID NO: 53674 - DNA, 20 bp, Neisseria gonorrhoeae
ttgtcgcgcaggcagtctgc

SEQ ID NO: 53675 - DNA, 20 bp, Neisseria gonorrhoeae
tgtcgcgcaggcagtctgcc

SEQ ID NO: 53676 - DNA, 20 bp, Neisseria gonorrhoeae
gtcgcgcaggcagtctgccg

SEQ ID NO: 53677 - DNA, 20 bp, Neisseria gonorrhoeae
tcattgcacacgcccgcgat

SEQ ID NO: 53678 - DNA, 20 bp, Neisseria gonorrhoeae
cacacgcccgcgatgttcgg

SEQ ID NO: 53679 - DNA, 20 bp, Neisseria gonorrhoeae
ggcgtgcattgcccgccttt

SEQ ID NO: 53680 - DNA, 20 bp, Neisseria gonorrhoeae
cccgcctttggcggctttgc

SEQ ID NO: 53681 - DNA, 20 bp, Neisseria gonorrhoeae
ggcggctttgcgtatcgcgc

SEQ ID NO: 53682 - DNA, 20 bp, Neisseria gonorrhoeae
cgtccacaggccggcgccca

SEQ ID NO: 53683 - DNA, 20 bp, Neisseria gonorrhoeae
ccgccgtcatcgcgccggct

SEQ ID NO: 53684 - DNA, 20 bp, Neisseria gonorrhoeae
ggcgccggcctgtggacgca

SEQ ID NO: 53685 - DNA, 20 bp, Neisseria gonorrhoeae
ctgaaccgcggggcgatgcc

SEQ ID NO: 53686 - DNA, 20 bp, Neisseria gonorrhoeae
tgaaccgcggggcgatgccc

SEQ ID NO: 53687 - DNA, 20 bp, Neisseria gonorrhoeae
ttccagcgcgtcgcgcatcg

SEQ ID NO: 53688 - DNA, 20 bp, Neisseria gonorrhoeae
tccagcgcgtcgcgcatcgc

SEQ ID NO: 53689 - DNA, 20 bp, Neisseria gonorrhoeae
ccagcgcgtcgcgcatcgcc

SEQ ID NO: 53690 - DNA, 20 bp, Neisseria gonorrhoeae
gcgcgcggaagcccgccgcc

SEQ ID NO: 53691 - DNA, 20 bp, Neisseria gonorrhoeae
acaggccggatcctacacgc

SEQ ID NO: 53692 - DNA, 20 bp, Neisseria gonorrhoeae
caggccggatcctacacgcc

SEQ ID NO: 53693 - DNA, 20 bp, Neisseria gonorrhoeae
acgatgtgggcattcaggcg

SEQ ID NO: 53694 - DNA, 20 bp, Neisseria gonorrhoeae
cgatgtgggcattcaggcgg

SEQ ID NO: 53695 - DNA, 20 bp, Neisseria gonorrhoeae
ttgcggacaaaggcggcgcg

SEQ ID NO: 53696 - DNA, 20 bp, Neisseria gonorrhoeae
cggacaaaggcggcgcgttg

SEQ ID NO: 53697 - DNA, 20 bp, Neisseria gonorrhoeae
gtccgggccgtaaaagactc

SEQ ID NO: 53698 - DNA, 20 bp, Neisseria gonorrhoeae
cgacaacggcgccggcttca

SEQ ID NO: 53699 - DNA, 20 bp, Neisseria gonorrhoeae
tcgcaatgccggatgacgtc

SEQ ID NO: 53700 - DNA, 20 bp, Neisseria gonorrhoeae
tcgagaaaatgcgactgcgg

SEQ ID NO: 53701 - DNA, 20 bp, Neisseria gonorrhoeae
aagcggcaatgagggcggta

SEQ ID NO: 53702 - DNA, 20 bp, Neisseria gonorrhoeae
ccgcttcaagttgcggtccg

SEQ ID NO: 53703 - DNA, 20 bp, Neisseria gonorrhoeae
aagttgcggtccgcagtcgc

SEQ ID NO: 53704 - DNA, 20 bp, Neisseria gonorrhoeae
cggtccgcagtcgcattttc

SEQ ID NO: 53705 - DNA, 20 bp, Neisseria gonorrhoeae
tttgcggggttttcggcggg

SEQ ID NO: 53706 - DNA, 20 bp, Neisseria gonorrhoeae
gcggggttttcggcgggcga

SEQ ID NO: 53707 - DNA, 20 bp, Neisseria gonorrhoeae
cggggttttcggcgggcgat

SEQ ID NO: 53708 - DNA, 20 bp, Neisseria gonorrhoeae
tcggcgggcgatacttcggg

SEQ ID NO: 53709 - DNA, 20 bp, Neisseria gonorrhoeae
cggcgggcgatacttcgggc

SEQ ID NO: 53710 - DNA, 20 bp, Neisseria gonorrhoeae
ggtttttgcaatcgtattgc

SEQ ID NO: 53711 - DNA, 20 bp, Neisseria gonorrhoeae
gtttttgcaatcgtattgct

SEQ ID NO: 53712 - DNA, 20 bp, Neisseria gonorrhoeae
ttgcaatcgtattgctcagg

SEQ ID NO: 53713 - DNA, 20 bp, Neisseria gonorrhoeae
tgcaatcgtattgctcaggc

SEQ ID NO: 53714 - DNA, 20 bp, Neisseria gonorrhoeae
gcaatcgtattgctcaggct

SEQ ID NO: 53715 - DNA, 20 bp, Neisseria gonorrhoeae
caaaggctgcgagccgacgg

SEQ ID NO: 53716 - DNA, 20 bp, Neisseria gonorrhoeae
aaaggctgcgagccgacggg

SEQ ID NO: 53717 - DNA, 20 bp, Neisseria gonorrhoeae
tccaccaccaagagcgcgcc

SEQ ID NO: 53718 - DNA, 20 bp, Neisseria gonorrhoeae
gcggaattggcgcacggcat

SEQ ID NO: 53719 - DNA, 20 bp, Neisseria gonorrhoeae
gcgcacggcatcggcgcgct

SEQ ID NO: 53720 - DNA, 20 bp, Neisseria gonorrhoeae
tgttcgcggtatccggtttg

SEQ ID NO: 53721 - DNA, 20 bp, Neisseria gonorrhoeae
gcggtatccggtttgttctt

SEQ ID NO: 53722 - DNA, 20 bp, Neisseria gonorrhoeae
gttctttgccgccgcgtatg

SEQ ID NO: 53723 - DNA, 20 bp, Neisseria gonorrhoeae
ttctttgccgccgcgtatgg

SEQ ID NO: 53724 - DNA, 20 bp, Neisseria gonorrhoeae
tttgccgccgcgtatggcga

SEQ ID NO: 53725 - DNA, 20 bp, Neisseria gonorrhoeae
tggtcaacagccgtatgtgt

SEQ ID NO: 53726 - DNA, 20 bp, Neisseria gonorrhoeae
ggtcaacagccgtatgtgtg

SEQ ID NO: 53727 - DNA, 20 bp, Neisseria gonorrhoeae
gtcaacagccgtatgtgtgc

SEQ ID NO: 53728 - DNA, 20 bp, Neisseria gonorrhoeae
gcagatggggcggttgtttt

SEQ ID NO: 53729 - DNA, 20 bp, Neisseria gonorrhoeae
ttttcggcacacatacggct

SEQ ID NO: 53730 - DNA, 20 bp, Neisseria gonorrhoeae
ggaaggcaacaccctgcgcg

SEQ ID NO: 53731 - DNA, 20 bp, Neisseria gonorrhoeae
cgtcctcgccgatccggccg

SEQ ID NO: 53732 - DNA, 20 bp, Neisseria gonorrhoeae
tctttggtgttttggcgttt

SEQ ID NO: 53733 - DNA, 20 bp, Neisseria gonorrhoeae
ggtgttttggcgtttgccgg

SEQ ID NO: 53734 - DNA, 20 bp, Neisseria gonorrhoeae
gtgttttggcgtttgccggc

SEQ ID NO: 53735 - DNA, 20 bp, Neisseria gonorrhoeae
caggaaaaagccgcgtccgg

SEQ ID NO: 53736 - DNA, 20 bp, Neisseria gonorrhoeae
tccaccaccgaagccctgcg

SEQ ID NO: 53737 - DNA, 20 bp, Neisseria gonorrhoeae
gaaaaggtcaacgcgctggg

SEQ ID NO: 53738 - DNA, 20 bp, Neisseria gonorrhoeae
aaaaggtcaacgcgctgggc

SEQ ID NO: 53739 - DNA, 20 bp, Neisseria gonorrhoeae
cgcgccgatgcccagcgcgt

SEQ ID NO: 53740 - DNA, 20 bp, Neisseria gonorrhoeae
ccggcctgatagactgcccg

SEQ ID NO: 53741 - DNA, 20 bp, Neisseria gonorrhoeae
caggttttacgttttgcaga

SEQ ID NO: 53742 - DNA, 20 bp, Neisseria gonorrhoeae
tacgttttgcagacgaccgc

SEQ ID NO: 53743 - DNA, 20 bp, Neisseria gonorrhoeae
acgttttgcagacgaccgcg

SEQ ID NO: 53744 - DNA, 20 bp, Neisseria gonorrhoeae
cgttttgcagacgaccgcgt

SEQ ID NO: 53745 - DNA, 20 bp, Neisseria gonorrhoeae
gccgccgccgccgaaaacat

SEQ ID NO: 53746 - DNA, 20 bp, Neisseria gonorrhoeae
ccgccgccgccgaaaacatc

SEQ ID NO: 53747 - DNA, 20 bp, Neisseria gonorrhoeae
tcggcggcggcggcaaacag

SEQ ID NO: 53748 - DNA, 20 bp, Neisseria gonorrhoeae
cggcggcggcggcaaacagg

SEQ ID NO: 53749 - DNA, 20 bp, Neisseria gonorrhoeae
ggcggcggcggcaaacagga

SEQ ID NO: 53750 - DNA, 20 bp, Neisseria gonorrhoeae
taccgtaaaatccgcacggt

SEQ ID NO: 53751 - DNA, 20 bp, Neisseria gonorrhoeae
accgtaaaatccgcacggtt

SEQ ID NO: 53752 - DNA, 20 bp, Neisseria gonorrhoeae
ccgtaaaatccgcacggtta

SEQ ID NO: 53753 - DNA, 20 bp, Neisseria gonorrhoeae
ccaaccattgtttggccttg

SEQ ID NO: 53754 - DNA, 20 bp, Neisseria gonorrhoeae
tttggccttggctgccgatg

SEQ ID NO: 53755 - DNA, 20 bp, Neisseria gonorrhoeae
atgcgctacggcagccgcga

SEQ ID NO: 53756 - DNA, 20 bp, Neisseria gonorrhoeae
cgcttcgccgccgaaaagtt

SEQ ID NO: 53757 - DNA, 20 bp, Neisseria gonorrhoeae
gccgccgaaaagttcttttt

SEQ ID NO: 53758 - DNA, 20 bp, Neisseria gonorrhoeae
tttttcgcggctgccgtagc

SEQ ID NO: 53759 - DNA, 20 bp, Neisseria gonorrhoeae
ttcgcggctgccgtagcgca

SEQ ID NO: 53760 - DNA, 20 bp, Neisseria gonorrhoeae
gatgatgaaacaatacggct

SEQ ID NO: 53761 - DNA, 20 bp, Neisseria gonorrhoeae
tgcctattgccggtatggtt

SEQ ID NO: 53762 - DNA, 20 bp, Neisseria gonorrhoeae
ccggtatggtttcaagacgc

SEQ ID NO: 53763 - DNA, 20 bp, Neisseria gonorrhoeae
caagacgcttcacgccttcc

SEQ ID NO: 53764 - DNA, 20 bp, Neisseria gonorrhoeae
aagacgcttcacgccttcct

SEQ ID NO: 53765 - DNA, 20 bp, Neisseria gonorrhoeae
caaccggtacaccagaggtt

SEQ ID NO: 53766 - DNA, 20 bp, Neisseria gonorrhoeae
gtccactccggtcctctcgt

SEQ ID NO: 53767 - DNA, 20 bp, Neisseria gonorrhoeae
caacgcccactgcagatagg

SEQ ID NO: 53768 - DNA, 20 bp, Neisseria gonorrhoeae
gaagtttgacgggggctgct

SEQ ID NO: 53769 - DNA, 20 bp, Neisseria gonorrhoeae
gacgggggctgctcctagta

SEQ ID NO: 53770 - DNA, 20 bp, Neisseria gonorrhoeae
acgccgcccgccgaaatagc

SEQ ID NO: 53771 - DNA, 20 bp, Neisseria gonorrhoeae
cgccgcccgccgaaatagct

SEQ ID NO: 53772 - DNA, 20 bp, Neisseria gonorrhoeae
cgcccggcccggcggggccc

SEQ ID NO: 53773 - DNA, 20 bp, Neisseria gonorrhoeae
ggccttggctgccgatgagg

SEQ ID NO: 53774 - DNA, 20 bp, Neisseria gonorrhoeae
gccttggctgccgatgaggt

SEQ ID NO: 53775 - DNA, 20 bp, Neisseria gonorrhoeae
gcccgtgcggatacggattg

SEQ ID NO: 53776 - DNA, 20 bp, Neisseria gonorrhoeae
cctcctcgaccggcagcaca

SEQ ID NO: 53777 - DNA, 20 bp, Neisseria gonorrhoeae
ccgtcgccgattttgcccga

SEQ ID NO: 53778 - DNA, 20 bp, Neisseria gonorrhoeae
tgcccgaacgcgccacctcg

SEQ ID NO: 53779 - DNA, 20 bp, Neisseria gonorrhoeae
gcccgaacgcgccacctcga

SEQ ID NO: 53780 - DNA, 20 bp, Neisseria gonorrhoeae
gcgggcgcggcaacaggcgc

SEQ ID NO: 53781 - DNA, 20 bp, Neisseria gonorrhoeae
cgggcgcggcaacaggcgcg

SEQ ID NO: 53782 - DNA, 20 bp, Neisseria gonorrhoeae
gcgtccgaaagcgggcttga

SEQ ID NO: 53783 - DNA, 20 bp, Neisseria gonorrhoeae
cggacgcgaacctttgcccg

SEQ ID NO: 53784 - DNA, 20 bp, Neisseria gonorrhoeae
ggacgcgaacctttgcccgt

SEQ ID NO: 53785 - DNA, 20 bp, Neisseria gonorrhoeae
tctccatccacgacgtgggc

SEQ ID NO: 53786 - DNA, 20 bp, Neisseria gonorrhoeae
gacaagccgcccgcgcccac

SEQ ID NO: 53787 - DNA, 20 bp, Neisseria gonorrhoeae
tggtcgccgagctgccagca

SEQ ID NO: 53788 - DNA, 20 bp, Neisseria gonorrhoeae
ggtcgccgagctgccagcag

SEQ ID NO: 53789 - DNA, 20 bp, Neisseria gonorrhoeae
gtcgccgagctgccagcagc

SEQ ID NO: 53790 - DNA, 20 bp, Neisseria gonorrhoeae
ggtatttgccgaccatttgg

SEQ ID NO: 53791 - DNA, 20 bp, Neisseria gonorrhoeae
gtatttgccgaccatttggt

SEQ ID NO: 53792 - DNA, 20 bp, Neisseria gonorrhoeae
gccgaccatttggtcgcggt

SEQ ID NO: 53793 - DNA, 20 bp, Neisseria gonorrhoeae
ccgaccatttggtcgcggtg

SEQ ID NO: 53794 - DNA, 20 bp, Neisseria gonorrhoeae
ggtcgcggtgggtcatgccg

SEQ ID NO: 53795 - DNA, 20 bp, Neisseria gonorrhoeae
acccgcgccggattcgatgc

SEQ ID NO: 53796 - DNA, 20 bp, Neisseria gonorrhoeae
cgatttgcccgtttacgccc

SEQ ID NO: 53797 - DNA, 20 bp, Neisseria gonorrhoeae
gatttgcccgtttacgccct

SEQ ID NO: 53798 - DNA, 20 bp, Neisseria gonorrhoeae
gcccgtttacgccctgttcg

SEQ ID NO: 53799 - DNA, 20 bp, Neisseria gonorrhoeae
cccgtttacgccctgttcgc

SEQ ID NO: 53800 - DNA, 20 bp, Neisseria gonorrhoeae
caccctgccttgcgcgacca

SEQ ID NO: 53801 - DNA, 20 bp, Neisseria gonorrhoeae
cgcgaccaattcgccgcctt

SEQ ID NO: 53802 - DNA, 20 bp, Neisseria gonorrhoeae
gccgccttctttgccgatcc

SEQ ID NO: 53803 - DNA, 20 bp, Neisseria gonorrhoeae
ggatcggcaaagaaggcggc

SEQ ID NO: 53804 - DNA, 20 bp, Neisseria gonorrhoeae
gtcgcgcaaggcagggtgga

SEQ ID NO: 53805 - DNA, 20 bp, Neisseria gonorrhoeae
ttacggggatgtattttgcc

SEQ ID NO: 53806 - DNA, 20 bp, Neisseria gonorrhoeae
cggggatgtattttgccaag

SEQ ID NO: 53807 - DNA, 20 bp, Neisseria gonorrhoeae
tgccaagtggctgggcgcgg

SEQ ID NO: 53808 - DNA, 20 bp, Neisseria gonorrhoeae
gccaagtggctgggcgcgga

SEQ ID NO: 53809 - DNA, 20 bp, Neisseria gonorrhoeae
ccaagtggctgggcgcggaa

SEQ ID NO: 53810 - DNA, 20 bp, Neisseria gonorrhoeae
ccggttacaaaatgttgaag

SEQ ID NO: 53811 - DNA, 20 bp, Neisseria gonorrhoeae
caaaatgttgaagaacacgg

SEQ ID NO: 53812 - DNA, 20 bp, Neisseria gonorrhoeae
aagaacacggtcgtcatgcc

SEQ ID NO: 53813 - DNA, 20 bp, Neisseria gonorrhoeae
gcacgcgatgggcattgccg

SEQ ID NO: 53814 - DNA, 20 bp, Neisseria gonorrhoeae
ttcaacattttgtaaccggc

SEQ ID NO: 53815 - DNA, 20 bp, Neisseria gonorrhoeae
ccgtagccgccggcagcacc

SEQ ID NO: 53816 - DNA, 20 bp, Neisseria gonorrhoeae
acgaccaaccgtttctgtgc

SEQ ID NO: 53817 - DNA, 20 bp, Neisseria gonorrhoeae
gtcgtgaagactgcaccgac

SEQ ID NO: 53818 - DNA, 20 bp, Neisseria gonorrhoeae
ggcggcggcgagtccgacgg

SEQ ID NO: 53819 - DNA, 20 bp, Neisseria gonorrhoeae
gcggcggcgagtccgacggg

SEQ ID NO: 53820 - DNA, 20 bp, Neisseria gonorrhoeae
gtagatgccgtgcagggctt

SEQ ID NO: 53821 - DNA, 20 bp, Neisseria gonorrhoeae
ggcggcttcgtggtagccgg

SEQ ID NO: 53822 - DNA, 20 bp, Neisseria gonorrhoeae
gtggtagccggtgccgtagg

SEQ ID NO: 53823 - DNA, 20 bp, Neisseria gonorrhoeae
aggctgcccgaacactgcta

SEQ ID NO: 53824 - DNA, 20 bp, Neisseria gonorrhoeae
caacctccgcatcatcgacg

SEQ ID NO: 53825 - DNA, 20 bp, Neisseria gonorrhoeae
aaatagcagtgttcgggcag

SEQ ID NO: 53826 - DNA, 20 bp, Neisseria gonorrhoeae
gggcagcctgaacgcggccc

SEQ ID NO: 53827 - DNA, 20 bp, Neisseria gonorrhoeae
gtcttggttgatttgctcga

SEQ ID NO: 53828 - DNA, 20 bp, Neisseria gonorrhoeae
atcggcgaagacaagctgcc

SEQ ID NO: 53829 - DNA, 20 bp, Neisseria gonorrhoeae
tcggcgaagacaagctgccg

SEQ ID NO: 53830 - DNA, 20 bp, Neisseria gonorrhoeae
aaagaacaaatcaaacgcgc

SEQ ID NO: 53831 - DNA, 20 bp, Neisseria gonorrhoeae
tttgacggcgggcaggcggc

SEQ ID NO: 53832 - DNA, 20 bp, Neisseria gonorrhoeae
gacggcgggcaggcggctgc

SEQ ID NO: 53833 - DNA, 20 bp, Neisseria gonorrhoeae
cacccggcttcgccacccgc

SEQ ID NO: 53834 - DNA, 20 bp, Neisseria gonorrhoeae
gccacccgcaccccgtgggc

SEQ ID NO: 53835 - DNA, 20 bp, Neisseria gonorrhoeae
gaggtagatggggaggcgcg

SEQ ID NO: 53836 - DNA, 20 bp, Neisseria gonorrhoeae
aggtagatggggaggcgcgg

SEQ ID NO: 53837 - DNA, 20 bp, Neisseria gonorrhoeae
tgcccacggggtgcgggtgg

SEQ ID NO: 53838 - DNA, 20 bp, Neisseria gonorrhoeae
ttcataataattgccggttg

SEQ ID NO: 53839 - DNA, 20 bp, Neisseria gonorrhoeae
ataataattgccggttgcct

SEQ ID NO: 53840 - DNA, 20 bp, Neisseria gonorrhoeae
ccggttgcctccatgcagat

SEQ ID NO: 53841 - DNA, 20 bp, Neisseria gonorrhoeae
cctccatgcagatatgcaga

SEQ ID NO: 53842 - DNA, 20 bp, Neisseria gonorrhoeae
tgacatcccaagcttttcaa

SEQ ID NO: 53843 - DNA, 20 bp, Neisseria gonorrhoeae
ttcaacaacaaaacacacaa

SEQ ID NO: 53844 - DNA, 20 bp, Neisseria gonorrhoeae
aacaacaaaacacacaacgc

SEQ ID NO: 53845 - DNA, 20 bp, Neisseria gonorrhoeae
cgccaccaacccataggccg

SEQ ID NO: 53846 - DNA, 20 bp, Neisseria gonorrhoeae
cagacggcctatgggttggt

SEQ ID NO: 53847 - DNA, 20 bp, Neisseria gonorrhoeae
agacggcctatgggttggtg

SEQ ID NO: 53848 - DNA, 20 bp, Neisseria gonorrhoeae
gtacgtcaaagccgacaacc

SEQ ID NO: 53849 - DNA, 20 bp, Neisseria gonorrhoeae
acgcccacagcagcttcctc

SEQ ID NO: 53850 - DNA, 20 bp, Neisseria gonorrhoeae
cgcccacagcagcttcctct

SEQ ID NO: 53851 - DNA, 20 bp, Neisseria gonorrhoeae
ctctctgatacgccgcaaat

SEQ ID NO: 53852 - DNA, 20 bp, Neisseria gonorrhoeae
gcggcgtatcagagaggaag

SEQ ID NO: 53853 - DNA, 20 bp, Neisseria gonorrhoeae
ccagccaaatcggcagcggc

SEQ ID NO: 53854 - DNA, 20 bp, Neisseria gonorrhoeae
tggacgaaccctccatcggc

SEQ ID NO: 53855 - DNA, 20 bp, Neisseria gonorrhoeae
ggacgaaccctccatcggcc

SEQ ID NO: 53856 - DNA, 20 bp, Neisseria gonorrhoeae
gacgaaccctccatcggcct

SEQ ID NO: 53857 - DNA, 20 bp, Neisseria gonorrhoeae
tcgcgctggtgcaggccgat

SEQ ID NO: 53858 - DNA, 20 bp, Neisseria gonorrhoeae
tccttcaacgtcaaaggcgg

SEQ ID NO: 53859 - DNA, 20 bp, Neisseria gonorrhoeae
aacgtcaaaggcggccgctg

SEQ ID NO: 53860 - DNA, 20 bp, Neisseria gonorrhoeae
aagtcgaaatgcacttcctc

SEQ ID NO: 53861 - DNA, 20 bp, Neisseria gonorrhoeae
cgactttaatcacgccgtcg

SEQ ID NO: 53862 - DNA, 20 bp, Neisseria gonorrhoeae
gactttaatcacgccgtcgc

SEQ ID NO: 53863 - DNA, 20 bp, Neisseria gonorrhoeae
tcctgccgcgccgcgaccgc

SEQ ID NO: 53864 - DNA, 20 bp, Neisseria gonorrhoeae
cctgccgcgccgcgaccgcg

SEQ ID NO: 53865 - DNA, 20 bp, Neisseria gonorrhoeae
ctgccgcgccgcgaccgcgt

SEQ ID NO: 53866 - DNA, 20 bp, Neisseria gonorrhoeae
acgccgcccgccgaaatagc

SEQ ID NO: 53867 - DNA, 20 bp, Neisseria gonorrhoeae
cgccgcccgccgaaatagct

SEQ ID NO: 53868 - DNA, 20 bp, Neisseria gonorrhoeae
caattcgacttcttgcgcgc

SEQ ID NO: 53869 - DNA, 20 bp, Neisseria gonorrhoeae
aattcgacttcttgcgcgcc

SEQ ID NO: 53870 - DNA, 20 bp, Neisseria gonorrhoeae
gacttcttgcgcgcccaaac

SEQ ID NO: 53871 - DNA, 20 bp, Neisseria gonorrhoeae
ttgcgcgcccaaacgcatcg

SEQ ID NO: 53872 - DNA, 20 bp, Neisseria gonorrhoeae
cgcgcccaaacgcatcgtgc

SEQ ID NO: 53873 - DNA, 20 bp, Neisseria gonorrhoeae
ttttccacgcggtcaaatcc

SEQ ID NO: 53874 - DNA, 20 bp, Neisseria gonorrhoeae
tttccacgcggtcaaatccg

SEQ ID NO: 53875 - DNA, 20 bp, Neisseria gonorrhoeae
ttccacgcggtcaaatccgc

SEQ ID NO: 53876 - DNA, 20 bp, Neisseria gonorrhoeae
tccacgcggtcaaatccgcc

SEQ ID NO: 53877 - DNA, 20 bp, Neisseria gonorrhoeae
ccacgcggtcaaatccgcct

SEQ ID NO: 53878 - DNA, 20 bp, Neisseria gonorrhoeae
cccggtcgcgtccgtccaat

SEQ ID NO: 53879 - DNA, 20 bp, Neisseria gonorrhoeae
ccggtcgcgtccgtccaatt

SEQ ID NO: 53880 - DNA, 20 bp, Neisseria gonorrhoeae
ctgcgccacaccgcgcccgc

SEQ ID NO: 53881 - DNA, 20 bp, Neisseria gonorrhoeae
ccgcgtgtttcgccgttttg

SEQ ID NO: 53882 - DNA, 20 bp, Neisseria gonorrhoeae
cgccgttttgcgggatacgc

SEQ ID NO: 53883 - DNA, 20 bp, Neisseria gonorrhoeae
cgaggatgctgccgatgttg

SEQ ID NO: 53884 - DNA, 20 bp, Neisseria gonorrhoeae
gaggatgctgccgatgttgg

SEQ ID NO: 53885 - DNA, 20 bp, Neisseria gonorrhoeae
gggtctttttcggtcaggcg

SEQ ID NO: 53886 - DNA, 20 bp, Neisseria gonorrhoeae
ttcggtcaggcggaagatgc

SEQ ID NO: 53887 - DNA, 20 bp, Neisseria gonorrhoeae
tcggtcaggcggaagatgcc

SEQ ID NO: 53888 - DNA, 20 bp, Neisseria gonorrhoeae
agcgcggcgcggtcggtttt

SEQ ID NO: 53889 - DNA, 20 bp, Neisseria gonorrhoeae
tttcgaggcggacgacggcg

SEQ ID NO: 53890 - DNA, 20 bp, Neisseria gonorrhoeae
ttcgaggcggacgacggcga

SEQ ID NO: 53891 - DNA, 20 bp, Neisseria gonorrhoeae
tcgaggcggacgacggcgac

SEQ ID NO: 53892 - DNA, 20 bp, Neisseria gonorrhoeae
cgaggcggacgacggcgact

SEQ ID NO: 53893 - DNA, 20 bp, Neisseria gonorrhoeae
gccttagtcggcttctgggt

SEQ ID NO: 53894 - DNA, 20 bp, Neisseria gonorrhoeae
gtcggcttctgggtcatcgg

SEQ ID NO: 53895 - DNA, 20 bp, Neisseria gonorrhoeae
tgggtcatcggtatgacccc

SEQ ID NO: 53896 - DNA, 20 bp, Neisseria gonorrhoeae
tgctggtgttgaccgcattc

SEQ ID NO: 53897 - DNA, 20 bp, Neisseria gonorrhoeae
gctggtgttgaccgcattca

SEQ ID NO: 53898 - DNA, 20 bp, Neisseria gonorrhoeae
ggttgagctgctgaaaaacc

SEQ ID NO: 53899 - DNA, 20 bp, Neisseria gonorrhoeae
gttgagctgctgaaaaaccc

SEQ ID NO: 53900 - DNA, 20 bp, Neisseria gonorrhoeae
agctgctgaaaaacccgccc

SEQ ID NO: 53901 - DNA, 20 bp, Neisseria gonorrhoeae
ttggtcgagctgcttgccca

SEQ ID NO: 53902 - DNA, 20 bp, Neisseria gonorrhoeae
gtcgagctgcttgcccaccg

SEQ ID NO: 53903 - DNA, 20 bp, Neisseria gonorrhoeae
ccccatcggtatttccttcc

SEQ ID NO: 53904 - DNA, 20 bp, Neisseria gonorrhoeae
cccatcggtatttccttccc

SEQ ID NO: 53905 - DNA, 20 bp, Neisseria gonorrhoeae
ccttccccgcaggttcaggc

SEQ ID NO: 53906 - DNA, 20 bp, Neisseria gonorrhoeae
cttccccgcaggttcaggct

SEQ ID NO: 53907 - DNA, 20 bp, Neisseria gonorrhoeae
cccgcaggttcaggcttggt

SEQ ID NO: 53908 - DNA, 20 bp, Neisseria gonorrhoeae
tccgacgaaggtcactacgg

SEQ ID NO: 53909 - DNA, 20 bp, Neisseria gonorrhoeae
gtcggacaactctttcgcgt

SEQ ID NO: 53910 - DNA, 20 bp, Neisseria gonorrhoeae
cgcgtccattttggtcggcg

SEQ ID NO: 53911 - DNA, 20 bp, Neisseria gonorrhoeae
gcgtccattttggtcggcgg

SEQ ID NO: 53912 - DNA, 20 bp, Neisseria gonorrhoeae
tggtcggcggcgctacccac

SEQ ID NO: 53913 - DNA, 20 bp, Neisseria gonorrhoeae
ttcaagtgcatccgcgccgg

SEQ ID NO: 53914 - DNA, 20 bp, Neisseria gonorrhoeae
aagtgcatccgcgccggctg

SEQ ID NO: 53915 - DNA, 20 bp, Neisseria gonorrhoeae
gcggctttgccgcattttcc

SEQ ID NO: 53916 - DNA, 20 bp, Neisseria gonorrhoeae
cggctttgccgcattttccg

SEQ ID NO: 53917 - DNA, 20 bp, Neisseria gonorrhoeae
gccgcattttccgcagccgg

SEQ ID NO: 53918 - DNA, 20 bp, Neisseria gonorrhoeae
ggcgtggtcggcatcgacat

SEQ ID NO: 53919 - DNA, 20 bp, Neisseria gonorrhoeae
ggtggcgatggatttgttca

SEQ ID NO: 53920 - DNA, 20 bp, Neisseria gonorrhoeae
cagacggccccgccaccatg

SEQ ID NO: 53921 - DNA, 20 bp, Neisseria gonorrhoeae
agacggccccgccaccatgt

SEQ ID NO: 53922 - DNA, 20 bp, Neisseria gonorrhoeae
cgcccggttttgccaaactc

SEQ ID NO: 53923 - DNA, 20 bp, Neisseria gonorrhoeae
tgccaaactcgatgcgatgg

SEQ ID NO: 53924 - DNA, 20 bp, Neisseria gonorrhoeae
gccaaactcgatgcgatgga

SEQ ID NO: 53925 - DNA, 20 bp, Neisseria gonorrhoeae
ccaaactcgatgcgatggaa

SEQ ID NO: 53926 - DNA, 20 bp, Neisseria gonorrhoeae
gtgcccctcaaaaggatggg

SEQ ID NO: 53927 - DNA, 20 bp, Neisseria gonorrhoeae
tgtcggcgttccactgaacg

SEQ ID NO: 53928 - DNA, 20 bp, Neisseria gonorrhoeae
cactgaacggagatttcacc

SEQ ID NO: 53929 - DNA, 20 bp, Neisseria gonorrhoeae
caccctcaacctgcccgccg

SEQ ID NO: 53930 - DNA, 20 bp, Neisseria gonorrhoeae
accctcaacctgcccgccgt

SEQ ID NO: 53931 - DNA, 20 bp, Neisseria gonorrhoeae
ctgacggcttcgaggacggc

SEQ ID NO: 53932 - DNA, 20 bp, Neisseria gonorrhoeae
cggacattcctacgtcccgc

SEQ ID NO: 53933 - DNA, 20 bp, Neisseria gonorrhoeae
tttgtcgccgagtgcctgcc

SEQ ID NO: 53934 - DNA, 20 bp, Neisseria gonorrhoeae
ttgtcgccgagtgcctgccg

SEQ ID NO: 53935 - DNA, 20 bp, Neisseria gonorrhoeae
tgtcgccgagtgcctgccgg

SEQ ID NO: 53936 - DNA, 20 bp, Neisseria gonorrhoeae
gtcgccgagtgcctgccgga

SEQ ID NO: 53937 - DNA, 20 bp, Neisseria gonorrhoeae
gacggcggcatcgaagtcgg

SEQ ID NO: 53938 - DNA, 20 bp, Neisseria gonorrhoeae
ggcggagatgggggcagttt

SEQ ID NO: 53939 - DNA, 20 bp, Neisseria gonorrhoeae
gcggagatgggggcagtttt

SEQ ID NO: 53940 - DNA, 20 bp, Neisseria gonorrhoeae
tgtcgggcgagcggttgtat

SEQ ID NO: 53941 - DNA, 20 bp, Neisseria gonorrhoeae
gtcgggcgagcggttgtata

SEQ ID NO: 53942 - DNA, 20 bp, Neisseria gonorrhoeae
caaggcatcggttttctctg

SEQ ID NO: 53943 - DNA, 20 bp, Neisseria gonorrhoeae
tctctgtgcggactgtaaaa

SEQ ID NO: 53944 - DNA, 20 bp, Neisseria gonorrhoeae
ctctgtgcggactgtaaaat

SEQ ID NO: 53945 - DNA, 20 bp, Neisseria gonorrhoeae
tctgtgcggactgtaaaatt

SEQ ID NO: 53946 - DNA, 20 bp, Neisseria gonorrhoeae
taatcataattttacagtcc

SEQ ID NO: 53947 - DNA, 20 bp, Neisseria gonorrhoeae
ggcgggcgaacccggctggc

SEQ ID NO: 53948 - DNA, 20 bp, Neisseria gonorrhoeae
gcgggcgaacccggctggcg

SEQ ID NO: 53949 - DNA, 20 bp, Neisseria gonorrhoeae
tacctttccgcaaccggcgt

SEQ ID NO: 53950 - DNA, 20 bp, Neisseria gonorrhoeae
acctttccgcaaccggcgtg

SEQ ID NO: 53951 - DNA, 20 bp, Neisseria gonorrhoeae
cctttccgcaaccggcgtgg

SEQ ID NO: 53952 - DNA, 20 bp, Neisseria gonorrhoeae
gacgacgcaaaagacctggg

SEQ ID NO: 53953 - DNA, 20 bp, Neisseria gonorrhoeae
ccgcacaaatcgaagccgac

SEQ ID NO: 53954 - DNA, 20 bp, Neisseria gonorrhoeae
gatttgtgcggcaacgagtt

SEQ ID NO: 53955 - DNA, 20 bp, Neisseria gonorrhoeae
gtgcggcaacgagtttggcc

SEQ ID NO: 53956 - DNA, 20 bp, Neisseria gonorrhoeae
tgcggcaacgagtttggccg

SEQ ID NO: 53957 - DNA, 20 bp, Neisseria gonorrhoeae
tggccgtctgaaacttcagg

SEQ ID NO: 53958 - DNA, 20 bp, Neisseria gonorrhoeae
ggccgtctgaaacttcaggc

SEQ ID NO: 53959 - DNA, 20 bp, Neisseria gonorrhoeae
gccgtctgaaacttcaggca

SEQ ID NO: 53960 - DNA, 20 bp, Neisseria gonorrhoeae
aggcagcgcgcgacctttga

SEQ ID NO: 53961 - DNA, 20 bp, Neisseria gonorrhoeae
gaccacgctcatggcgtatt

SEQ ID NO: 53962 - DNA, 20 bp, Neisseria gonorrhoeae
tggcttgccattgcctgctg

SEQ ID NO: 53963 - DNA, 20 bp, Neisseria gonorrhoeae
ccattgcctgctggctgatt

SEQ ID NO: 53964 - DNA, 20 bp, Neisseria gonorrhoeae
cctgctggctgattttcttt

SEQ ID NO: 53965 - DNA, 20 bp, Neisseria gonorrhoeae
tcttttccaccctcaacccg

SEQ ID NO: 53966 - DNA, 20 bp, Neisseria gonorrhoeae
cttttccaccctcaacccgc

SEQ ID NO: 53967 - DNA, 20 bp, Neisseria gonorrhoeae
gtcgctatgattgcctcgct

SEQ ID NO: 53968 - DNA, 20 bp, Neisseria gonorrhoeae
cctcgctgtcggtcagatac

SEQ ID NO: 53969 - DNA, 20 bp, Neisseria gonorrhoeae
cccatgaaaaccacgtcgcc

SEQ ID NO: 53970 - DNA, 20 bp, Neisseria gonorrhoeae
aagcccctgatacggcggta

SEQ ID NO: 53971 - DNA, 20 bp, Neisseria gonorrhoeae
tcatgggcaagtttgccggc

SEQ ID NO: 53972 - DNA, 20 bp, Neisseria gonorrhoeae
ccggacaagcccccgcctac

SEQ ID NO: 53973 - DNA, 20 bp, Neisseria gonorrhoeae
tgccggtgtattggtaggcg

SEQ ID NO: 53974 - DNA, 20 bp, Neisseria gonorrhoeae
gccggtgtattggtaggcgg

SEQ ID NO: 53975 - DNA, 20 bp, Neisseria gonorrhoeae
ccggtgtattggtaggcggg

SEQ ID NO: 53976 - DNA, 20 bp, Neisseria gonorrhoeae
gtaggcgggggcttgtccgg

SEQ ID NO: 53977 - DNA, 20 bp, Neisseria gonorrhoeae
tctgaactccgttaaatttg

SEQ ID NO: 53978 - DNA, 20 bp, Neisseria gonorrhoeae
ctgaactccgttaaatttga

SEQ ID NO: 53979 - DNA, 20 bp, Neisseria gonorrhoeae
tgaactccgttaaatttgat

SEQ ID NO: 53980 - DNA, 20 bp, Neisseria gonorrhoeae
aatttgatggcaagaacccg

SEQ ID NO: 53981 - DNA, 20 bp, Neisseria gonorrhoeae
gatggcaagaacccgcaacc

SEQ ID NO: 53982 - DNA, 20 bp, Neisseria gonorrhoeae
atcgcatttgacgtgtagcc

SEQ ID NO: 53983 - DNA, 20 bp, Neisseria gonorrhoeae
gacgtgtagcctttgaactt

SEQ ID NO: 53984 - DNA, 20 bp, Neisseria gonorrhoeae
acgtgtagcctttgaacttt

SEQ ID NO: 53985 - DNA, 20 bp, Neisseria gonorrhoeae
gaacttttccagtgcggcga

SEQ ID NO: 53986 - DNA, 20 bp, Neisseria gonorrhoeae
aacttttccagtgcggcgag

SEQ ID NO: 53987 - DNA, 20 bp, Neisseria gonorrhoeae
cgcgcttgcgggcgtgaggt

SEQ ID NO: 53988 - DNA, 20 bp, Neisseria gonorrhoeae
cgggcgtgaggtcgggacgc

SEQ ID NO: 53989 - DNA, 20 bp, Neisseria gonorrhoeae
cttgtacatccgccgtggtg

SEQ ID NO: 53990 - DNA, 20 bp, Neisseria gonorrhoeae
tacatccgccgtggtgttgc

SEQ ID NO: 53991 - DNA, 20 bp, Neisseria gonorrhoeae
ccttgcgcgtccctgccgaa

SEQ ID NO: 53992 - DNA, 20 bp, Neisseria gonorrhoeae
gtcaaattttagaacggacg

SEQ ID NO: 53993 - DNA, 20 bp, Neisseria gonorrhoeae
tagaacggacggaatttcat

SEQ ID NO: 53994 - DNA, 20 bp, Neisseria gonorrhoeae
agaacggacggaatttcatg

SEQ ID NO: 53995 - DNA, 20 bp, Neisseria gonorrhoeae
gaacggacggaatttcatgc

SEQ ID NO: 53996 - DNA, 20 bp, Neisseria gonorrhoeae
catgcagtggcgttagcttt

SEQ ID NO: 53997 - DNA, 20 bp, Neisseria gonorrhoeae
cgccccttccctcttcccat

SEQ ID NO: 53998 - DNA, 20 bp, Neisseria gonorrhoeae
cctcttcccattccgttgtg

SEQ ID NO: 53999 - DNA, 20 bp, Neisseria gonorrhoeae
ccattccgttgtgaaagccc

SEQ ID NO: 54000 - DNA, 20 bp, Neisseria gonorrhoeae
cgttgtgaaagcccgaaccg

SEQ ID NO: 54001 - DNA, 20 bp, Neisseria gonorrhoeae
tgaaagcccgaaccgtgcct

SEQ ID NO: 54002 - DNA, 20 bp, Neisseria gonorrhoeae
agcagccagaagccccaagt

SEQ ID NO: 54003 - DNA, 20 bp, Neisseria gonorrhoeae
gtcgtcaaaccgcgcgttcg

SEQ ID NO: 54004 - DNA, 20 bp, Neisseria gonorrhoeae
tcgtcaaaccgcgcgttcgg

SEQ ID NO: 54005 - DNA, 20 bp, Neisseria gonorrhoeae
ggtttcaagtagcgcgcaac

SEQ ID NO: 54006 - DNA, 20 bp, Neisseria gonorrhoeae
cgcgctacttgaaaccgaac

SEQ ID NO: 54007 - DNA, 20 bp, Neisseria gonorrhoeae
caaagcggagaagcaggcgc

SEQ ID NO: 54008 - DNA, 20 bp, Neisseria gonorrhoeae
ccatagaggcggaggtagag

SEQ ID NO: 54009 - DNA, 20 bp, Neisseria gonorrhoeae
cgggcacgctgcaccacctg

SEQ ID NO: 54010 - DNA, 20 bp, Neisseria gonorrhoeae
tccggctctacctccgcctc

SEQ ID NO: 54011 - DNA, 20 bp, Neisseria gonorrhoeae
tccgctttggaagtcgtgcc

SEQ ID NO: 54012 - DNA, 20 bp, Neisseria gonorrhoeae
acccacatccccgtaatcca

SEQ ID NO: 54013 - DNA, 20 bp, Neisseria gonorrhoeae
tcgaatccctgagccgttgc

SEQ ID NO: 54014 - DNA, 20 bp, Neisseria gonorrhoeae
ccgccagttgcagcgcatac

SEQ ID NO: 54015 - DNA, 20 bp, Neisseria gonorrhoeae
cagcgcatacgccgcacaac

SEQ ID NO: 54016 - DNA, 20 bp, Neisseria gonorrhoeae
tgcggcgtatgcgctgcaac

SEQ ID NO: 54017 - DNA, 20 bp, Neisseria gonorrhoeae
gcggttcgcgtgtcaatgcc

SEQ ID NO: 54018 - DNA, 20 bp, Neisseria gonorrhoeae
gcgtgtcaatgccgtcagca

SEQ ID NO: 54019 - DNA, 20 bp, Neisseria gonorrhoeae
tccggcgagcgcatcgacgt

SEQ ID NO: 54020 - DNA, 20 bp, Neisseria gonorrhoeae
tcctttggtcgcccgagcct

SEQ ID NO: 54021 - DNA, 20 bp, Neisseria gonorrhoeae
ggtcgcccgagcctgcccaa

SEQ ID NO: 54022 - DNA, 20 bp, Neisseria gonorrhoeae
agccggagcagacggcagaa

SEQ ID NO: 54023 - DNA, 20 bp, Neisseria gonorrhoeae
cgcttctgccttggcacggg

SEQ ID NO: 54024 - DNA, 20 bp, Neisseria gonorrhoeae
tgccttggcacgggcttctg

SEQ ID NO: 54025 - DNA, 20 bp, Neisseria gonorrhoeae
gcacgggcttctgcgcgtgc

SEQ ID NO: 54026 - DNA, 20 bp, Neisseria gonorrhoeae
tgcgcgtgcggcagcttcgg

SEQ ID NO: 54027 - DNA, 20 bp, Neisseria gonorrhoeae
cggcggaaaccaaacccgcc

SEQ ID NO: 54028 - DNA, 20 bp, Neisseria gonorrhoeae
gccggttttttggcatcttt

SEQ ID NO: 54029 - DNA, 20 bp, Neisseria gonorrhoeae
tttggcatctttgcctttgc

SEQ ID NO: 54030 - DNA, 20 bp, Neisseria gonorrhoeae
ttggcatctttgcctttgcc

SEQ ID NO: 54031 - DNA, 20 bp, Neisseria gonorrhoeae
tggcatctttgcctttgccg

SEQ ID NO: 54032 - DNA, 20 bp, Neisseria gonorrhoeae
ggcggcatcccacggggctt

SEQ ID NO: 54033 - DNA, 20 bp, Neisseria gonorrhoeae
gcggcatcccacggggcttt

SEQ ID NO: 54034 - DNA, 20 bp, Neisseria gonorrhoeae
gcggctgtgcagctcgatat

SEQ ID NO: 54035 - DNA, 20 bp, Neisseria gonorrhoeae
cggctgtgcagctcgatatc

SEQ ID NO: 54036 - DNA, 20 bp, Neisseria gonorrhoeae
gcaggacgtggagcagatcg

SEQ ID NO: 54037 - DNA, 20 bp, Neisseria gonorrhoeae
ttcgacatggcgtgtggtgg

SEQ ID NO: 54038 - DNA, 20 bp, Neisseria gonorrhoeae
gacatggcgtgtggtggacg

SEQ ID NO: 54039 - DNA, 20 bp, Neisseria gonorrhoeae
ctgacttcgccgaagccgct

SEQ ID NO: 54040 - DNA, 20 bp, Neisseria gonorrhoeae
tgacttcgccgaagccgctg

SEQ ID NO: 54041 - DNA, 20 bp, Neisseria gonorrhoeae
gccgaagccgctgtcgcgca

SEQ ID NO: 54042 - DNA, 20 bp, Neisseria gonorrhoeae
tccagccattcctgcgccag

SEQ ID NO: 54043 - DNA, 20 bp, Neisseria gonorrhoeae
ctgcgccagcctgccctcga

SEQ ID NO: 54044 - DNA, 20 bp, Neisseria gonorrhoeae
gccgtcctgccactcggtct

SEQ ID NO: 54045 - DNA, 20 bp, Neisseria gonorrhoeae
gagggcaggctggcgcagga

SEQ ID NO: 54046 - DNA, 20 bp, Neisseria gonorrhoeae
cgcctattttccatcgtacc

SEQ ID NO: 54047 - DNA, 20 bp, Neisseria gonorrhoeae
tccatcgtaccgaaggttgc

SEQ ID NO: 54048 - DNA, 20 bp, Neisseria gonorrhoeae
ccatcgtaccgaaggttgcc

SEQ ID NO: 54049 - DNA, 20 bp, Neisseria gonorrhoeae
catcgtaccgaaggttgccg

SEQ ID NO: 54050 - DNA, 20 bp, Neisseria gonorrhoeae
ccgccactggtccgcataca

SEQ ID NO: 54051 - DNA, 20 bp, Neisseria gonorrhoeae
ggcagctattttgaatatcc

SEQ ID NO: 54052 - DNA, 20 bp, Neisseria gonorrhoeae
tgaatatccccgaagcacgc

SEQ ID NO: 54053 - DNA, 20 bp, Neisseria gonorrhoeae
gaatatccccgaagcacgca

SEQ ID NO: 54054 - DNA, 20 bp, Neisseria gonorrhoeae
aatatccccgaagcacgcag

SEQ ID NO: 54055 - DNA, 20 bp, Neisseria gonorrhoeae
ggggcgcgcgggcttggcgt

SEQ ID NO: 54056 - DNA, 20 bp, Neisseria gonorrhoeae
ttgagggcaagcagtggata

SEQ ID NO: 54057 - DNA, 20 bp, Neisseria gonorrhoeae
agggcaagcagtggataacc

SEQ ID NO: 54058 - DNA, 20 bp, Neisseria gonorrhoeae
gcattgcagacatcggacac

SEQ ID NO: 54059 - DNA, 20 bp, Neisseria gonorrhoeae
cagacatcggacaccttgtc

SEQ ID NO: 54060 - DNA, 20 bp, Neisseria gonorrhoeae
tcgtcttttgcggttatcca

SEQ ID NO: 54061 - DNA, 20 bp, Neisseria gonorrhoeae
ttcccgttgtcgggcggaca

SEQ ID NO: 54062 - DNA, 20 bp, Neisseria gonorrhoeae
ccgttgtcgggcggacaggc

SEQ ID NO: 54063 - DNA, 20 bp, Neisseria gonorrhoeae
tcgggcggacaggcaagctg

SEQ ID NO: 54064 - DNA, 20 bp, Neisseria gonorrhoeae
ccatcgcgcggctgcctttc

SEQ ID NO: 54065 - DNA, 20 bp, Neisseria gonorrhoeae
catcgcgcggctgcctttcg

SEQ ID NO: 54066 - DNA, 20 bp, Neisseria gonorrhoeae
tcttcggcattccgaaacgc

SEQ ID NO: 54067 - DNA, 20 bp, Neisseria gonorrhoeae
ggcattccgaaacgcaacgg

SEQ ID NO: 54068 - DNA, 20 bp, Neisseria gonorrhoeae
cgaaacgcaacgggcgggcc

SEQ ID NO: 54069 - DNA, 20 bp, Neisseria gonorrhoeae
ccgcggacgatgccgagcct

SEQ ID NO: 54070 - DNA, 20 bp, Neisseria gonorrhoeae
caggctcggcatcgtccgcg

SEQ ID NO: 54071 - DNA, 20 bp, Neisseria gonorrhoeae
caacgcccactgcagatagg

SEQ ID NO: 54072 - DNA, 20 bp, Neisseria gonorrhoeae
aaaacgtcgtgagacagttt

SEQ ID NO: 54073 - DNA, 20 bp, Neisseria gonorrhoeae
aaacgtcgtgagacagtttg

SEQ ID NO: 54074 - DNA, 20 bp, Neisseria gonorrhoeae
ggtccctatctgcagtgggc

SEQ ID NO: 54075 - DNA, 20 bp, Neisseria gonorrhoeae
gtccctatctgcagtgggcg

SEQ ID NO: 54076 - DNA, 20 bp, Neisseria gonorrhoeae
ttgaaaggcttgccgtatat

SEQ ID NO: 54077 - DNA, 20 bp, Neisseria gonorrhoeae
aaaggcttgccgtatatttg

SEQ ID NO: 54078 - DNA, 20 bp, Neisseria gonorrhoeae
ccgtatatttgaacaaataa

SEQ ID NO: 54079 - DNA, 20 bp, Neisseria gonorrhoeae
gaacaaataagcaattgaac

SEQ ID NO: 54080 - DNA, 20 bp, Neisseria gonorrhoeae
aacaaataagcaattgaacg

SEQ ID NO: 54081 - DNA, 20 bp, Neisseria gonorrhoeae
tgatgccgtctgttttcgac

SEQ ID NO: 54082 - DNA, 20 bp, Neisseria gonorrhoeae
tcgacattcccgcaggcagc

SEQ ID NO: 54083 - DNA, 20 bp, Neisseria gonorrhoeae
cgacattcccgcaggcagca

SEQ ID NO: 54084 - DNA, 20 bp, Neisseria gonorrhoeae
gacattcccgcaggcagcag

SEQ ID NO: 54085 - DNA, 20 bp, Neisseria gonorrhoeae
ccgcaggcagcagatcgacc

SEQ ID NO: 54086 - DNA, 20 bp, Neisseria gonorrhoeae
tgaccgtgcgcgaaaaatgg

SEQ ID NO: 54087 - DNA, 20 bp, Neisseria gonorrhoeae
tgccaaaatttcacgcccca

SEQ ID NO: 54088 - DNA, 20 bp, Neisseria gonorrhoeae
cacgccccagtagttggtgg

SEQ ID NO: 54089 - DNA, 20 bp, Neisseria gonorrhoeae
acgccccagtagttggtggt

SEQ ID NO: 54090 - DNA, 20 bp, Neisseria gonorrhoeae
gtggtgttcgcctgtacgga

SEQ ID NO: 54091 - DNA, 20 bp, Neisseria gonorrhoeae
gcggcaactgccgcgacgaa

SEQ ID NO: 54092 - DNA, 20 bp, Neisseria gonorrhoeae
cccggaatgcggctgccgta

SEQ ID NO: 54093 - DNA, 20 bp, Neisseria gonorrhoeae
cgggcaatctaccgtatgcg

SEQ ID NO: 54094 - DNA, 20 bp, Neisseria gonorrhoeae
gtcgcggcagttgccgcgaa

SEQ ID NO: 54095 - DNA, 20 bp, Neisseria gonorrhoeae
cgtcggcgtttctgacggcg

SEQ ID NO: 54096 - DNA, 20 bp, Neisseria gonorrhoeae
tcggccgtcggcggtacagt

SEQ ID NO: 54097 - DNA, 20 bp, Neisseria gonorrhoeae
cggccgtcggcggtacagtt

SEQ ID NO: 54098 - DNA, 20 bp, Neisseria gonorrhoeae
ggccgtcggcggtacagttc

SEQ ID NO: 54099 - DNA, 20 bp, Neisseria gonorrhoeae
cgcgccgcacaccccgcagg

SEQ ID NO: 54100 - DNA, 20 bp, Neisseria gonorrhoeae
tgggtggtcaagccgcgtat

SEQ ID NO: 54101 - DNA, 20 bp, Neisseria gonorrhoeae
cgccgctttggtcgatacgc

SEQ ID NO: 54102 - DNA, 20 bp, Neisseria gonorrhoeae
ggtcgatacgcggcttgacc

SEQ ID NO: 54103 - DNA, 20 bp, Neisseria gonorrhoeae
gtcgatacgcggcttgacca

SEQ ID NO: 54104 - DNA, 20 bp, Neisseria gonorrhoeae
accacccagaactgggtatc

SEQ ID NO: 54105 - DNA, 20 bp, Neisseria gonorrhoeae
gacgatatgctcgaagcggc

SEQ ID NO: 54106 - DNA, 20 bp, Neisseria gonorrhoeae
agcaatgcattcaaccgttt

SEQ ID NO: 54107 - DNA, 20 bp, Neisseria gonorrhoeae
aaccgtttggacagcacacg

SEQ ID NO: 54108 - DNA, 20 bp, Neisseria gonorrhoeae
ggacagcacacgcacctttg

SEQ ID NO: 54109 - DNA, 20 bp, Neisseria gonorrhoeae
gacagcacacgcacctttgt

SEQ ID NO: 54110 - DNA, 20 bp, Neisseria gonorrhoeae
cggcgacgaagcggcgttgc

SEQ ID NO: 54111 - DNA, 20 bp, Neisseria gonorrhoeae
ggcgacgaagcggcgttgct

SEQ ID NO: 54112 - DNA, 20 bp, Neisseria gonorrhoeae
cttgccgctgtcggcgagaa

SEQ ID NO: 54113 - DNA, 20 bp, Neisseria gonorrhoeae
ccgctgtcggcgagaagagc

SEQ ID NO: 54114 - DNA, 20 bp, Neisseria gonorrhoeae
gtcggcaacaccttgccgca

SEQ ID NO: 54115 - DNA, 20 bp, Neisseria gonorrhoeae
ccctgtggcgggcgcgtctt

SEQ ID NO: 54116 - DNA, 20 bp, Neisseria gonorrhoeae
cctgtggcgggcgcgtcttt

SEQ ID NO: 54117 - DNA, 20 bp, Neisseria gonorrhoeae
gttggacgaagcgaccgccg

SEQ ID NO: 54118 - DNA, 20 bp, Neisseria gonorrhoeae
ttggacgaagcgaccgccgc

SEQ ID NO: 54119 - DNA, 20 bp, Neisseria gonorrhoeae
gacgaagcgaccgccgccgc

SEQ ID NO: 54120 - DNA, 20 bp, Neisseria gonorrhoeae
gcaccggggcataccctgac

SEQ ID NO: 54121 - DNA, 20 bp, Neisseria gonorrhoeae
ccgccgcagccttcggttct

SEQ ID NO: 54122 - DNA, 20 bp, Neisseria gonorrhoeae
gcccggcacttgcgctgtgg

SEQ ID NO: 54123 - DNA, 20 bp, Neisseria gonorrhoeae
cccggcacttgcgctgtggg

SEQ ID NO: 54124 - DNA, 20 bp, Neisseria gonorrhoeae
cgctgtgggtgtcggtcagg

SEQ ID NO: 54125 - DNA, 20 bp, Neisseria gonorrhoeae
ccttccctgttgccggcacg

SEQ ID NO: 54126 - DNA, 20 bp, Neisseria gonorrhoeae
cttccctgttgccggcacgc

SEQ ID NO: 54127 - DNA, 20 bp, Neisseria gonorrhoeae
cctgttgccggcacgctgat

SEQ ID NO: 54128 - DNA, 20 bp, Neisseria gonorrhoeae
ccggcacgctgatgatcgaa

SEQ ID NO: 54129 - DNA, 20 bp, Neisseria gonorrhoeae
atcgccgccctgaaatccat

SEQ ID NO: 54130 - DNA, 20 bp, Neisseria gonorrhoeae
ccgctgcccctcgtgcgcga

SEQ ID NO: 54131 - DNA, 20 bp, Neisseria gonorrhoeae
tgttcgcgcacgaggggcag

SEQ ID NO: 54132 - DNA, 20 bp, Neisseria gonorrhoeae
gcgcacgaggggcagcggga

SEQ ID NO: 54133 - DNA, 20 bp, Neisseria gonorrhoeae
ttcgcgagagtacggatgcg

SEQ ID NO: 54134 - DNA, 20 bp, Neisseria gonorrhoeae
gcgagagtacggatgcgccc

SEQ ID NO: 54135 - DNA, 20 bp, Neisseria gonorrhoeae
tttaccgtcaacgccgaccg

SEQ ID NO: 54136 - DNA, 20 bp, Neisseria gonorrhoeae
ttaccgtcaacgccgaccgc

SEQ ID NO: 54137 - DNA, 20 bp, Neisseria gonorrhoeae
taccgtcaacgccgaccgca

SEQ ID NO: 54138 - DNA, 20 bp, Neisseria gonorrhoeae
accgtcaacgccgaccgcag

SEQ ID NO: 54139 - DNA, 20 bp, Neisseria gonorrhoeae
ccgtcaacgccgaccgcagg

SEQ ID NO: 54140 - DNA, 20 bp, Neisseria gonorrhoeae
cctttgccgaacaacaaatg

SEQ ID NO: 54141 - DNA, 20 bp, Neisseria gonorrhoeae
gccgaacaacaaatgctgca

SEQ ID NO: 54142 - DNA, 20 bp, Neisseria gonorrhoeae
ccgaacaacaaatgctgcac

SEQ ID NO: 54143 - DNA, 20 bp, Neisseria gonorrhoeae
gttgttcggcaaaggcaacc

SEQ ID NO: 54144 - DNA, 20 bp, Neisseria gonorrhoeae
ttgttcggcaaaggcaaccc

SEQ ID NO: 54145 - DNA, 20 bp, Neisseria gonorrhoeae
agcactttgccgcgcagggg

SEQ ID NO: 54146 - DNA, 20 bp, Neisseria gonorrhoeae
gccgcgcaggggcaggatgg

SEQ ID NO: 54147 - DNA, 20 bp, Neisseria gonorrhoeae
ccgcgcaggggcaggatggc

SEQ ID NO: 54148 - DNA, 20 bp, Neisseria gonorrhoeae
tgtggctttgtcgcgggcga

SEQ ID NO: 54149 - DNA, 20 bp, Neisseria gonorrhoeae
gtcgcgggcgagtttggcgg

SEQ ID NO: 54150 - DNA, 20 bp, Neisseria gonorrhoeae
tcagaccgtcggggtaatgc

SEQ ID NO: 54151 - DNA, 20 bp, Neisseria gonorrhoeae
cagaccgtcggggtaatgcc

SEQ ID NO: 54152 - DNA, 20 bp, Neisseria gonorrhoeae
agaccgtcggggtaatgcca

SEQ ID NO: 54153 - DNA, 20 bp, Neisseria gonorrhoeae
gggtgtgcgcttcgtcttcg

SEQ ID NO: 54154 - DNA, 20 bp, Neisseria gonorrhoeae
ggtgtgcgcttcgtcttcgc

SEQ ID NO: 54155 - DNA, 20 bp, Neisseria gonorrhoeae
tcgatgacttcttggcagat

SEQ ID NO: 54156 - DNA, 20 bp, Neisseria gonorrhoeae
ttggcagatatgtgtcgggc

SEQ ID NO: 54157 - DNA, 20 bp, Neisseria gonorrhoeae
gcagatatgtgtcgggctgt

SEQ ID NO: 54158 - DNA, 20 bp, Neisseria gonorrhoeae
gggcgaataggcaggcacgc

SEQ ID NO: 54159 - DNA, 20 bp, Neisseria gonorrhoeae
caagcccaactcttcagccg

SEQ ID NO: 54160 - DNA, 20 bp, Neisseria gonorrhoeae
aagcccaactcttcagccgc

SEQ ID NO: 54161 - DNA, 20 bp, Neisseria gonorrhoeae
agccgccttcaaatccacat

SEQ ID NO: 54162 - DNA, 20 bp, Neisseria gonorrhoeae
aaatccacattattgaagcc

SEQ ID NO: 54163 - DNA, 20 bp, Neisseria gonorrhoeae
gagctcgtccgcttcgggca

SEQ ID NO: 54164 - DNA, 20 bp, Neisseria gonorrhoeae
gggcatgacggcaacggtac

SEQ ID NO: 54165 - DNA, 20 bp, Neisseria gonorrhoeae
gctttcggtggcggggacgc

SEQ ID NO: 54166 - DNA, 20 bp, Neisseria gonorrhoeae
cggtggcggggacgcgctgc

SEQ ID NO: 54167 - DNA, 20 bp, Neisseria gonorrhoeae
ggtggcggggacgcgctgca

SEQ ID NO: 54168 - DNA, 20 bp, Neisseria gonorrhoeae
ccgtgtccgtagctttgcag

SEQ ID NO: 54169 - DNA, 20 bp, Neisseria gonorrhoeae
gcaggataagggcttgggcg

SEQ ID NO: 54170 - DNA, 20 bp, Neisseria gonorrhoeae
caggataagggcttgggcgg

SEQ ID NO: 54171 - DNA, 20 bp, Neisseria gonorrhoeae
ggcgggaagctgtccgagcc

SEQ ID NO: 54172 - DNA, 20 bp, Neisseria gonorrhoeae
ttggacggcaaagccgggga

SEQ ID NO: 54173 - DNA, 20 bp, Neisseria gonorrhoeae
gggatgcggacattgtgcca

SEQ ID NO: 54174 - DNA, 20 bp, Neisseria gonorrhoeae
tgccagccccgggtttcgtc

SEQ ID NO: 54175 - DNA, 20 bp, Neisseria gonorrhoeae
cgtcccactcggcaagtgcg

SEQ ID NO: 54176 - DNA, 20 bp, Neisseria gonorrhoeae
gtcccactcggcaagtgcgc

SEQ ID NO: 54177 - DNA, 20 bp, Neisseria gonorrhoeae
cggcaatgcccatttcggcg

SEQ ID NO: 54178 - DNA, 20 bp, Neisseria gonorrhoeae
acgcccaacgcttcccacac

SEQ ID NO: 54179 - DNA, 20 bp, Neisseria gonorrhoeae
ccacaccttcaacgcgtccg

SEQ ID NO: 54180 - DNA, 20 bp, Neisseria gonorrhoeae
aacgcgtccgccgtcgcctt

SEQ ID NO: 54181 - DNA, 20 bp, Neisseria gonorrhoeae
acatcgtgcacgcgcacgat

SEQ ID NO: 54182 - DNA, 20 bp, Neisseria gonorrhoeae
aaggtgtgggaagcgttggg

SEQ ID NO: 54183 - DNA, 20 bp, Neisseria gonorrhoeae
ccccgccgccgaaagccacg

SEQ ID NO: 54184 - DNA, 20 bp, Neisseria gonorrhoeae
cccgccgccgaaagccacgc

SEQ ID NO: 54185 - DNA, 20 bp, Neisseria gonorrhoeae
ggcggcaacgcggctgtctt

SEQ ID NO: 54186 - DNA, 20 bp, Neisseria gonorrhoeae
gcggcaacgcggctgtcttc

SEQ ID NO: 54187 - DNA, 20 bp, Neisseria gonorrhoeae
cgcccgattttcccgactga

SEQ ID NO: 54188 - DNA, 20 bp, Neisseria gonorrhoeae
gcaataaagaatacgcacca

SEQ ID NO: 54189 - DNA, 20 bp, Neisseria gonorrhoeae
cccggcgggtatagcgcacg

SEQ ID NO: 54190 - DNA, 20 bp, Neisseria gonorrhoeae
ttcaggcaggtcgggctgtt

SEQ ID NO: 54191 - DNA, 20 bp, Neisseria gonorrhoeae
tcaggcaggtcgggctgttg

SEQ ID NO: 54192 - DNA, 20 bp, Neisseria gonorrhoeae
caggcaggtcgggctgttgc

SEQ ID NO: 54193 - DNA, 20 bp, Neisseria gonorrhoeae
cggaaatcttcagcctgcag

SEQ ID NO: 54194 - DNA, 20 bp, Neisseria gonorrhoeae
agcctgcagcttgcgggctg

SEQ ID NO: 54195 - DNA, 20 bp, Neisseria gonorrhoeae
cgggctgccacaaccattca

SEQ ID NO: 54196 - DNA, 20 bp, Neisseria gonorrhoeae
acgattgcgatatacccggc

SEQ ID NO: 54197 - DNA, 20 bp, Neisseria gonorrhoeae
cgatatacccggcggcattc

SEQ ID NO: 54198 - DNA, 20 bp, Neisseria gonorrhoeae
ctcaaacggcggcgccgcat

SEQ ID NO: 54199 - DNA, 20 bp, Neisseria gonorrhoeae
gagtaaggcggcgcgtttgg

SEQ ID NO: 54200 - DNA, 20 bp, Neisseria gonorrhoeae
agtaaggcggcgcgtttggt

SEQ ID NO: 54201 - DNA, 20 bp, Neisseria gonorrhoeae
ggtatgcgacgcggcttggg

SEQ ID NO: 54202 - DNA, 20 bp, Neisseria gonorrhoeae
gtatgcgacgcggcttggga

SEQ ID NO: 54203 - DNA, 20 bp, Neisseria gonorrhoeae
gggcagaaatgcgcgcgtgt

SEQ ID NO: 54204 - DNA, 20 bp, Neisseria gonorrhoeae
ggcagaaatgcgcgcgtgtt

SEQ ID NO: 54205 - DNA, 20 bp, Neisseria gonorrhoeae
cagtttgacgtgtccgaccg

SEQ ID NO: 54206 - DNA, 20 bp, Neisseria gonorrhoeae
gacgtgtccgaccgcgaagc

SEQ ID NO: 54207 - DNA, 20 bp, Neisseria gonorrhoeae
acgtgtccgaccgcgaagcc

SEQ ID NO: 54208 - DNA, 20 bp, Neisseria gonorrhoeae
cgcccgaagacatcggccgg

SEQ ID NO: 54209 - DNA, 20 bp, Neisseria gonorrhoeae
atctgcacggcaccgggacg

SEQ ID NO: 54210 - DNA, 20 bp, Neisseria gonorrhoeae
ccgaaaaccgctgcaacggc

SEQ ID NO: 54211 - DNA, 20 bp, Neisseria gonorrhoeae
ccatactgtcgttgtggtgc

SEQ ID NO: 54212 - DNA, 20 bp, Neisseria gonorrhoeae
catactgtcgttgtggtgcg

SEQ ID NO: 54213 - DNA, 20 bp, Neisseria gonorrhoeae
ccgaccggcaaagcaatccc

SEQ ID NO: 54214 - DNA, 20 bp, Neisseria gonorrhoeae
cgccccggctttgggacggg

SEQ ID NO: 54215 - DNA, 20 bp, Neisseria gonorrhoeae
gggacgggcagaacgacccc

SEQ ID NO: 54216 - DNA, 20 bp, Neisseria gonorrhoeae
ggacgggcagaacgaccccg

SEQ ID NO: 54217 - DNA, 20 bp, Neisseria gonorrhoeae
atggcgggcaggtcggggtc

SEQ ID NO: 54218 - DNA, 20 bp, Neisseria gonorrhoeae
aggaggcggtatgggcaggc

SEQ ID NO: 54219 - DNA, 20 bp, Neisseria gonorrhoeae
ggaggcggtatgggcaggca

SEQ ID NO: 54220 - DNA, 20 bp, Neisseria gonorrhoeae
cgggcgcagacgttttctga

SEQ ID NO: 54221 - DNA, 20 bp, Neisseria gonorrhoeae
gggcgcagacgttttctgac

SEQ ID NO: 54222 - DNA, 20 bp, Neisseria gonorrhoeae
tctgacggctgccgccgttg

SEQ ID NO: 54223 - DNA, 20 bp, Neisseria gonorrhoeae
gcgtttgcctgtttgagcgc

SEQ ID NO: 54224 - DNA, 20 bp, Neisseria gonorrhoeae
gcctgtttgagcgcgtgttc

SEQ ID NO: 54225 - DNA, 20 bp, Neisseria gonorrhoeae
cctgtttgagcgcgtgttcg

SEQ ID NO: 54226 - DNA, 20 bp, Neisseria gonorrhoeae
gagcgcgtgttcggcggcgc

SEQ ID NO: 54227 - DNA, 20 bp, Neisseria gonorrhoeae
agcgcgtgttcggcggcgcg

SEQ ID NO: 54228 - DNA, 20 bp, Neisseria gonorrhoeae
gtaagatgccgcacccagtc

SEQ ID NO: 54229 - DNA, 20 bp, Neisseria gonorrhoeae
tagctgctgctgacattgcc

SEQ ID NO: 54230 - DNA, 20 bp, Neisseria gonorrhoeae
ccgccgctcaagctgccttg

SEQ ID NO: 54231 - DNA, 20 bp, Neisseria gonorrhoeae
gcgcgagccgttcgcattgg

SEQ ID NO: 54232 - DNA, 20 bp, Neisseria gonorrhoeae
ccgccaatgcgaacggctcg

SEQ ID NO: 54233 - DNA, 20 bp, Neisseria gonorrhoeae
tgcctcttcgcgcgactgtc

SEQ ID NO: 54234 - DNA, 20 bp, Neisseria gonorrhoeae
gcctcttcgcgcgactgtcc

SEQ ID NO: 54235 - DNA, 20 bp, Neisseria gonorrhoeae
cctcttcgcgcgactgtccg

SEQ ID NO: 54236 - DNA, 20 bp, Neisseria gonorrhoeae
gcgcgactgtccgccccatt

SEQ ID NO: 54237 - DNA, 20 bp, Neisseria gonorrhoeae
gaggctgtaaccgccgccca

SEQ ID NO: 54238 - DNA, 20 bp, Neisseria gonorrhoeae
ccaatgcggtgcggatgtcg

SEQ ID NO: 54239 - DNA, 20 bp, Neisseria gonorrhoeae
cgccgccgctgcggcacggt

SEQ ID NO: 54240 - DNA, 20 bp, Neisseria gonorrhoeae
cgtttgccgacatccgcacc

SEQ ID NO: 54241 - DNA, 20 bp, Neisseria gonorrhoeae
gtttgccgacatccgcaccg

SEQ ID NO: 54242 - DNA, 20 bp, Neisseria gonorrhoeae
gccgacatccgcaccgcatt

SEQ ID NO: 54243 - DNA, 20 bp, Neisseria gonorrhoeae
gtcgcacccgcaggcagttg

SEQ ID NO: 54244 - DNA, 20 bp, Neisseria gonorrhoeae
cacgctaaccataacgaagc

SEQ ID NO: 54245 - DNA, 20 bp, Neisseria gonorrhoeae
gtcttcggtcggcaggaacg

SEQ ID NO: 54246 - DNA, 20 bp, Neisseria gonorrhoeae
ggtcggcaggaacgaagtcg

SEQ ID NO: 54247 - DNA, 20 bp, Neisseria gonorrhoeae
tgggcgtgttcctgtttatg

SEQ ID NO: 54248 - DNA, 20 bp, Neisseria gonorrhoeae
gggaaaaatcttgtccttcg

SEQ ID NO: 54249 - DNA, 20 bp, Neisseria gonorrhoeae
ggaaaaatcttgtccttcgc

SEQ ID NO: 54250 - DNA, 20 bp, Neisseria gonorrhoeae
tccttcgcggcgcgccccga

SEQ ID NO: 54251 - DNA, 20 bp, Neisseria gonorrhoeae
gcggcgcgccccgatatagg

SEQ ID NO: 54252 - DNA, 20 bp, Neisseria gonorrhoeae
cggcgatttgctccgcgtgt

SEQ ID NO: 54253 - DNA, 20 bp, Neisseria gonorrhoeae
ggcgggatgtttggcaacca

SEQ ID NO: 54254 - DNA, 20 bp, Neisseria gonorrhoeae
gcgggatgtttggcaaccag

SEQ ID NO: 54255 - DNA, 20 bp, Neisseria gonorrhoeae
ggcaaccaggtcgaatacgg

SEQ ID NO: 54256 - DNA, 20 bp, Neisseria gonorrhoeae
gcaaccaggtcgaatacggc

SEQ ID NO: 54257 - DNA, 20 bp, Neisseria gonorrhoeae
ggtattgcggggaaaatctc

SEQ ID NO: 54258 - DNA, 20 bp, Neisseria gonorrhoeae
cgctgtcgaggaagcggcgg

SEQ ID NO: 54259 - DNA, 20 bp, Neisseria gonorrhoeae
gctgtcgaggaagcggcgga

SEQ ID NO: 54260 - DNA, 20 bp, Neisseria gonorrhoeae
tccggacagttgccgccgca

SEQ ID NO: 54261 - DNA, 20 bp, Neisseria gonorrhoeae
ccggacagttgccgccgcac

SEQ ID NO: 54262 - DNA, 20 bp, Neisseria gonorrhoeae
cggacagttgccgccgcaca

SEQ ID NO: 54263 - DNA, 20 bp, Neisseria gonorrhoeae
tccgaccgtcgcgggctgcc

SEQ ID NO: 54264 - DNA, 20 bp, Neisseria gonorrhoeae
ctcgaaaccctgtcggatat

SEQ ID NO: 54265 - DNA, 20 bp, Neisseria gonorrhoeae
cccggatatggcggcagccc

SEQ ID NO: 54266 - DNA, 20 bp, Neisseria gonorrhoeae
gggcagcatccagcccaata

SEQ ID NO: 54267 - DNA, 20 bp, Neisseria gonorrhoeae
caggtaaacagctgatccgt

SEQ ID NO: 54268 - DNA, 20 bp, Neisseria gonorrhoeae
ggacggagaaatgcgcggcg

SEQ ID NO: 54269 - DNA, 20 bp, Neisseria gonorrhoeae
gacggagaaatgcgcggcgg

SEQ ID NO: 54270 - DNA, 20 bp, Neisseria gonorrhoeae
acctggaagcaggcggtaga

SEQ ID NO: 54271 - DNA, 20 bp, Neisseria gonorrhoeae
gaggatttgcgccgcttcga

SEQ ID NO: 54272 - DNA, 20 bp, Neisseria gonorrhoeae
aggatttgcgccgcttcgat

SEQ ID NO: 54273 - DNA, 20 bp, Neisseria gonorrhoeae
gcgccgcttcgatgacgttg

SEQ ID NO: 54274 - DNA, 20 bp, Neisseria gonorrhoeae
cgccgcttcgatgacgttgc

SEQ ID NO: 54275 - DNA, 20 bp, Neisseria gonorrhoeae
gatgacgttgccccaatgca

SEQ ID NO: 54276 - DNA, 20 bp, Neisseria gonorrhoeae
gccggccgggaactgactcc

SEQ ID NO: 54277 - DNA, 20 bp, Neisseria gonorrhoeae
ccggccgggaactgactcca

SEQ ID NO: 54278 - DNA, 20 bp, Neisseria gonorrhoeae
ccgccccaaatacctgccca

SEQ ID NO: 54279 - DNA, 20 bp, Neisseria gonorrhoeae
attttactgttgttctgcct

SEQ ID NO: 54280 - DNA, 20 bp, Neisseria gonorrhoeae
tactgttgttctgcctgtcg

SEQ ID NO: 54281 - DNA, 20 bp, Neisseria gonorrhoeae
agcaggtggatgcggtgcca

SEQ ID NO: 54282 - DNA, 20 bp, Neisseria gonorrhoeae
gtcggaatagcggccgccca

SEQ ID NO: 54283 - DNA, 20 bp, Neisseria gonorrhoeae
caaacgtaccggtcctgatt

SEQ ID NO: 54284 - DNA, 20 bp, Neisseria gonorrhoeae
ggcacgtgtgggcggccgct

SEQ ID NO: 54285 - DNA, 20 bp, Neisseria gonorrhoeae
gcacgtgtgggcggccgcta

SEQ ID NO: 54286 - DNA, 20 bp, Neisseria gonorrhoeae
tcacgcgtggaacgtcaaat

SEQ ID NO: 54287 - DNA, 20 bp, Neisseria gonorrhoeae
cacgcgtggaacgtcaaatc

SEQ ID NO: 54288 - DNA, 20 bp, Neisseria gonorrhoeae
acgcgtggaacgtcaaatcc

SEQ ID NO: 54289 - DNA, 20 bp, Neisseria gonorrhoeae
gccccttatgacctcgacaa

SEQ ID NO: 54290 - DNA, 20 bp, Neisseria gonorrhoeae
tgacctcgacaaagaaaact

SEQ ID NO: 54291 - DNA, 20 bp, Neisseria gonorrhoeae
tcgagttggacacggccttc

SEQ ID NO: 54292 - DNA, 20 bp, Neisseria gonorrhoeae
gacacggccttcttcgcgca

SEQ ID NO: 54293 - DNA, 20 bp, Neisseria gonorrhoeae
ttcgcgcacggtgtcggcgt

SEQ ID NO: 54294 - DNA, 20 bp, Neisseria gonorrhoeae
gcgcacggtgtcggcgtttt

SEQ ID NO: 54295 - DNA, 20 bp, Neisseria gonorrhoeae
tgctggcggatgtaggcgcg

SEQ ID NO: 54296 - DNA, 20 bp, Neisseria gonorrhoeae
tgcgcgacgtatccgacgcg

SEQ ID NO: 54297 - DNA, 20 bp, Neisseria gonorrhoeae
gcgcgacgtatccgacgcgc

SEQ ID NO: 54298 - DNA, 20 bp, Neisseria gonorrhoeae
cgcgacgtatccgacgcgct

SEQ ID NO: 54299 - DNA, 20 bp, Neisseria gonorrhoeae
ccgccgtacaaacccagtcc

SEQ ID NO: 54300 - DNA, 20 bp, Neisseria gonorrhoeae
gtacggcggtaacgttgagt

SEQ ID NO: 54301 - DNA, 20 bp, Neisseria gonorrhoeae
cgaatacgtcggtgtcggcg

SEQ ID NO: 54302 - DNA, 20 bp, Neisseria gonorrhoeae
gggcggtacgacttcgatgc

SEQ ID NO: 54303 - DNA, 20 bp, Neisseria gonorrhoeae
gatgccgcgcaggtagaaga

SEQ ID NO: 54304 - DNA, 20 bp, Neisseria gonorrhoeae
tacctgcgcggcatcgaagt

SEQ ID NO: 54305 - DNA, 20 bp, Neisseria gonorrhoeae
gtaaccgtcgacgtattcgg

SEQ ID NO: 54306 - DNA, 20 bp, Neisseria gonorrhoeae
tgttgcccgaaccttggtcg

SEQ ID NO: 54307 - DNA, 20 bp, Neisseria gonorrhoeae
cccgaaccttggtcgcccat

SEQ ID NO: 54308 - DNA, 20 bp, Neisseria gonorrhoeae
gtcgcccataacggagacgt

SEQ ID NO: 54309 - DNA, 20 bp, Neisseria gonorrhoeae
acgtctccgttatgggcgac

SEQ ID NO: 54310 - DNA, 20 bp, Neisseria gonorrhoeae
cgtctccgttatgggcgacc

SEQ ID NO: 54311 - DNA, 20 bp, Neisseria gonorrhoeae
cgaccggcaatatgggtgta

SEQ ID NO: 54312 - DNA, 20 bp, Neisseria gonorrhoeae
ccagcccggcatggagcttt

SEQ ID NO: 54313 - DNA, 20 bp, Neisseria gonorrhoeae
cagcccggcatggagctttg

SEQ ID NO: 54314 - DNA, 20 bp, Neisseria gonorrhoeae
gccgcgcccaaagctccatg

SEQ ID NO: 54315 - DNA, 20 bp, Neisseria gonorrhoeae
ccgcgcccaaagctccatgc

SEQ ID NO: 54316 - DNA, 20 bp, Neisseria gonorrhoeae
gcaagttgcagcgtaatgcc

SEQ ID NO: 54317 - DNA, 20 bp, Neisseria gonorrhoeae
cagcgtaatgcctgccaatc

SEQ ID NO: 54318 - DNA, 20 bp, Neisseria gonorrhoeae
ccggcaagtttgtcggacac

SEQ ID NO: 54319 - DNA, 20 bp, Neisseria gonorrhoeae
gtcggacacctcatcatcct

SEQ ID NO: 54320 - DNA, 20 bp, Neisseria gonorrhoeae
tcggacacctcatcatcctc

SEQ ID NO: 54321 - DNA, 20 bp, Neisseria gonorrhoeae
cgcgctttctcgccctcgtc

SEQ ID NO: 54322 - DNA, 20 bp, Neisseria gonorrhoeae
ctcgccctcgtcccgcaagg

SEQ ID NO: 54323 - DNA, 20 bp, Neisseria gonorrhoeae
tcgccctcgtcccgcaaggc

SEQ ID NO: 54324 - DNA, 20 bp, Neisseria gonorrhoeae
atcagcggaacgctctgcct

SEQ ID NO: 54325 - DNA, 20 bp, Neisseria gonorrhoeae
ccgaatttgtcaggcagcag

SEQ ID NO: 54326 - DNA, 20 bp, Neisseria gonorrhoeae
ggcgttaacaccgagcttgt

SEQ ID NO: 54327 - DNA, 20 bp, Neisseria gonorrhoeae
acaccgagcttgtcgcacaa

SEQ ID NO: 54328 - DNA, 20 bp, Neisseria gonorrhoeae
tcgcacaactcctgtgcacg

SEQ ID NO: 54329 - DNA, 20 bp, Neisseria gonorrhoeae
tgcgacaagctcggtgttaa

SEQ ID NO: 54330 - DNA, 20 bp, Neisseria gonorrhoeae
acgccgaaccgtgcctgctg

SEQ ID NO: 54331 - DNA, 20 bp, Neisseria gonorrhoeae
tacagactcaaccacaccgg

SEQ ID NO: 54332 - DNA, 20 bp, Neisseria gonorrhoeae
acagactcaaccacaccgga

SEQ ID NO: 54333 - DNA, 20 bp, Neisseria gonorrhoeae
cagactcaaccacaccggac

SEQ ID NO: 54334 - DNA, 20 bp, Neisseria gonorrhoeae
ttcggcggcgaggttcgcac

SEQ ID NO: 54335 - DNA, 20 bp, Neisseria gonorrhoeae
ggcggcgaggttcgcaccga

SEQ ID NO: 54336 - DNA, 20 bp, Neisseria gonorrhoeae
ccaaagccgcacaagccttt

SEQ ID NO: 54337 - DNA, 20 bp, Neisseria gonorrhoeae
cccgacgcttcggcaatatt

SEQ ID NO: 54338 - DNA, 20 bp, Neisseria gonorrhoeae
ccgacgcttcggcaatattc

SEQ ID NO: 54339 - DNA, 20 bp, Neisseria gonorrhoeae
ggcaatattcgaacgcaata

SEQ ID NO: 54340 - DNA, 20 bp, Neisseria gonorrhoeae
cgttcgaatattgccgaagc

SEQ ID NO: 54341 - DNA, 20 bp, Neisseria gonorrhoeae
gtcccctccgcctgcggtgg

SEQ ID NO: 54342 - DNA, 20 bp, Neisseria gonorrhoeae
tcccctccgcctgcggtggc

SEQ ID NO: 54343 - DNA, 20 bp, Neisseria gonorrhoeae
gtgcggacaatgccgcgttg

SEQ ID NO: 54344 - DNA, 20 bp, Neisseria gonorrhoeae
tcgtgaaaagcggcggcggc

SEQ ID NO: 54345 - DNA, 20 bp, Neisseria gonorrhoeae
tcacgacaacgcggcattgt

SEQ ID NO: 54346 - DNA, 20 bp, Neisseria gonorrhoeae
tgctcgtttgccaaagcgcg

SEQ ID NO: 54347 - DNA, 20 bp, Neisseria gonorrhoeae
gctcgtttgccaaagcgcgc

SEQ ID NO: 54348 - DNA, 20 bp, Neisseria gonorrhoeae
ctcgtttgccaaagcgcgca

SEQ ID NO: 54349 - DNA, 20 bp, Neisseria gonorrhoeae
gccaaagcgcgcagttgttc

SEQ ID NO: 54350 - DNA, 20 bp, Neisseria gonorrhoeae
ccaaagcgcgcagttgttcg

SEQ ID NO: 54351 - DNA, 20 bp, Neisseria gonorrhoeae
cagacgtgccgccgtccatc

SEQ ID NO: 54352 - DNA, 20 bp, Neisseria gonorrhoeae
agacgtgccgccgtccatca

SEQ ID NO: 54353 - DNA, 20 bp, Neisseria gonorrhoeae
tggcattgctgccgatgcgg

SEQ ID NO: 54354 - DNA, 20 bp, Neisseria gonorrhoeae
ggcattgctgccgatgcgga

SEQ ID NO: 54355 - DNA, 20 bp, Neisseria gonorrhoeae
gcattgctgccgatgcggat

SEQ ID NO: 54356 - DNA, 20 bp, Neisseria gonorrhoeae
ttacctgctccagctctttg

SEQ ID NO: 54357 - DNA, 20 bp, Neisseria gonorrhoeae
cctgctccagctctttgccg

SEQ ID NO: 54358 - DNA, 20 bp, Neisseria gonorrhoeae
gccgccgcaggttatctgtg

SEQ ID NO: 54359 - DNA, 20 bp, Neisseria gonorrhoeae
ccgccgcaggttatctgtgg

SEQ ID NO: 54360 - DNA, 20 bp, Neisseria gonorrhoeae
tctgtggacaggcgcggcga

SEQ ID NO: 54361 - DNA, 20 bp, Neisseria gonorrhoeae
tcgggatgttgattcgagga

SEQ ID NO: 54362 - DNA, 20 bp, Neisseria gonorrhoeae
attcgaggaaaacttgcgca

SEQ ID NO: 54363 - DNA, 20 bp, Neisseria gonorrhoeae
gaggaaaacttgcgcacgtt

SEQ ID NO: 54364 - DNA, 20 bp, Neisseria gonorrhoeae
cgcacgttcgcgttcggcaa

SEQ ID NO: 54365 - DNA, 20 bp, Neisseria gonorrhoeae
gcgttcggcaaggcgcacca

SEQ ID NO: 54366 - DNA, 20 bp, Neisseria gonorrhoeae
tccacccgctttaaaagctg

SEQ ID NO: 54367 - DNA, 20 bp, Neisseria gonorrhoeae
ccacccgctttaaaagctgc

SEQ ID NO: 54368 - DNA, 20 bp, Neisseria gonorrhoeae
cacccgctttaaaagctgcg

SEQ ID NO: 54369 - DNA, 20 bp, Neisseria gonorrhoeae
taaagcgggtggaaaaccgt

SEQ ID NO: 54370 - DNA, 20 bp, Neisseria gonorrhoeae
aaagcgggtggaaaaccgtt

SEQ ID NO: 54371 - DNA, 20 bp, Neisseria gonorrhoeae
ctccgccgttcatcagggcg

SEQ ID NO: 54372 - DNA, 20 bp, Neisseria gonorrhoeae
tccgccgttcatcagggcgc

SEQ ID NO: 54373 - DNA, 20 bp, Neisseria gonorrhoeae
atcagggcgcgggcgatgga

SEQ ID NO: 54374 - DNA, 20 bp, Neisseria gonorrhoeae
gccgggcttgttgccctctt

SEQ ID NO: 54375 - DNA, 20 bp, Neisseria gonorrhoeae
cgccatttccaacgcctgct

SEQ ID NO: 54376 - DNA, 20 bp, Neisseria gonorrhoeae
ccaacgcctgcttgatgtct

SEQ ID NO: 54377 - DNA, 20 bp, Neisseria gonorrhoeae
caacgcctgcttgatgtcta

SEQ ID NO: 54378 - DNA, 20 bp, Neisseria gonorrhoeae
atgtctacggcgacgacgcg

SEQ ID NO: 54379 - DNA, 20 bp, Neisseria gonorrhoeae
ttcctgcatggttacgccga

SEQ ID NO: 54380 - DNA, 20 bp, Neisseria gonorrhoeae
gcatcgtccagcggggcatc

SEQ ID NO: 54381 - DNA, 20 bp, Neisseria gonorrhoeae
gtccagaaggcagaaggggg

SEQ ID NO: 54382 - DNA, 20 bp, Neisseria gonorrhoeae
aggctgaacagggcgaacac

SEQ ID NO: 54383 - DNA, 20 bp, Neisseria gonorrhoeae
gccctgttcagcctcaaccc

SEQ ID NO: 54384 - DNA, 20 bp, Neisseria gonorrhoeae
agcctcaaccccgccccctt

SEQ ID NO: 54385 - DNA, 20 bp, Neisseria gonorrhoeae
ggtcaggttttgatggtagc

SEQ ID NO: 54386 - DNA, 20 bp, Neisseria gonorrhoeae
tgatggtagcgtttggcgtt

SEQ ID NO: 54387 - DNA, 20 bp, Neisseria gonorrhoeae
gatggtagcgtttggcgttg

SEQ ID NO: 54388 - DNA, 20 bp, Neisseria gonorrhoeae
atggtagcgtttggcgttga

SEQ ID NO: 54389 - DNA, 20 bp, Neisseria gonorrhoeae
ggcgttgatcagggcctcct

SEQ ID NO: 54390 - DNA, 20 bp, Neisseria gonorrhoeae
caacacggtctgctcttccg

SEQ ID NO: 54391 - DNA, 20 bp, Neisseria gonorrhoeae
cgccaactgtgccagttcgc

SEQ ID NO: 54392 - DNA, 20 bp, Neisseria gonorrhoeae
gcgctcgatgtgttcgcggc

SEQ ID NO: 54393 - DNA, 20 bp, Neisseria gonorrhoeae
gcggcggatttgcccttggt

SEQ ID NO: 54394 - DNA, 20 bp, Neisseria gonorrhoeae
gcggaagagcagaccgtgtt

SEQ ID NO: 54395 - DNA, 20 bp, Neisseria gonorrhoeae
tttgatgccgccggagaggc

SEQ ID NO: 54396 - DNA, 20 bp, Neisseria gonorrhoeae
ttgatgccgccggagaggcc

SEQ ID NO: 54397 - DNA, 20 bp, Neisseria gonorrhoeae
tgatgccgccggagaggccg

SEQ ID NO: 54398 - DNA, 20 bp, Neisseria gonorrhoeae
gatgccgccggagaggccgt

SEQ ID NO: 54399 - DNA, 20 bp, Neisseria gonorrhoeae
atgccgccggagaggccgtc

SEQ ID NO: 54400 - DNA, 20 bp, Neisseria gonorrhoeae
cctgccaaaagtcggcggct

SEQ ID NO: 54401 - DNA, 20 bp, Neisseria gonorrhoeae
ctgctgttgcgacaggattt

SEQ ID NO: 54402 - DNA, 20 bp, Neisseria gonorrhoeae
cgacaggatttgcgacaacg

SEQ ID NO: 54403 - DNA, 20 bp, Neisseria gonorrhoeae
gcgacaacgcctgctgctgc

SEQ ID NO: 54404 - DNA, 20 bp, Neisseria gonorrhoeae
cgacaacgcctgctgctgcg

SEQ ID NO: 54405 - DNA, 20 bp, Neisseria gonorrhoeae
aacgccagttcgcggcggat

SEQ ID NO: 54406 - DNA, 20 bp, Neisseria gonorrhoeae
gcggcggatgcggtttgcct

SEQ ID NO: 54407 - DNA, 20 bp, Neisseria gonorrhoeae
gcctcgtcctgctgggtttg

SEQ ID NO: 54408 - DNA, 20 bp, Neisseria gonorrhoeae
cctcgtcctgctgggtttgg

SEQ ID NO: 54409 - DNA, 20 bp, Neisseria gonorrhoeae
ggaaggcagcgttgagcgtg

SEQ ID NO: 54410 - DNA, 20 bp, Neisseria gonorrhoeae
cttaatgtggcgggcagttt

SEQ ID NO: 54411 - DNA, 20 bp, Neisseria gonorrhoeae
atgtggcgggcagttttgcc

SEQ ID NO: 54412 - DNA, 20 bp, Neisseria gonorrhoeae
tgccggaccggaccgggctt

SEQ ID NO: 54413 - DNA, 20 bp, Neisseria gonorrhoeae
gccggaccggaccgggcttt

SEQ ID NO: 54414 - DNA, 20 bp, Neisseria gonorrhoeae
ccggaccggaccgggctttc

SEQ ID NO: 54415 - DNA, 20 bp, Neisseria gonorrhoeae
ggtccgattcagcagcaaat

SEQ ID NO: 54416 - DNA, 20 bp, Neisseria gonorrhoeae
agcagcaaatcgcccttgat

SEQ ID NO: 54417 - DNA, 20 bp, Neisseria gonorrhoeae
ataccggcctgtccgtgacc

SEQ ID NO: 54418 - DNA, 20 bp, Neisseria gonorrhoeae
tggcgttgcagtccgtcggc

SEQ ID NO: 54419 - DNA, 20 bp, Neisseria gonorrhoeae
gctgctgaatcggaccgaag

SEQ ID NO: 54420 - DNA, 20 bp, Neisseria gonorrhoeae
tgctacctcgacagccaagt

SEQ ID NO: 54421 - DNA, 20 bp, Neisseria gonorrhoeae
gtacagcttatcgcctccgg

SEQ ID NO: 54422 - DNA, 20 bp, Neisseria gonorrhoeae
tcgcctccggctacggcgaa

SEQ ID NO: 54423 - DNA, 20 bp, Neisseria gonorrhoeae
cggaaaatgtattcgccgta

SEQ ID NO: 54424 - DNA, 20 bp, Neisseria gonorrhoeae
gccgtagccggaggcgataa

SEQ ID NO: 54425 - DNA, 20 bp, Neisseria gonorrhoeae
agcaggaacaaaacggcaaa

SEQ ID NO: 54426 - DNA, 20 bp, Neisseria gonorrhoeae
ataccggcggtaagcctgtg

SEQ ID NO: 54427 - DNA, 20 bp, Neisseria gonorrhoeae
ccgccggtatgaacgccctt

SEQ ID NO: 54428 - DNA, 20 bp, Neisseria gonorrhoeae
ccattgtcggcctgctctac

SEQ ID NO: 54429 - DNA, 20 bp, Neisseria gonorrhoeae
tcggcctgctctacctggcc

SEQ ID NO: 54430 - DNA, 20 bp, Neisseria gonorrhoeae
ccggcagcggcattgagctg

SEQ ID NO: 54431 - DNA, 20 bp, Neisseria gonorrhoeae
cggcagcggcattgagctgc

SEQ ID NO: 54432 - DNA, 20 bp, Neisseria gonorrhoeae
agctgcaaaaaagcgggcaa

SEQ ID NO: 54433 - DNA, 20 bp, Neisseria gonorrhoeae
tcgggcaggtttgccgcgag

SEQ ID NO: 54434 - DNA, 20 bp, Neisseria gonorrhoeae
cgggcaggtttgccgcgagc

SEQ ID NO: 54435 - DNA, 20 bp, Neisseria gonorrhoeae
tcaaagcccatatcgcgctt

SEQ ID NO: 54436 - DNA, 20 bp, Neisseria gonorrhoeae
ccgaagccgtgttccccgaa

SEQ ID NO: 54437 - DNA, 20 bp, Neisseria gonorrhoeae
cccgaaaacatcccctcgcc

SEQ ID NO: 54438 - DNA, 20 bp, Neisseria gonorrhoeae
acgcgatttgccgcaaaccc

SEQ ID NO: 54439 - DNA, 20 bp, Neisseria gonorrhoeae
gccgcaaacccctgtggcag

SEQ ID NO: 54440 - DNA, 20 bp, Neisseria gonorrhoeae
ggcgtggtagcggttgaccc

SEQ ID NO: 54441 - DNA, 20 bp, Neisseria gonorrhoeae
acccattcgatttcgccgtc

SEQ ID NO: 54442 - DNA, 20 bp, Neisseria gonorrhoeae
gatttcgccgtcggtcatca

SEQ ID NO: 54443 - DNA, 20 bp, Neisseria gonorrhoeae
cgccgtcggtcatcagggcg

SEQ ID NO: 54444 - DNA, 20 bp, Neisseria gonorrhoeae
gccgtcggtcatcagggcgg

SEQ ID NO: 54445 - DNA, 20 bp, Neisseria gonorrhoeae
ggcgtgatgtcgaaaccgac

SEQ ID NO: 54446 - DNA, 20 bp, Neisseria gonorrhoeae
ctttcttgatgggcgtcttg

SEQ ID NO: 54447 - DNA, 20 bp, Neisseria gonorrhoeae
cttgatgggcgtcttgcgta

SEQ ID NO: 54448 - DNA, 20 bp, Neisseria gonorrhoeae
ttgatgggcgtcttgcgtat

SEQ ID NO: 54449 - DNA, 20 bp, Neisseria gonorrhoeae
atgggcgtcttgcgtatttt

SEQ ID NO: 54450 - DNA, 20 bp, Neisseria gonorrhoeae
gatgccctgttcggcaatca

SEQ ID NO: 54451 - DNA, 20 bp, Neisseria gonorrhoeae
atgccctgttcggcaatcac

SEQ ID NO: 54452 - DNA, 20 bp, Neisseria gonorrhoeae
ggcaatcacgtccacgccgt

SEQ ID NO: 54453 - DNA, 20 bp, Neisseria gonorrhoeae
cgatgccttcttcccattcc

SEQ ID NO: 54454 - DNA, 20 bp, Neisseria gonorrhoeae
ttcccattccgcgacggcgt

SEQ ID NO: 54455 - DNA, 20 bp, Neisseria gonorrhoeae
gagttcaaagcggttggcac

SEQ ID NO: 54456 - DNA, 20 bp, Neisseria gonorrhoeae
agttcaaagcggttggcacc

SEQ ID NO: 54457 - DNA, 20 bp, Neisseria gonorrhoeae
aaagcggttggcacctgctt

SEQ ID NO: 54458 - DNA, 20 bp, Neisseria gonorrhoeae
gcacctgctttgagcggcac

SEQ ID NO: 54459 - DNA, 20 bp, Neisseria gonorrhoeae
gagcggcacttccaatacgc

SEQ ID NO: 54460 - DNA, 20 bp, Neisseria gonorrhoeae
gtaggcggtcaaggtatcgg

SEQ ID NO: 54461 - DNA, 20 bp, Neisseria gonorrhoeae
taggcggtcaaggtatcggc

SEQ ID NO: 54462 - DNA, 20 bp, Neisseria gonorrhoeae
cagccgataccttgaccgcc

SEQ ID NO: 54463 - DNA, 20 bp, Neisseria gonorrhoeae
accgcctacaaactcgccta

SEQ ID NO: 54464 - DNA, 20 bp, Neisseria gonorrhoeae
ccagtttttcgcggcggaac

SEQ ID NO: 54465 - DNA, 20 bp, Neisseria gonorrhoeae
cagtttttcgcggcggaacg

SEQ ID NO: 54466 - DNA, 20 bp, Neisseria gonorrhoeae
ttcgcggcggaacgcaccat

SEQ ID NO: 54467 - DNA, 20 bp, Neisseria gonorrhoeae
tcgcggcggaacgcaccatg

SEQ ID NO: 54468 - DNA, 20 bp, Neisseria gonorrhoeae
cgcggcggaacgcaccatgg

SEQ ID NO: 54469 - DNA, 20 bp, Neisseria gonorrhoeae
caatacgaacacaatggcgg

SEQ ID NO: 54470 - DNA, 20 bp, Neisseria gonorrhoeae
tgagcgatacgccgagaaac

SEQ ID NO: 54471 - DNA, 20 bp, Neisseria gonorrhoeae
gagcgatacgccgagaaaca

SEQ ID NO: 54472 - DNA, 20 bp, Neisseria gonorrhoeae
agcgatacgccgagaaacac

SEQ ID NO: 54473 - DNA, 20 bp, Neisseria gonorrhoeae
ctcggcgtatcgctcaaaat

SEQ ID NO: 54474 - DNA, 20 bp, Neisseria gonorrhoeae
gaggataaacagcgtggagg

SEQ ID NO: 54475 - DNA, 20 bp, Neisseria gonorrhoeae
atcctcgaagcgatgttggg

SEQ ID NO: 54476 - DNA, 20 bp, Neisseria gonorrhoeae
tcctcgaagcgatgttgggc

SEQ ID NO: 54477 - DNA, 20 bp, Neisseria gonorrhoeae
ggcgtgtggacgcagcaggc

SEQ ID NO: 54478 - DNA, 20 bp, Neisseria gonorrhoeae
ccgccgcattgctgacttcc

SEQ ID NO: 54479 - DNA, 20 bp, Neisseria gonorrhoeae
atacaggcatcggcggcggc

SEQ ID NO: 54480 - DNA, 20 bp, Neisseria gonorrhoeae
cggtttggcgcggtaagcca

SEQ ID NO: 54481 - DNA, 20 bp, Neisseria gonorrhoeae
ggtttggcgcggtaagccac

SEQ ID NO: 54482 - DNA, 20 bp, Neisseria gonorrhoeae
ggcgcggtaagccacgccta

SEQ ID NO: 54483 - DNA, 20 bp, Neisseria gonorrhoeae
gcgcggtaagccacgcctat

SEQ ID NO: 54484 - DNA, 20 bp, Neisseria gonorrhoeae
caacgcattgggcagacaag

SEQ ID NO: 54485 - DNA, 20 bp, Neisseria gonorrhoeae
ggcagacaagccatgatttt

SEQ ID NO: 54486 - DNA, 20 bp, Neisseria gonorrhoeae
ttggtgtgcctgttgtcggt

SEQ ID NO: 54487 - DNA, 20 bp, Neisseria gonorrhoeae
tggtgtgcctgttgtcggtt

SEQ ID NO: 54488 - DNA, 20 bp, Neisseria gonorrhoeae
ggtgtgcctgttgtcggttt

SEQ ID NO: 54489 - DNA, 20 bp, Neisseria gonorrhoeae
aactatgctgtctaaattta

SEQ ID NO: 54490 - DNA, 20 bp, Neisseria gonorrhoeae
actatgctgtctaaatttac

SEQ ID NO: 54491 - DNA, 20 bp, Neisseria gonorrhoeae
acggcagataatcagcagcg

SEQ ID NO: 54492 - DNA, 20 bp, Neisseria gonorrhoeae
cggcagataatcagcagcgt

SEQ ID NO: 54493 - DNA, 20 bp, Neisseria gonorrhoeae
gaacacgattgaccgcttga

SEQ ID NO: 54494 - DNA, 20 bp, Neisseria gonorrhoeae
tgcgtttgatttgaaatcta

SEQ ID NO: 54495 - DNA, 20 bp, Neisseria gonorrhoeae
gatttgaaatctaccaatgg

SEQ ID NO: 54496 - DNA, 20 bp, Neisseria gonorrhoeae
atttgaaatctaccaatggc

SEQ ID NO: 54497 - DNA, 20 bp, Neisseria gonorrhoeae
gaaatctaccaatggcacac

SEQ ID NO: 54498 - DNA, 20 bp, Neisseria gonorrhoeae
aaatctaccaatggcacacc

SEQ ID NO: 54499 - DNA, 20 bp, Neisseria gonorrhoeae
ggagaagacggttttgaatt

SEQ ID NO: 54500 - DNA, 20 bp, Neisseria gonorrhoeae
tgaattgtgggacgaatggt

SEQ ID NO: 54501 - DNA, 20 bp, Neisseria gonorrhoeae
gaattgtgggacgaatggtc

SEQ ID NO: 54502 - DNA, 20 bp, Neisseria gonorrhoeae
aattgtgggacgaatggtcg

SEQ ID NO: 54503 - DNA, 20 bp, Neisseria gonorrhoeae
tgggacgaatggtcgcgcca

SEQ ID NO: 54504 - DNA, 20 bp, Neisseria gonorrhoeae
aatacggtggtttccaacgt

SEQ ID NO: 54505 - DNA, 20 bp, Neisseria gonorrhoeae
ccaacgtgaaattaagcaac

SEQ ID NO: 54506 - DNA, 20 bp, Neisseria gonorrhoeae
caacgtgaaattaagcaacc

SEQ ID NO: 54507 - DNA, 20 bp, Neisseria gonorrhoeae
agcaacctgaaaaacagcct

SEQ ID NO: 54508 - DNA, 20 bp, Neisseria gonorrhoeae
aggctcttctacatcgggtt

SEQ ID NO: 54509 - DNA, 20 bp, Neisseria gonorrhoeae
tcggctgctgacaagctcaa

SEQ ID NO: 54510 - DNA, 20 bp, Neisseria gonorrhoeae
atttggcgttcatcgggcat

SEQ ID NO: 54511 - DNA, 20 bp, Neisseria gonorrhoeae
ggcgttcatcgggcatctcg

SEQ ID NO: 54512 - DNA, 20 bp, Neisseria gonorrhoeae
gcgttcatcgggcatctcgc

SEQ ID NO: 54513 - DNA, 20 bp, Neisseria gonorrhoeae
atcgggcatctcgctttgtg

SEQ ID NO: 54514 - DNA, 20 bp, Neisseria gonorrhoeae
tgtcggtgtttggcaacgtg

SEQ ID NO: 54515 - DNA, 20 bp, Neisseria gonorrhoeae
ggcaacgtgatgatgctaaa

SEQ ID NO: 54516 - DNA, 20 bp, Neisseria gonorrhoeae
gcaacgtgatgatgctaaat

SEQ ID NO: 54517 - DNA, 20 bp, Neisseria gonorrhoeae
ttgcaatttgtagaaatcaa

SEQ ID NO: 54518 - DNA, 20 bp, Neisseria gonorrhoeae
tgcaatttgtagaaatcaaa

SEQ ID NO: 54519 - DNA, 20 bp, Neisseria gonorrhoeae
atcataatcggcggcatctg

SEQ ID NO: 54520 - DNA, 20 bp, Neisseria gonorrhoeae
tgtttgaaaactcgtaaaca

SEQ ID NO: 54521 - DNA, 20 bp, Neisseria gonorrhoeae
gtttgaaaactcgtaaacaa

SEQ ID NO: 54522 - DNA, 20 bp, Neisseria gonorrhoeae
tttgaaaactcgtaaacaag

SEQ ID NO: 54523 - DNA, 20 bp, Neisseria gonorrhoeae
gaaaactcgtaaacaagcgg

SEQ ID NO: 54524 - DNA, 20 bp, Neisseria gonorrhoeae
ttgcaaaatctgtttgtggc

SEQ ID NO: 54525 - DNA, 20 bp, Neisseria gonorrhoeae
caaaatctgtttgtggcagg

SEQ ID NO: 54526 - DNA, 20 bp, Neisseria gonorrhoeae
gtggcagggcagttggcgga

SEQ ID NO: 54527 - DNA, 20 bp, Neisseria gonorrhoeae
tggcagggcagttggcggaa

SEQ ID NO: 54528 - DNA, 20 bp, Neisseria gonorrhoeae
gcggaagcgatgcacaatct

SEQ ID NO: 54529 - DNA, 20 bp, Neisseria gonorrhoeae
tcgcgtgaaatgtttgaagc

SEQ ID NO: 54530 - DNA, 20 bp, Neisseria gonorrhoeae
cgcgtgaaatgtttgaagca

SEQ ID NO: 54531 - DNA, 20 bp, Neisseria gonorrhoeae
gcgtgaaatgtttgaagcat

SEQ ID NO: 54532 - DNA, 20 bp, Neisseria gonorrhoeae
gaagcattggacaatattcc

SEQ ID NO: 54533 - DNA, 20 bp, Neisseria gonorrhoeae
aagcattggacaatattcca

SEQ ID NO: 54534 - DNA, 20 bp, Neisseria gonorrhoeae
agccttttcgcgccattgcg

SEQ ID NO: 54535 - DNA, 20 bp, Neisseria gonorrhoeae
gccttttcgcgccattgcga

SEQ ID NO: 54536 - DNA, 20 bp, Neisseria gonorrhoeae
tcgcgccattgcgagttatc

SEQ ID NO: 54537 - DNA, 20 bp, Neisseria gonorrhoeae
cgcgccattgcgagttatcg

SEQ ID NO: 54538 - DNA, 20 bp, Neisseria gonorrhoeae
gcgccattgcgagttatcgg

SEQ ID NO: 54539 - DNA, 20 bp, Neisseria gonorrhoeae
caaatgcgcgattagattaa

SEQ ID NO: 54540 - DNA, 20 bp, Neisseria gonorrhoeae
gattaatcgtcattttttgt

SEQ ID NO: 54541 - DNA, 20 bp, Neisseria gonorrhoeae
atcgtcattttttgttggat

SEQ ID NO: 54542 - DNA, 20 bp, Neisseria gonorrhoeae
tttgttggattaaggcgtgc

SEQ ID NO: 54543 - DNA, 20 bp, Neisseria gonorrhoeae
ttgttggattaaggcgtgcc

SEQ ID NO: 54544 - DNA, 20 bp, Neisseria gonorrhoeae
gcgtgatagccgctgttgaa

SEQ ID NO: 54545 - DNA, 20 bp, Neisseria gonorrhoeae
aacaataacgcgctttcccg

SEQ ID NO: 54546 - DNA, 20 bp, Neisseria gonorrhoeae
cccgttggaaacgttgtgcg

SEQ ID NO: 54547 - DNA, 20 bp, Neisseria gonorrhoeae
ccgttggaaacgttgtgcga

SEQ ID NO: 54548 - DNA, 20 bp, Neisseria gonorrhoeae
gaaacgttgtgcgacaagct

SEQ ID NO: 54549 - DNA, 20 bp, Neisseria gonorrhoeae
ccgataatggcggcaatcac

SEQ ID NO: 54550 - DNA, 20 bp, Neisseria gonorrhoeae
accccgtcgggtacgggcag

SEQ ID NO: 54551 - DNA, 20 bp, Neisseria gonorrhoeae
gacgctgctggctatgtttg

SEQ ID NO: 54552 - DNA, 20 bp, Neisseria gonorrhoeae
gtcggtgtgattgccgccat

SEQ ID NO: 54553 - DNA, 20 bp, Neisseria gonorrhoeae
tcggtgtgattgccgccatt

SEQ ID NO: 54554 - DNA, 20 bp, Neisseria gonorrhoeae
cgctgcatcacagggcggcg

SEQ ID NO: 54555 - DNA, 20 bp, Neisseria gonorrhoeae
gtcaggcgcacgttttcgct

SEQ ID NO: 54556 - DNA, 20 bp, Neisseria gonorrhoeae
tcgctgatgttttcgtcgtc

SEQ ID NO: 54557 - DNA, 20 bp, Neisseria gonorrhoeae
cgctgatgttttcgtcgtcg

SEQ ID NO: 54558 - DNA, 20 bp, Neisseria gonorrhoeae
gctgatgttttcgtcgtcga

SEQ ID NO: 54559 - DNA, 20 bp, Neisseria gonorrhoeae
ttgccgttggctgacacttc

SEQ ID NO: 54560 - DNA, 20 bp, Neisseria gonorrhoeae
ccgttggctgacacttcgtc

SEQ ID NO: 54561 - DNA, 20 bp, Neisseria gonorrhoeae
gctgacacttcgtcaataac

SEQ ID NO: 54562 - DNA, 20 bp, Neisseria gonorrhoeae
gtcaataaccgatttctgtc

SEQ ID NO: 54563 - DNA, 20 bp, Neisseria gonorrhoeae
ctgtcgcccaggtaagtctt

SEQ ID NO: 54564 - DNA, 20 bp, Neisseria gonorrhoeae
accccgcctgccgacatcac

SEQ ID NO: 54565 - DNA, 20 bp, Neisseria gonorrhoeae
ccccgcctgccgacatcacc

SEQ ID NO: 54566 - DNA, 20 bp, Neisseria gonorrhoeae
acacacggcggcggcggcag

SEQ ID NO: 54567 - DNA, 20 bp, Neisseria gonorrhoeae
tctgccgccgccgccgtgtg

SEQ ID NO: 54568 - DNA, 20 bp, Neisseria gonorrhoeae
ctgccgccgccgccgtgtgt

SEQ ID NO: 54569 - DNA, 20 bp, Neisseria gonorrhoeae
gccctgagccccatcgcatc

SEQ ID NO: 54570 - DNA, 20 bp, Neisseria gonorrhoeae
ccaaaacggtacgcgccccg

SEQ ID NO: 54571 - DNA, 20 bp, Neisseria gonorrhoeae
accgccgcacggatatggcc

SEQ ID NO: 54572 - DNA, 20 bp, Neisseria gonorrhoeae
ccgccgcacggatatggccg

SEQ ID NO: 54573 - DNA, 20 bp, Neisseria gonorrhoeae
tggcaacggcggatgcgatg

SEQ ID NO: 54574 - DNA, 20 bp, Neisseria gonorrhoeae
gtctccatccacgccgacgc

SEQ ID NO: 54575 - DNA, 20 bp, Neisseria gonorrhoeae
caccagcccctccgcgcgcg

SEQ ID NO: 54576 - DNA, 20 bp, Neisseria gonorrhoeae
accagcccctccgcgcgcgg

SEQ ID NO: 54577 - DNA, 20 bp, Neisseria gonorrhoeae
agcatataaacccccgttcc

SEQ ID NO: 54578 - DNA, 20 bp, Neisseria gonorrhoeae
cgcgcgcggaggggctggtg

SEQ ID NO: 54579 - DNA, 20 bp, Neisseria gonorrhoeae
ctgtccaatcctgccgaaga

SEQ ID NO: 54580 - DNA, 20 bp, Neisseria gonorrhoeae
cgtcggcagtgcgcccaatc

SEQ ID NO: 54581 - DNA, 20 bp, Neisseria gonorrhoeae
ggcgcactgccgacggaagg

SEQ ID NO: 54582 - DNA, 20 bp, Neisseria gonorrhoeae
gctgcccagcagcttctctt

SEQ ID NO: 54583 - DNA, 20 bp, Neisseria gonorrhoeae
tcttcggcaggattggacag

SEQ ID NO: 54584 - DNA, 20 bp, Neisseria gonorrhoeae
cagggcttggaagtcggttt

SEQ ID NO: 54585 - DNA, 20 bp, Neisseria gonorrhoeae
gaagtcggtttcgcccgcct

SEQ ID NO: 54586 - DNA, 20 bp, Neisseria gonorrhoeae
cgcccgcctcgaccttgccg

SEQ ID NO: 54587 - DNA, 20 bp, Neisseria gonorrhoeae
gcccgcctcgaccttgccgc

SEQ ID NO: 54588 - DNA, 20 bp, Neisseria gonorrhoeae
ccgccggcaaattcccaata

SEQ ID NO: 54589 - DNA, 20 bp, Neisseria gonorrhoeae
ggacagggcggggccgtaga

SEQ ID NO: 54590 - DNA, 20 bp, Neisseria gonorrhoeae
gggcttgcccaatgcgtcgt

SEQ ID NO: 54591 - DNA, 20 bp, Neisseria gonorrhoeae
cccaatgcgtcgtgcccgat

SEQ ID NO: 54592 - DNA, 20 bp, Neisseria gonorrhoeae
cggaaggaaaccgcgcctcg

SEQ ID NO: 54593 - DNA, 20 bp, Neisseria gonorrhoeae
ccttccgcaacatcggcatc

SEQ ID NO: 54594 - DNA, 20 bp, Neisseria gonorrhoeae
tgcagacgctcgaactgcct

SEQ ID NO: 54595 - DNA, 20 bp, Neisseria gonorrhoeae
gcagacgctcgaactgcctg

SEQ ID NO: 54596 - DNA, 20 bp, Neisseria gonorrhoeae
cagacgctcgaactgcctga

SEQ ID NO: 54597 - DNA, 20 bp, Neisseria gonorrhoeae
gttcggcgtggctgtgtgcg

SEQ ID NO: 54598 - DNA, 20 bp, Neisseria gonorrhoeae
ttcggcgtggctgtgtgcgt

SEQ ID NO: 54599 - DNA, 20 bp, Neisseria gonorrhoeae
ggcgcggtgcagggttttga

SEQ ID NO: 54600 - DNA, 20 bp, Neisseria gonorrhoeae
tgagttcctgactgccgtac

SEQ ID NO: 54601 - DNA, 20 bp, Neisseria gonorrhoeae
gagttcctgactgccgtacc

SEQ ID NO: 54602 - DNA, 20 bp, Neisseria gonorrhoeae
agttcctgactgccgtacca

SEQ ID NO: 54603 - DNA, 20 bp, Neisseria gonorrhoeae
ctgactgccgtaccacgaca

SEQ ID NO: 54604 - DNA, 20 bp, Neisseria gonorrhoeae
tatgcgcggcgtgtccgaaa

SEQ ID NO: 54605 - DNA, 20 bp, Neisseria gonorrhoeae
attgccgcctgttgggtaaa

SEQ ID NO: 54606 - DNA, 20 bp, Neisseria gonorrhoeae
ccgcctgttgggtaaacgtg

SEQ ID NO: 54607 - DNA, 20 bp, Neisseria gonorrhoeae
ggtaaacgtgccctgcggcc

SEQ ID NO: 54608 - DNA, 20 bp, Neisseria gonorrhoeae
acccaacaggcggcaatcaa

SEQ ID NO: 54609 - DNA, 20 bp, Neisseria gonorrhoeae
ccgccaacccgtcccaactc

SEQ ID NO: 54610 - DNA, 20 bp, Neisseria gonorrhoeae
ttcgggttgcccccgttttg

SEQ ID NO: 54611 - DNA, 20 bp, Neisseria gonorrhoeae
tcgggttgcccccgttttgg

SEQ ID NO: 54612 - DNA, 20 bp, Neisseria gonorrhoeae
cgggttgcccccgttttggc

SEQ ID NO: 54613 - DNA, 20 bp, Neisseria gonorrhoeae
gggttgcccccgttttggct

SEQ ID NO: 54614 - DNA, 20 bp, Neisseria gonorrhoeae
gcgtcggacgcatagcggca

SEQ ID NO: 54615 - DNA, 20 bp, Neisseria gonorrhoeae
cgtcggacgcatagcggcac

SEQ ID NO: 54616 - DNA, 20 bp, Neisseria gonorrhoeae
tgtgccgctatgcgtccgac

SEQ ID NO: 54617 - DNA, 20 bp, Neisseria gonorrhoeae
gtgccgctatgcgtccgacg

SEQ ID NO: 54618 - DNA, 20 bp, Neisseria gonorrhoeae
tgccgctatgcgtccgacgc

SEQ ID NO: 54619 - DNA, 20 bp, Neisseria gonorrhoeae
atcctcctcacgaaaatacg

SEQ ID NO: 54620 - DNA, 20 bp, Neisseria gonorrhoeae
tcctcctcacgaaaatacgc

SEQ ID NO: 54621 - DNA, 20 bp, Neisseria gonorrhoeae
ctttcttgatgggcgtcttg

SEQ ID NO: 54622 - DNA, 20 bp, Neisseria gonorrhoeae
cttgatgggcgtcttgcgta

SEQ ID NO: 54623 - DNA, 20 bp, Neisseria gonorrhoeae
ttgatgggcgtcttgcgtat

SEQ ID NO: 54624 - DNA, 20 bp, Neisseria gonorrhoeae
ggcgtgcgctaccgcttctg

SEQ ID NO: 54625 - DNA, 20 bp, Neisseria gonorrhoeae
tgattccccgacaccgatgc

SEQ ID NO: 54626 - DNA, 20 bp, Neisseria gonorrhoeae
cccgacaccgatgccgtctg

SEQ ID NO: 54627 - DNA, 20 bp, Neisseria gonorrhoeae
agacggcatttttaatcgcc

SEQ ID NO: 54628 - DNA, 20 bp, Neisseria gonorrhoeae
ttaatcgcccgccgtttacg

SEQ ID NO: 54629 - DNA, 20 bp, Neisseria gonorrhoeae
tcggataaaacggttgccca

SEQ ID NO: 54630 - DNA, 20 bp, Neisseria gonorrhoeae
cccaaaccccgcgtcctaga

SEQ ID NO: 54631 - DNA, 20 bp, Neisseria gonorrhoeae
ccacttccgtgggaatgacg

SEQ ID NO: 54632 - DNA, 20 bp, Neisseria gonorrhoeae
cgtgggaatgacggttcggt

SEQ ID NO: 54633 - DNA, 20 bp, Neisseria gonorrhoeae
ggttgctacggcccgctgat

SEQ ID NO: 54634 - DNA, 20 bp, Neisseria gonorrhoeae
ccgccatcatcagccaaaac

SEQ ID NO: 54635 - DNA, 20 bp, Neisseria gonorrhoeae
gggcggcggataaatcgaat

SEQ ID NO: 54636 - DNA, 20 bp, Neisseria gonorrhoeae
ggcggcggataaatcgaatt

SEQ ID NO: 54637 - DNA, 20 bp, Neisseria gonorrhoeae
cccgtatgaccgagcgcggt

SEQ ID NO: 54638 - DNA, 20 bp, Neisseria gonorrhoeae
gatttatccgccgcccaaag

SEQ ID NO: 54639 - DNA, 20 bp, Neisseria gonorrhoeae
cgcaccagccgccgtcaatc

SEQ ID NO: 54640 - DNA, 20 bp, Neisseria gonorrhoeae
caaacgctcgcggatttcat

SEQ ID NO: 54641 - DNA, 20 bp, Neisseria gonorrhoeae
cataagggtcggtcaatggt

SEQ ID NO: 54642 - DNA, 20 bp, Neisseria gonorrhoeae
ataagggtcggtcaatggtt

SEQ ID NO: 54643 - DNA, 20 bp, Neisseria gonorrhoeae
accgacccttatgaaatccg

SEQ ID NO: 54644 - DNA, 20 bp, Neisseria gonorrhoeae
ggtggaacgaggtgtccatc

SEQ ID NO: 54645 - DNA, 20 bp, Neisseria gonorrhoeae
gtggaacgaggtgtccatca

SEQ ID NO: 54646 - DNA, 20 bp, Neisseria gonorrhoeae
ggcaggccgggaaagtgttc

SEQ ID NO: 54647 - DNA, 20 bp, Neisseria gonorrhoeae
ctgcgcggcgaggatgccgc

SEQ ID NO: 54648 - DNA, 20 bp, Neisseria gonorrhoeae
gcggggttgtgcagcggggc

SEQ ID NO: 54649 - DNA, 20 bp, Neisseria gonorrhoeae
tttacgcgttccgccgcctg

SEQ ID NO: 54650 - DNA, 20 bp, Neisseria gonorrhoeae
acgcgttccgccgcctgcgg

SEQ ID NO: 54651 - DNA, 20 bp, Neisseria gonorrhoeae
cgcgttccgccgcctgcggc

SEQ ID NO: 54652 - DNA, 20 bp, Neisseria gonorrhoeae
cgccgcctgcggcaaggttg

SEQ ID NO: 54653 - DNA, 20 bp, Neisseria gonorrhoeae
accagcgtaccgagcacggc

SEQ ID NO: 54654 - DNA, 20 bp, Neisseria gonorrhoeae
acggttttgccgctggaggc

SEQ ID NO: 54655 - DNA, 20 bp, Neisseria gonorrhoeae
cggttttgccgctggaggcg

SEQ ID NO: 54656 - DNA, 20 bp, Neisseria gonorrhoeae
tgccgctggaggcggtgtaa

SEQ ID NO: 54657 - DNA, 20 bp, Neisseria gonorrhoeae
gccgctggaggcggtgtaat

SEQ ID NO: 54658 - DNA, 20 bp, Neisseria gonorrhoeae
ccgctggaggcggtgtaatc

SEQ ID NO: 54659 - DNA, 20 bp, Neisseria gonorrhoeae
tcgggcaaaatcgccggcgg

SEQ ID NO: 54660 - DNA, 20 bp, Neisseria gonorrhoeae
atgtacgttcccctgccagt

SEQ ID NO: 54661 - DNA, 20 bp, Neisseria gonorrhoeae
ccctgccagtgcgccttccc

SEQ ID NO: 54662 - DNA, 20 bp, Neisseria gonorrhoeae
ggaaggcgcactggcagggg

SEQ ID NO: 54663 - DNA, 20 bp, Neisseria gonorrhoeae
agaggtatgcgtccgccggc

SEQ ID NO: 54664 - DNA, 20 bp, Neisseria gonorrhoeae
ggccgtctgaaggctcttcg

SEQ ID NO: 54665 - DNA, 20 bp, Neisseria gonorrhoeae
gccgtctgaaggctcttcgt

SEQ ID NO: 54666 - DNA, 20 bp, Neisseria gonorrhoeae
gtaaggcttcgccagccctt

SEQ ID NO: 54667 - DNA, 20 bp, Neisseria gonorrhoeae
gccagccctttcgccgccaa

SEQ ID NO: 54668 - DNA, 20 bp, Neisseria gonorrhoeae
cgccgccaaatcggcggtgg

SEQ ID NO: 54669 - DNA, 20 bp, Neisseria gonorrhoeae
tcgcgccctcgccgaaaaat

SEQ ID NO: 54670 - DNA, 20 bp, Neisseria gonorrhoeae
gacaaacgccccgaccacgc

SEQ ID NO: 54671 - DNA, 20 bp, Neisseria gonorrhoeae
acgcaagaattcggtcagtg

SEQ ID NO: 54672 - DNA, 20 bp, Neisseria gonorrhoeae
cgcaagaattcggtcagtgc

SEQ ID NO: 54673 - DNA, 20 bp, Neisseria gonorrhoeae
gcactgaccgaattcttgcg

SEQ ID NO: 54674 - DNA, 20 bp, Neisseria gonorrhoeae
ccgcttccaaaccgcccacg

SEQ ID NO: 54675 - DNA, 20 bp, Neisseria gonorrhoeae
cgcttccaaaccgcccacgc

SEQ ID NO: 54676 - DNA, 20 bp, Neisseria gonorrhoeae
caaaccgcccacgccacgga

SEQ ID NO: 54677 - DNA, 20 bp, Neisseria gonorrhoeae
atgcgctgggcgtgatttcc

SEQ ID NO: 54678 - DNA, 20 bp, Neisseria gonorrhoeae
ccgtggcgtgggcggtttgg

SEQ ID NO: 54679 - DNA, 20 bp, Neisseria gonorrhoeae
cgctcggtcaggacgacctc

SEQ ID NO: 54680 - DNA, 20 bp, Neisseria gonorrhoeae
cgtcggtcatggtgcgccgc

SEQ ID NO: 54681 - DNA, 20 bp, Neisseria gonorrhoeae
tcccgatacggttgaggtcg

SEQ ID NO: 54682 - DNA, 20 bp, Neisseria gonorrhoeae
cccgatacggttgaggtcgt

SEQ ID NO: 54683 - DNA, 20 bp, Neisseria gonorrhoeae
ccgatacggttgaggtcgtc

SEQ ID NO: 54684 - DNA, 20 bp, Neisseria gonorrhoeae
ggcaacttgatgtcgccgta

SEQ ID NO: 54685 - DNA, 20 bp, Neisseria gonorrhoeae
gcaacttgatgtcgccgtat

SEQ ID NO: 54686 - DNA, 20 bp, Neisseria gonorrhoeae
atgtcgccgtatttttggaa

SEQ ID NO: 54687 - DNA, 20 bp, Neisseria gonorrhoeae
ttggaagcggcggccgacgc

SEQ ID NO: 54688 - DNA, 20 bp, Neisseria gonorrhoeae
tggaagcggcggccgacgcc

SEQ ID NO: 54689 - DNA, 20 bp, Neisseria gonorrhoeae
ctcaaactcgcacccaaacc

SEQ ID NO: 54690 - DNA, 20 bp, Neisseria gonorrhoeae
ccatcagagagtgggtaagc

SEQ ID NO: 54691 - DNA, 20 bp, Neisseria gonorrhoeae
cccactctctgatggcaatc

SEQ ID NO: 54692 - DNA, 20 bp, Neisseria gonorrhoeae
ggtatgggtttgggtgcgag

SEQ ID NO: 54693 - DNA, 20 bp, Neisseria gonorrhoeae
aagccgcagccgtccaaatc

SEQ ID NO: 54694 - DNA, 20 bp, Neisseria gonorrhoeae
gcggcgcatcgacgccgatc

SEQ ID NO: 54695 - DNA, 20 bp, Neisseria gonorrhoeae
cggcgcatcgacgccgatca

SEQ ID NO: 54696 - DNA, 20 bp, Neisseria gonorrhoeae
tgccttatctttcaacgcgt

SEQ ID NO: 54697 - DNA, 20 bp, Neisseria gonorrhoeae
gccttatctttcaacgcgtc

SEQ ID NO: 54698 - DNA, 20 bp, Neisseria gonorrhoeae
gatgtcgcctagcacgcgcc

SEQ ID NO: 54699 - DNA, 20 bp, Neisseria gonorrhoeae
tgcttgaacgcctcgatatc

SEQ ID NO: 54700 - DNA, 20 bp, Neisseria gonorrhoeae
gcttgaacgcctcgatatcc

SEQ ID NO: 54701 - DNA, 20 bp, Neisseria gonorrhoeae
cttgaacgcctcgatatccg

SEQ ID NO: 54702 - DNA, 20 bp, Neisseria gonorrhoeae
aacgcctcgatatccggctg

SEQ ID NO: 54703 - DNA, 20 bp, Neisseria gonorrhoeae
ttgacgaggtgggtttgcgg

SEQ ID NO: 54704 - DNA, 20 bp, Neisseria gonorrhoeae
tgacgaggtgggtttgcggg

SEQ ID NO: 54705 - DNA, 20 bp, Neisseria gonorrhoeae
gacgaggtgggtttgcgggc

SEQ ID NO: 54706 - DNA, 20 bp, Neisseria gonorrhoeae
acgaggtgggtttgcgggcc

SEQ ID NO: 54707 - DNA, 20 bp, Neisseria gonorrhoeae
gcgggccgtcggtacgcact

SEQ ID NO: 54708 - DNA, 20 bp, Neisseria gonorrhoeae
atgttgctgaagccttgcaa

SEQ ID NO: 54709 - DNA, 20 bp, Neisseria gonorrhoeae
ctgaagccttgcaaaccttc

SEQ ID NO: 54710 - DNA, 20 bp, Neisseria gonorrhoeae
caaaccttccgccacatcgt

SEQ ID NO: 54711 - DNA, 20 bp, Neisseria gonorrhoeae
cgccacatcgttcaaactca

SEQ ID NO: 54712 - DNA, 20 bp, Neisseria gonorrhoeae
aaactcaaaccggcagccaa

SEQ ID NO: 54713 - DNA, 20 bp, Neisseria gonorrhoeae
tccaaacgcgggttgtcgct

SEQ ID NO: 54714 - DNA, 20 bp, Neisseria gonorrhoeae
ccaaacgcgggttgtcgctg

SEQ ID NO: 54715 - DNA, 20 bp, Neisseria gonorrhoeae
caaacgcgggttgtcgctgg

SEQ ID NO: 54716 - DNA, 20 bp, Neisseria gonorrhoeae
tcgctggttacgacgacttt

SEQ ID NO: 54717 - DNA, 20 bp, Neisseria gonorrhoeae
cgacgactttatccgcgccc

SEQ ID NO: 54718 - DNA, 20 bp, Neisseria gonorrhoeae
catcgcggcggctgttgcgc

SEQ ID NO: 54719 - DNA, 20 bp, Neisseria gonorrhoeae
cgccttgttgacggaaacgg

SEQ ID NO: 54720 - DNA, 20 bp, Neisseria gonorrhoeae
ttgacggaaacggtagagca

SEQ ID NO: 54721 - DNA, 20 bp, Neisseria gonorrhoeae
acggaaacggtagagcaggg

SEQ ID NO: 54722 - DNA, 20 bp, Neisseria gonorrhoeae
ggacatcgacgggggcgggg

SEQ ID NO: 54723 - DNA, 20 bp, Neisseria gonorrhoeae
gatcatatcggttacggcac

SEQ ID NO: 54724 - DNA, 20 bp, Neisseria gonorrhoeae
cggcacggttgcgccgctgt

SEQ ID NO: 54725 - DNA, 20 bp, Neisseria gonorrhoeae
cgccgctgttcgctgtctgc

SEQ ID NO: 54726 - DNA, 20 bp, Neisseria gonorrhoeae
gctgtctgcccggccgggtc

SEQ ID NO: 54727 - DNA, 20 bp, Neisseria gonorrhoeae
ggatcgtaggcgggcgtatt

SEQ ID NO: 54728 - DNA, 20 bp, Neisseria gonorrhoeae
ctgacctttgccgtcaatat

SEQ ID NO: 54729 - DNA, 20 bp, Neisseria gonorrhoeae
gccgtcaatatcggtaaatc

SEQ ID NO: 54730 - DNA, 20 bp, Neisseria gonorrhoeae
ccgtcaatatcggtaaatcc

SEQ ID NO: 54731 - DNA, 20 bp, Neisseria gonorrhoeae
cccatcgggtaatggcgttt

SEQ ID NO: 54732 - DNA, 20 bp, Neisseria gonorrhoeae
taattctttttcaaatacaa

SEQ ID NO: 54733 - DNA, 20 bp, Neisseria gonorrhoeae
ctgtcgatgcttaattcgtg

SEQ ID NO: 54734 - DNA, 20 bp, Neisseria gonorrhoeae
attcgtgtgcgccgccgaac

SEQ ID NO: 54735 - DNA, 20 bp, Neisseria gonorrhoeae
gtgtgcgccgccgaacatga

SEQ ID NO: 54736 - DNA, 20 bp, Neisseria gonorrhoeae
tacccttgtgattttgattt

SEQ ID NO: 54737 - DNA, 20 bp, Neisseria gonorrhoeae
acccttgtgattttgatttc

SEQ ID NO: 54738 - DNA, 20 bp, Neisseria gonorrhoeae
ccgttccggctcgcccgcct

SEQ ID NO: 54739 - DNA, 20 bp, Neisseria gonorrhoeae
cggctcgcccgccttttctt

SEQ ID NO: 54740 - DNA, 20 bp, Neisseria gonorrhoeae
tcttcaacctcgtcggcttt

SEQ ID NO: 54741 - DNA, 20 bp, Neisseria gonorrhoeae
cttcaacctcgtcggctttg

SEQ ID NO: 54742 - DNA, 20 bp, Neisseria gonorrhoeae
ttcaacctcgtcggctttgt

SEQ ID NO: 54743 - DNA, 20 bp, Neisseria gonorrhoeae
ggaaaatttgttcataaaca

SEQ ID NO: 54744 - DNA, 20 bp, Neisseria gonorrhoeae
gttcataaacataccttaat

SEQ ID NO: 54745 - DNA, 20 bp, Neisseria gonorrhoeae
ttcataaacataccttaatg

SEQ ID NO: 54746 - DNA, 20 bp, Neisseria gonorrhoeae
ataaacataccttaatgtgt

SEQ ID NO: 54747 - DNA, 20 bp, Neisseria gonorrhoeae
atgtgtttcagacggcatta

SEQ ID NO: 54748 - DNA, 20 bp, Neisseria gonorrhoeae
tttgccgcgggcggcgatga

SEQ ID NO: 54749 - DNA, 20 bp, Neisseria gonorrhoeae
gccgcgggcggcgatgacgc

SEQ ID NO: 54750 - DNA, 20 bp, Neisseria gonorrhoeae
ccgcgggcggcgatgacgcg

SEQ ID NO: 54751 - DNA, 20 bp, Neisseria gonorrhoeae
caaaacggacgcactgcttt

SEQ ID NO: 54752 - DNA, 20 bp, Neisseria gonorrhoeae
cgcccgcttcctgctgcatc

SEQ ID NO: 54753 - DNA, 20 bp, Neisseria gonorrhoeae
acgaaggcaacggcatttcc

SEQ ID NO: 54754 - DNA, 20 bp, Neisseria gonorrhoeae
cgaaggcaacggcatttccg

SEQ ID NO: 54755 - DNA, 20 bp, Neisseria gonorrhoeae
ccgtcaaactctccgccatc

SEQ ID NO: 54756 - DNA, 20 bp, Neisseria gonorrhoeae
cgtcaaactctccgccatcc

SEQ ID NO: 54757 - DNA, 20 bp, Neisseria gonorrhoeae
ggcgcgcgagtagcgcggat

SEQ ID NO: 54758 - DNA, 20 bp, Neisseria gonorrhoeae
ccgaagtgcgcgaagccgtc

SEQ ID NO: 54759 - DNA, 20 bp, Neisseria gonorrhoeae
ctgccgctactacgcaaacg

SEQ ID NO: 54760 - DNA, 20 bp, Neisseria gonorrhoeae
tgccgctactacgcaaacga

SEQ ID NO: 54761 - DNA, 20 bp, Neisseria gonorrhoeae
ggcttcgtttgcgtagtagc

SEQ ID NO: 54762 - DNA, 20 bp, Neisseria gonorrhoeae
gtttgcgtagtagcggcaga

SEQ ID NO: 54763 - DNA, 20 bp, Neisseria gonorrhoeae
ccggttatgccgtttccctc

SEQ ID NO: 54764 - DNA, 20 bp, Neisseria gonorrhoeae
tgccgtttccctcatgcacg

SEQ ID NO: 54765 - DNA, 20 bp, Neisseria gonorrhoeae
ccctcatgcacgaagccggc

SEQ ID NO: 54766 - DNA, 20 bp, Neisseria gonorrhoeae
cctcatgcacgaagccggca

SEQ ID NO: 54767 - DNA, 20 bp, Neisseria gonorrhoeae
gtgcatgagggaaacggcat

SEQ ID NO: 54768 - DNA, 20 bp, Neisseria gonorrhoeae
tcacaggctcgaccgaagtg

SEQ ID NO: 54769 - DNA, 20 bp, Neisseria gonorrhoeae
cacaggctcgaccgaagtgg

SEQ ID NO: 54770 - DNA, 20 bp, Neisseria gonorrhoeae
acaggctcgaccgaagtggc

SEQ ID NO: 54771 - DNA, 20 bp, Neisseria gonorrhoeae
ccaaacgcggcgacaatccc

SEQ ID NO: 54772 - DNA, 20 bp, Neisseria gonorrhoeae
cggcaatcaggacgggattg

SEQ ID NO: 54773 - DNA, 20 bp, Neisseria gonorrhoeae
ctactcggccgacttggacg

SEQ ID NO: 54774 - DNA, 20 bp, Neisseria gonorrhoeae
gacggtttgctgcaaatcag

SEQ ID NO: 54775 - DNA, 20 bp, Neisseria gonorrhoeae
gctgcaaatcagcggcaaac

SEQ ID NO: 54776 - DNA, 20 bp, Neisseria gonorrhoeae
ctgcaaatcagcggcaaacc

SEQ ID NO: 54777 - DNA, 20 bp, Neisseria gonorrhoeae
tcgggtttgccgctgatttg

SEQ ID NO: 54778 - DNA, 20 bp, Neisseria gonorrhoeae
gaaaacacccgcttcaaaac

SEQ ID NO: 54779 - DNA, 20 bp, Neisseria gonorrhoeae
aaaacccacgaagcctcgtt

SEQ ID NO: 54780 - DNA, 20 bp, Neisseria gonorrhoeae
gtgggttttgaagcgggtgt

SEQ ID NO: 54781 - DNA, 20 bp, Neisseria gonorrhoeae
tgaagcgggtgttttccaag

SEQ ID NO: 54782 - DNA, 20 bp, Neisseria gonorrhoeae
gaagcgggtgttttccaagc

SEQ ID NO: 54783 - DNA, 20 bp, Neisseria gonorrhoeae
cgcgcttgcctgcggcgcaa

SEQ ID NO: 54784 - DNA, 20 bp, Neisseria gonorrhoeae
cctgcggcgcaatcggcgca

SEQ ID NO: 54785 - DNA, 20 bp, Neisseria gonorrhoeae
cgccgcaggcaagcgcggaa

SEQ ID NO: 54786 - DNA, 20 bp, Neisseria gonorrhoeae
cgtgcgcctttgccgctgtg

SEQ ID NO: 54787 - DNA, 20 bp, Neisseria gonorrhoeae
gccgctgtgggtcagtgcgc

SEQ ID NO: 54788 - DNA, 20 bp, Neisseria gonorrhoeae
ccttcgccaccggcagcgcg

SEQ ID NO: 54789 - DNA, 20 bp, Neisseria gonorrhoeae
gccaccggcagcgcggcgtt

SEQ ID NO: 54790 - DNA, 20 bp, Neisseria gonorrhoeae
ggcggcagtgcgcaatacgc

SEQ ID NO: 54791 - DNA, 20 bp, Neisseria gonorrhoeae
agggcgtattgcgcactgcc

SEQ ID NO: 54792 - DNA, 20 bp, Neisseria gonorrhoeae
cgcactgccgcccaacgccg

SEQ ID NO: 54793 - DNA, 20 bp, Neisseria gonorrhoeae
gatttcggcttggaagcgga

SEQ ID NO: 54794 - DNA, 20 bp, Neisseria gonorrhoeae
cggcttggaagcggacgcac

SEQ ID NO: 54795 - DNA, 20 bp, Neisseria gonorrhoeae
ggcttggaagcggacgcacg

SEQ ID NO: 54796 - DNA, 20 bp, Neisseria gonorrhoeae
gaagcggacgcacggatcca

SEQ ID NO: 54797 - DNA, 20 bp, Neisseria gonorrhoeae
tcgccggtatggacttggcg

SEQ ID NO: 54798 - DNA, 20 bp, Neisseria gonorrhoeae
ggaagcgggcgcaggtttgt

SEQ ID NO: 54799 - DNA, 20 bp, Neisseria gonorrhoeae
gaagcgggcgcaggtttgtg

SEQ ID NO: 54800 - DNA, 20 bp, Neisseria gonorrhoeae
gtgcgacgaagccgccgtcc

SEQ ID NO: 54801 - DNA, 20 bp, Neisseria gonorrhoeae
tgcgacgaagccgccgtccg

SEQ ID NO: 54802 - DNA, 20 bp, Neisseria gonorrhoeae
gattgccggtttgccctgcg

SEQ ID NO: 54803 - DNA, 20 bp, Neisseria gonorrhoeae
gtccgtcggcatttcccgtc

SEQ ID NO: 54804 - DNA, 20 bp, Neisseria gonorrhoeae
cccgtccatccatcggcact

SEQ ID NO: 54805 - DNA, 20 bp, Neisseria gonorrhoeae
ccgtccatccatcggcactg

SEQ ID NO: 54806 - DNA, 20 bp, Neisseria gonorrhoeae
ggacaggcagtgccgatgga

SEQ ID NO: 54807 - DNA, 20 bp, Neisseria gonorrhoeae
gcggctgatgtcgagcgaga

SEQ ID NO: 54808 - DNA, 20 bp, Neisseria gonorrhoeae
ccatcggatagagtgcgccc

SEQ ID NO: 54809 - DNA, 20 bp, Neisseria gonorrhoeae
gcgtgcgttatgctgcgcct

SEQ ID NO: 54810 - DNA, 20 bp, Neisseria gonorrhoeae
tgctgcgcctgcggcaattt

SEQ ID NO: 54811 - DNA, 20 bp, Neisseria gonorrhoeae
ggttgcggcggtattgcagc

SEQ ID NO: 54812 - DNA, 20 bp, Neisseria gonorrhoeae
gttgcggcggtattgcagca

SEQ ID NO: 54813 - DNA, 20 bp, Neisseria gonorrhoeae
gcaaaaaccttgttgggcgg

SEQ ID NO: 54814 - DNA, 20 bp, Neisseria gonorrhoeae
ttgggcggcggcaatgtgtt

SEQ ID NO: 54815 - DNA, 20 bp, Neisseria gonorrhoeae
ggcggcggcaatgtgttgct

SEQ ID NO: 54816 - DNA, 20 bp, Neisseria gonorrhoeae
ctgctggacgaaccgtccaa

SEQ ID NO: 54817 - DNA, 20 bp, Neisseria gonorrhoeae
ccacgtcgagatcgttggac

SEQ ID NO: 54818 - DNA, 20 bp, Neisseria gonorrhoeae
tttgggacgagattgtcgcc

SEQ ID NO: 54819 - DNA, 20 bp, Neisseria gonorrhoeae
gggacgagattgtcgccatg

SEQ ID NO: 54820 - DNA, 20 bp, Neisseria gonorrhoeae
ggacgagattgtcgccatgc

SEQ ID NO: 54821 - DNA, 20 bp, Neisseria gonorrhoeae
tcgccatgctgtttgtgctg

SEQ ID NO: 54822 - DNA, 20 bp, Neisseria gonorrhoeae
gtgctggcgtttgtgccgtt

SEQ ID NO: 54823 - DNA, 20 bp, Neisseria gonorrhoeae
gctcgggacggagcagcttt

SEQ ID NO: 54824 - DNA, 20 bp, Neisseria gonorrhoeae
tgttcgcattcggcgaacac

SEQ ID NO: 54825 - DNA, 20 bp, Neisseria gonorrhoeae
gttcgcattcggcgaacaca

SEQ ID NO: 54826 - DNA, 20 bp, Neisseria gonorrhoeae
ttcgcattcggcgaacacat

SEQ ID NO: 54827 - DNA, 20 bp, Neisseria gonorrhoeae
gcattcggcgaacacatcat

SEQ ID NO: 54828 - DNA, 20 bp, Neisseria gonorrhoeae
ttttcagcacctgcagattg

SEQ ID NO: 54829 - DNA, 20 bp, Neisseria gonorrhoeae
tttcagcacctgcagattga

SEQ ID NO: 54830 - DNA, 20 bp, Neisseria gonorrhoeae
ttcagcacctgcagattgag

SEQ ID NO: 54831 - DNA, 20 bp, Neisseria gonorrhoeae
tcagcacctgcagattgaga

SEQ ID NO: 54832 - DNA, 20 bp, Neisseria gonorrhoeae
cagcacctgcagattgagaa

SEQ ID NO: 54833 - DNA, 20 bp, Neisseria gonorrhoeae
cgccgcaaattgctggattt

SEQ ID NO: 54834 - DNA, 20 bp, Neisseria gonorrhoeae
ctggatttgcaggacacagg

SEQ ID NO: 54835 - DNA, 20 bp, Neisseria gonorrhoeae
gcaggacacaggcacagacg

SEQ ID NO: 54836 - DNA, 20 bp, Neisseria gonorrhoeae
caggacacaggcacagacga

SEQ ID NO: 54837 - DNA, 20 bp, Neisseria gonorrhoeae
tcgcaagaactcagccgcct

SEQ ID NO: 54838 - DNA, 20 bp, Neisseria gonorrhoeae
ccaacatcagcgtactcccc

SEQ ID NO: 54839 - DNA, 20 bp, Neisseria gonorrhoeae
gcaatcccgccgatgttcag

SEQ ID NO: 54840 - DNA, 20 bp, Neisseria gonorrhoeae
agtaccacgcgtgtttccct

SEQ ID NO: 54841 - DNA, 20 bp, Neisseria gonorrhoeae
cacatcggtcttaaacgccc

SEQ ID NO: 54842 - DNA, 20 bp, Neisseria gonorrhoeae
aacgcccccgccgccgccct

SEQ ID NO: 54843 - DNA, 20 bp, Neisseria gonorrhoeae
aagaccgatgtggaagtggt

SEQ ID NO: 54844 - DNA, 20 bp, Neisseria gonorrhoeae
agaccgatgtggaagtggtt

SEQ ID NO: 54845 - DNA, 20 bp, Neisseria gonorrhoeae
cgccggagagcgcgtcggat

SEQ ID NO: 54846 - DNA, 20 bp, Neisseria gonorrhoeae
ccgaaactgtggatgacggt

SEQ ID NO: 54847 - DNA, 20 bp, Neisseria gonorrhoeae
cagtcggagaaggattatct

SEQ ID NO: 54848 - DNA, 20 bp, Neisseria gonorrhoeae
tccgactgcaacggaccgtc

SEQ ID NO: 54849 - DNA, 20 bp, Neisseria gonorrhoeae
cggcaaggctttcctccgtc

SEQ ID NO: 54850 - DNA, 20 bp, Neisseria gonorrhoeae
ggcaaggctttcctccgtcc

SEQ ID NO: 54851 - DNA, 20 bp, Neisseria gonorrhoeae
cgaccgcgctttggctgccg

SEQ ID NO: 54852 - DNA, 20 bp, Neisseria gonorrhoeae
ggctgccggtgcggtcaata

SEQ ID NO: 54853 - DNA, 20 bp, Neisseria gonorrhoeae
gctgccggtgcggtcaatac

SEQ ID NO: 54854 - DNA, 20 bp, Neisseria gonorrhoeae
gaagacggcagaatacgcgg

SEQ ID NO: 54855 - DNA, 20 bp, Neisseria gonorrhoeae
tcgccgcgtattctgccgtc

SEQ ID NO: 54856 - DNA, 20 bp, Neisseria gonorrhoeae
cggaatatcgaggcttcctg

SEQ ID NO: 54857 - DNA, 20 bp, Neisseria gonorrhoeae
ctgcggcaggtagccgacac

SEQ ID NO: 54858 - DNA, 20 bp, Neisseria gonorrhoeae
gtgtatgggcaggtggcgca

SEQ ID NO: 54859 - DNA, 20 bp, Neisseria gonorrhoeae
cgccacctgcccatacacga

SEQ ID NO: 54860 - DNA, 20 bp, Neisseria gonorrhoeae
ccgccattttgcgcccgata

SEQ ID NO: 54861 - DNA, 20 bp, Neisseria gonorrhoeae
tgcgcccgatatgtccggac

SEQ ID NO: 54862 - DNA, 20 bp, Neisseria gonorrhoeae
gcgcccgatatgtccggact

SEQ ID NO: 54863 - DNA, 20 bp, Neisseria gonorrhoeae
cgcccgatatgtccggactt

SEQ ID NO: 54864 - DNA, 20 bp, Neisseria gonorrhoeae
cccatacccgtgatgacgac

SEQ ID NO: 54865 - DNA, 20 bp, Neisseria gonorrhoeae
aagtgcctgccaccgacgca

SEQ ID NO: 54866 - DNA, 20 bp, Neisseria gonorrhoeae
cgagcgcatcgatgcctgcg

SEQ ID NO: 54867 - DNA, 20 bp, Neisseria gonorrhoeae
gagcgcatcgatgcctgcgt

SEQ ID NO: 54868 - DNA, 20 bp, Neisseria gonorrhoeae
aatcatggcgtttttacgcg

SEQ ID NO: 54869 - DNA, 20 bp, Neisseria gonorrhoeae
atcatggcgtttttacgcgc

SEQ ID NO: 54870 - DNA, 20 bp, Neisseria gonorrhoeae
ccaaacgcttggcagccgga

SEQ ID NO: 54871 - DNA, 20 bp, Neisseria gonorrhoeae
gcagccggacaaagcgttgc

SEQ ID NO: 54872 - DNA, 20 bp, Neisseria gonorrhoeae
cccatatccaagttgtcgcc

SEQ ID NO: 54873 - DNA, 20 bp, Neisseria gonorrhoeae
tcgccagcttcttcatctcg

SEQ ID NO: 54874 - DNA, 20 bp, Neisseria gonorrhoeae
ttcatctcgcgcgtggacag

SEQ ID NO: 54875 - DNA, 20 bp, Neisseria gonorrhoeae
gccgcactggaagcccaagg

SEQ ID NO: 54876 - DNA, 20 bp, Neisseria gonorrhoeae
ccgcactggaagcccaaggc

SEQ ID NO: 54877 - DNA, 20 bp, Neisseria gonorrhoeae
tatgggcatctaccggcgtg

SEQ ID NO: 54878 - DNA, 20 bp, Neisseria gonorrhoeae
atgggcatctaccggcgtga

SEQ ID NO: 54879 - DNA, 20 bp, Neisseria gonorrhoeae
tgggcatctaccggcgtgaa

SEQ ID NO: 54880 - DNA, 20 bp, Neisseria gonorrhoeae
tcagacggcatcgtcggcag

SEQ ID NO: 54881 - DNA, 20 bp, Neisseria gonorrhoeae
cagacggcatcgtcggcagt

SEQ ID NO: 54882 - DNA, 20 bp, Neisseria gonorrhoeae
agacggcatcgtcggcagtt

SEQ ID NO: 54883 - DNA, 20 bp, Neisseria gonorrhoeae
cacccaaaacctcgcccgcg

SEQ ID NO: 54884 - DNA, 20 bp, Neisseria gonorrhoeae
cgtcctgttccgtgcagacg

SEQ ID NO: 54885 - DNA, 20 bp, Neisseria gonorrhoeae
ccacaccgcgccaaatctat

SEQ ID NO: 54886 - DNA, 20 bp, Neisseria gonorrhoeae
cacaccgcgccaaatctatt

SEQ ID NO: 54887 - DNA, 20 bp, Neisseria gonorrhoeae
gcagcagtgtttgggcgttc

SEQ ID NO: 54888 - DNA, 20 bp, Neisseria gonorrhoeae
cagcagtgtttgggcgttcc

SEQ ID NO: 54889 - DNA, 20 bp, Neisseria gonorrhoeae
gggcgttccgacaccgcaat

SEQ ID NO: 54890 - DNA, 20 bp, Neisseria gonorrhoeae
gatttggacttggctgtatg

SEQ ID NO: 54891 - DNA, 20 bp, Neisseria gonorrhoeae
ggacttggctgtatgtgtag

SEQ ID NO: 54892 - DNA, 20 bp, Neisseria gonorrhoeae
gacttggctgtatgtgtaga

SEQ ID NO: 54893 - DNA, 20 bp, Neisseria gonorrhoeae
gctgtatgtgtagaggcgtt

SEQ ID NO: 54894 - DNA, 20 bp, Neisseria gonorrhoeae
caccaaatcggcgtattcga

SEQ ID NO: 54895 - DNA, 20 bp, Neisseria gonorrhoeae
aggttgacctcgttgtagcc

SEQ ID NO: 54896 - DNA, 20 bp, Neisseria gonorrhoeae
acctcgttgtagccgtattc

SEQ ID NO: 54897 - DNA, 20 bp, Neisseria gonorrhoeae
tagccgtattcttcggcggc

SEQ ID NO: 54898 - DNA, 20 bp, Neisseria gonorrhoeae
ttcggcggctttggcggctt

SEQ ID NO: 54899 - DNA, 20 bp, Neisseria gonorrhoeae
ggcggctttggcggctttcg

SEQ ID NO: 54900 - DNA, 20 bp, Neisseria gonorrhoeae
tcatcatcggccggcgcacg

SEQ ID NO: 54901 - DNA, 20 bp, Neisseria gonorrhoeae
catcatcggccggcgcacgt

SEQ ID NO: 54902 - DNA, 20 bp, Neisseria gonorrhoeae
atcatcggccggcgcacgtc

SEQ ID NO: 54903 - DNA, 20 bp, Neisseria gonorrhoeae
tccgtcgggggcgcacggga

SEQ ID NO: 54904 - DNA, 20 bp, Neisseria gonorrhoeae
agcggcttgccgtacatcgc

SEQ ID NO: 54905 - DNA, 20 bp, Neisseria gonorrhoeae
tgtgttgttttcaggttcgg

SEQ ID NO: 54906 - DNA, 20 bp, Neisseria gonorrhoeae
gtgttgttttcaggttcggc

SEQ ID NO: 54907 - DNA, 20 bp, Neisseria gonorrhoeae
tgttgttttcaggttcggcg

SEQ ID NO: 54908 - DNA, 20 bp, Neisseria gonorrhoeae
ttttcaggttcggcgggcgt

SEQ ID NO: 54909 - DNA, 20 bp, Neisseria gonorrhoeae
tcaggttcggcgggcgtgga

SEQ ID NO: 54910 - DNA, 20 bp, Neisseria gonorrhoeae
gtacaacgaagttttgggcg

SEQ ID NO: 54911 - DNA, 20 bp, Neisseria gonorrhoeae
tacaacgaagttttgggcgg

SEQ ID NO: 54912 - DNA, 20 bp, Neisseria gonorrhoeae
tgggcggccggttgccaagc

SEQ ID NO: 54913 - DNA, 20 bp, Neisseria gonorrhoeae
gggcggccggttgccaagcg

SEQ ID NO: 54914 - DNA, 20 bp, Neisseria gonorrhoeae
ggcggccggttgccaagcgt

SEQ ID NO: 54915 - DNA, 20 bp, Neisseria gonorrhoeae
gcggcagcggcgcgattgag

SEQ ID NO: 54916 - DNA, 20 bp, Neisseria gonorrhoeae
agcaagacgcaaacatcatc

SEQ ID NO: 54917 - DNA, 20 bp, Neisseria gonorrhoeae
gcggtgcggcatgatgatga

SEQ ID NO: 54918 - DNA, 20 bp, Neisseria gonorrhoeae
gcgtcttgctcaatcgcgcc

SEQ ID NO: 54919 - DNA, 20 bp, Neisseria gonorrhoeae
cgtcttgctcaatcgcgccg

SEQ ID NO: 54920 - DNA, 20 bp, Neisseria gonorrhoeae
ttggcggatttggcgcaaca

SEQ ID NO: 54921 - DNA, 20 bp, Neisseria gonorrhoeae
gcggatttggcgcaacaggg

SEQ ID NO: 54922 - DNA, 20 bp, Neisseria gonorrhoeae
ggcgcaacagggcggtcagg

SEQ ID NO: 54923 - DNA, 20 bp, Neisseria gonorrhoeae
gcgcaacagggcggtcagga

SEQ ID NO: 54924 - DNA, 20 bp, Neisseria gonorrhoeae
cgcgatacggcggacggttt

SEQ ID NO: 54925 - DNA, 20 bp, Neisseria gonorrhoeae
cgcgcttgcgggcgtgaggt

SEQ ID NO: 54926 - DNA, 20 bp, Neisseria gonorrhoeae
cgggcgtgaggtcgggacgc

SEQ ID NO: 54927 - DNA, 20 bp, Neisseria gonorrhoeae
cttgtacatccgccgtggtg

SEQ ID NO: 54928 - DNA, 20 bp, Neisseria gonorrhoeae
tacatccgccgtggtgttgc

SEQ ID NO: 54929 - DNA, 20 bp, Neisseria gonorrhoeae
ccttgcgcgtccctgccgaa

SEQ ID NO: 54930 - DNA, 20 bp, Neisseria gonorrhoeae
gtactttgaagacgaaacgc

SEQ ID NO: 54931 - DNA, 20 bp, Neisseria gonorrhoeae
gaagacgaaacgccgtggtg

SEQ ID NO: 54932 - DNA, 20 bp, Neisseria gonorrhoeae
aagacgaaacgccgtggtgc

SEQ ID NO: 54933 - DNA, 20 bp, Neisseria gonorrhoeae
gtcggacactgcctgggcaa

SEQ ID NO: 54934 - DNA, 20 bp, Neisseria gonorrhoeae
tcggacactgcctgggcaaa

SEQ ID NO: 54935 - DNA, 20 bp, Neisseria gonorrhoeae
acgacggcggttaagccgcc

SEQ ID NO: 54936 - DNA, 20 bp, Neisseria gonorrhoeae
agccgcccgccgatttggtg

SEQ ID NO: 54937 - DNA, 20 bp, Neisseria gonorrhoeae
ggtgcggccctgcccgaaac

SEQ ID NO: 54938 - DNA, 20 bp, Neisseria gonorrhoeae
gtgcggccctgcccgaaact

SEQ ID NO: 54939 - DNA, 20 bp, Neisseria gonorrhoeae
aagggaacacgggcgcggac

SEQ ID NO: 54940 - DNA, 20 bp, Neisseria gonorrhoeae
ttttgttgcaacgctggatt

SEQ ID NO: 54941 - DNA, 20 bp, Neisseria gonorrhoeae
tttgttgcaacgctggattt

SEQ ID NO: 54942 - DNA, 20 bp, Neisseria gonorrhoeae
ttgttgcaacgctggatttt

SEQ ID NO: 54943 - DNA, 20 bp, Neisseria gonorrhoeae
tgttgcaacgctggattttt

SEQ ID NO: 54944 - DNA, 20 bp, Neisseria gonorrhoeae
gttgcaacgctggatttttg

SEQ ID NO: 54945 - DNA, 20 bp, Neisseria gonorrhoeae
cgccgccgaatacgacaatc

SEQ ID NO: 54946 - DNA, 20 bp, Neisseria gonorrhoeae
gaagcataaaaggctggata

SEQ ID NO: 54947 - DNA, 20 bp, Neisseria gonorrhoeae
tcgtattcggcggcgcaacc

SEQ ID NO: 54948 - DNA, 20 bp, Neisseria gonorrhoeae
ggcggcgcaaccattgtttt

SEQ ID NO: 54949 - DNA, 20 bp, Neisseria gonorrhoeae
ccgcatcctttcaggcacat

SEQ ID NO: 54950 - DNA, 20 bp, Neisseria gonorrhoeae
caggcacatgcgcgactggg

SEQ ID NO: 54951 - DNA, 20 bp, Neisseria gonorrhoeae
aggcacatgcgcgactgggc

SEQ ID NO: 54952 - DNA, 20 bp, Neisseria gonorrhoeae
gtcaaggttggaccggatat

SEQ ID NO: 54953 - DNA, 20 bp, Neisseria gonorrhoeae
gaccggatattcagtccgcc

SEQ ID NO: 54954 - DNA, 20 bp, Neisseria gonorrhoeae
gacggcaaagccgtcattgc

SEQ ID NO: 54955 - DNA, 20 bp, Neisseria gonorrhoeae
ccgtttcttccgcacaggca

SEQ ID NO: 54956 - DNA, 20 bp, Neisseria gonorrhoeae
cttccgcacaggcagtccgc

SEQ ID NO: 54957 - DNA, 20 bp, Neisseria gonorrhoeae
ttccgcacaggcagtccgcg

SEQ ID NO: 54958 - DNA, 20 bp, Neisseria gonorrhoeae
cgcacaggcagtccgcgatc

SEQ ID NO: 54959 - DNA, 20 bp, Neisseria gonorrhoeae
cgccctgccgcttcacgcgt

SEQ ID NO: 54960 - DNA, 20 bp, Neisseria gonorrhoeae
acgcgttcgcaggcttcgta

SEQ ID NO: 54961 - DNA, 20 bp, Neisseria gonorrhoeae
gcaggcttcgtaggcatcgt

SEQ ID NO: 54962 - DNA, 20 bp, Neisseria gonorrhoeae
gtaggcatcgtccacttcaa

SEQ ID NO: 54963 - DNA, 20 bp, Neisseria gonorrhoeae
aaccgcgatgtgtccgtagg

SEQ ID NO: 54964 - DNA, 20 bp, Neisseria gonorrhoeae
ggatttgaagtggcagttgc

SEQ ID NO: 54965 - DNA, 20 bp, Neisseria gonorrhoeae
gaagtggcagttgcggcaac

SEQ ID NO: 54966 - DNA, 20 bp, Neisseria gonorrhoeae
aagtggcagttgcggcaacg

SEQ ID NO: 54967 - DNA, 20 bp, Neisseria gonorrhoeae
cggcaacggtacatcacgct

SEQ ID NO: 54968 - DNA, 20 bp, Neisseria gonorrhoeae
ggttatcggacggcagctcc

SEQ ID NO: 54969 - DNA, 20 bp, Neisseria gonorrhoeae
ggaaggcaggctgccggaca

SEQ ID NO: 54970 - DNA, 20 bp, Neisseria gonorrhoeae
gaaggcaggctgccggacac

SEQ ID NO: 54971 - DNA, 20 bp, Neisseria gonorrhoeae
gtagatttcgcctgtggtgc

SEQ ID NO: 54972 - DNA, 20 bp, Neisseria gonorrhoeae
cgcctgtggtgcggtcgaag

SEQ ID NO: 54973 - DNA, 20 bp, Neisseria gonorrhoeae
gcctgtggtgcggtcgaaga

SEQ ID NO: 54974 - DNA, 20 bp, Neisseria gonorrhoeae
tcttcaatgatggtgggtgc

SEQ ID NO: 54975 - DNA, 20 bp, Neisseria gonorrhoeae
aatgatggtgggtgcggcct

SEQ ID NO: 54976 - DNA, 20 bp, Neisseria gonorrhoeae
agcggcggtgtcggcatcgg

SEQ ID NO: 54977 - DNA, 20 bp, Neisseria gonorrhoeae
aagacaactgcttcatcggc

SEQ ID NO: 54978 - DNA, 20 bp, Neisseria gonorrhoeae
cgccgcaatgccgaaacttt

SEQ ID NO: 54979 - DNA, 20 bp, Neisseria gonorrhoeae
cggcattgcggcggaacgcg

SEQ ID NO: 54980 - DNA, 20 bp, Neisseria gonorrhoeae
ggcattgcggcggaacgcgt

SEQ ID NO: 54981 - DNA, 20 bp, Neisseria gonorrhoeae
cggcggaacgcgtgtttgcg

SEQ ID NO: 54982 - DNA, 20 bp, Neisseria gonorrhoeae
gcgatgtacgactgggtggg

SEQ ID NO: 54983 - DNA, 20 bp, Neisseria gonorrhoeae
actttcgcacccgtccgcaa

SEQ ID NO: 54984 - DNA, 20 bp, Neisseria gonorrhoeae
cgcacccgtccgcaaagcac

SEQ ID NO: 54985 - DNA, 20 bp, Neisseria gonorrhoeae
gcacccgtccgcaaagcacg

SEQ ID NO: 54986 - DNA, 20 bp, Neisseria gonorrhoeae
gcggacgggtgcgaaagtca

SEQ ID NO: 54987 - DNA, 20 bp, Neisseria gonorrhoeae
cggacgggtgcgaaagtcaa

SEQ ID NO: 54988 - DNA, 20 bp, Neisseria gonorrhoeae
tgccgatttgggcgtgccgc

SEQ ID NO: 54989 - DNA, 20 bp, Neisseria gonorrhoeae
gccgatttgggcgtgccgcg

SEQ ID NO: 54990 - DNA, 20 bp, Neisseria gonorrhoeae
ccgatttgggcgtgccgcgc

SEQ ID NO: 54991 - DNA, 20 bp, Neisseria gonorrhoeae
cgcggctgccgatttgccgc

SEQ ID NO: 54992 - DNA, 20 bp, Neisseria gonorrhoeae
gccgctgccgattccgccgg

SEQ ID NO: 54993 - DNA, 20 bp, Neisseria gonorrhoeae
accataacccttatggagtt

SEQ ID NO: 54994 - DNA, 20 bp, Neisseria gonorrhoeae
tggagttgagtatgtacgcg

SEQ ID NO: 54995 - DNA, 20 bp, Neisseria gonorrhoeae
agtatgtacgcggtcgtaaa

SEQ ID NO: 54996 - DNA, 20 bp, Neisseria gonorrhoeae
atactgtttgccgccggttt

SEQ ID NO: 54997 - DNA, 20 bp, Neisseria gonorrhoeae
tactgtttgccgccggtttt

SEQ ID NO: 54998 - DNA, 20 bp, Neisseria gonorrhoeae
aacctcgggctttccagcgc

SEQ ID NO: 54999 - DNA, 20 bp, Neisseria gonorrhoeae
ccagcgcggatattctggca

SEQ ID NO: 55000 - DNA, 20 bp, Neisseria gonorrhoeae
cagcgcggatattctggcaa

SEQ ID NO: 55001 - DNA, 20 bp, Neisseria gonorrhoeae
tggcaaaactgatactcgaa

SEQ ID NO: 55002 - DNA, 20 bp, Neisseria gonorrhoeae
ggcttcgagtatcagttttg

SEQ ID NO: 55003 - DNA, 20 bp, Neisseria gonorrhoeae
cttcgccgttcggctaccgt

SEQ ID NO: 55004 - DNA, 20 bp, Neisseria gonorrhoeae
ttcgccgttcggctaccgta

SEQ ID NO: 55005 - DNA, 20 bp, Neisseria gonorrhoeae
gccgttcggctaccgtatgc

SEQ ID NO: 55006 - DNA, 20 bp, Neisseria gonorrhoeae
ggctaccgtatgcaccccat

SEQ ID NO: 55007 - DNA, 20 bp, Neisseria gonorrhoeae
gggacagtctgcacggaagc

SEQ ID NO: 55008 - DNA, 20 bp, Neisseria gonorrhoeae
ggacagtctgcacggaagcg

SEQ ID NO: 55009 - DNA, 20 bp, Neisseria gonorrhoeae
tcgccgatacggtttggagc

SEQ ID NO: 55010 - DNA, 20 bp, Neisseria gonorrhoeae
cgccgatacggtttggagcc

SEQ ID NO: 55011 - DNA, 20 bp, Neisseria gonorrhoeae
gccgatacggtttggagccg

SEQ ID NO: 55012 - DNA, 20 bp, Neisseria gonorrhoeae
cagcagtgggaagaacgctg

SEQ ID NO: 55013 - DNA, 20 bp, Neisseria gonorrhoeae
gcaccgctttacgaagccgt

SEQ ID NO: 55014 - DNA, 20 bp, Neisseria gonorrhoeae
acgaagccgtccgcaccggc

SEQ ID NO: 55015 - DNA, 20 bp, Neisseria gonorrhoeae
cgaagccgtccgcaccggca

SEQ ID NO: 55016 - DNA, 20 bp, Neisseria gonorrhoeae
gattttgccggtgcggacgg

SEQ ID NO: 55017 - DNA, 20 bp, Neisseria gonorrhoeae
aaaccaattttcagacggca

SEQ ID NO: 55018 - DNA, 20 bp, Neisseria gonorrhoeae
tcagacggcatttgtccctt

SEQ ID NO: 55019 - DNA, 20 bp, Neisseria gonorrhoeae
cagacggcatttgtccctta

SEQ ID NO: 55020 - DNA, 20 bp, Neisseria gonorrhoeae
agacggcatttgtcccttaa

SEQ ID NO: 55021 - DNA, 20 bp, Neisseria gonorrhoeae
gtcccttaaaacacgttttt

SEQ ID NO: 55022 - DNA, 20 bp, Neisseria gonorrhoeae
tttccgggcaaagcaaaaac

SEQ ID NO: 55023 - DNA, 20 bp, Neisseria gonorrhoeae
ttccgggcaaagcaaaaacc

SEQ ID NO: 55024 - DNA, 20 bp, Neisseria gonorrhoeae
tccgggcaaagcaaaaaccc

SEQ ID NO: 55025 - DNA, 20 bp, Neisseria gonorrhoeae
ccgggcaaagcaaaaacccc

SEQ ID NO: 55026 - DNA, 20 bp, Neisseria gonorrhoeae
cgggcaaagcaaaaaccccc

SEQ ID NO: 55027 - DNA, 20 bp, Neisseria gonorrhoeae
gcctgacccactgcctgtcc

SEQ ID NO: 55028 - DNA, 20 bp, Neisseria gonorrhoeae
cctgacccactgcctgtccc

SEQ ID NO: 55029 - DNA, 20 bp, Neisseria gonorrhoeae
aactgacccccgtcatccgt

SEQ ID NO: 55030 - DNA, 20 bp, Neisseria gonorrhoeae
aggcgggcgcgtgcatcggt

SEQ ID NO: 55031 - DNA, 20 bp, Neisseria gonorrhoeae
atcatttcgcgcatcatcag

SEQ ID NO: 55032 - DNA, 20 bp, Neisseria gonorrhoeae
cgcgcatcatcagcgtgttg

SEQ ID NO: 55033 - DNA, 20 bp, Neisseria gonorrhoeae
gcgcatcatcagcgtgttgt

SEQ ID NO: 55034 - DNA, 20 bp, Neisseria gonorrhoeae
agcgcggattttttctgcca

SEQ ID NO: 55035 - DNA, 20 bp, Neisseria gonorrhoeae
tttctgccacgttttaaacc

SEQ ID NO: 55036 - DNA, 20 bp, Neisseria gonorrhoeae
ttctgccacgttttaaacct

SEQ ID NO: 55037 - DNA, 20 bp, Neisseria gonorrhoeae
tctgccacgttttaaacctc

SEQ ID NO: 55038 - DNA, 20 bp, Neisseria gonorrhoeae
ctgccacgttttaaacctcc

SEQ ID NO: 55039 - DNA, 20 bp, Neisseria gonorrhoeae
ccaacagcctgtggcggcgc

SEQ ID NO: 55040 - DNA, 20 bp, Neisseria gonorrhoeae
ggccaccctgcaatcgctcg

SEQ ID NO: 55041 - DNA, 20 bp, Neisseria gonorrhoeae
aacttgattttgcgccaaac

SEQ ID NO: 55042 - DNA, 20 bp, Neisseria gonorrhoeae
attttgcgccaaaccggcct

SEQ ID NO: 55043 - DNA, 20 bp, Neisseria gonorrhoeae
tgcgccaaaccggcctgctg

SEQ ID NO: 55044 - DNA, 20 bp, Neisseria gonorrhoeae
cgcccaccgaagccatcggc

SEQ ID NO: 55045 - DNA, 20 bp, Neisseria gonorrhoeae
gcccaccgaagccatcggca

SEQ ID NO: 55046 - DNA, 20 bp, Neisseria gonorrhoeae
ggtgggcgaaatcagcttgg

SEQ ID NO: 55047 - DNA, 20 bp, Neisseria gonorrhoeae
ggcagccattcgatgacggc

SEQ ID NO: 55048 - DNA, 20 bp, Neisseria gonorrhoeae
gatgacggcggcggtgtggg

SEQ ID NO: 55049 - DNA, 20 bp, Neisseria gonorrhoeae
gatagaacaacgcggcggca

SEQ ID NO: 55050 - DNA, 20 bp, Neisseria gonorrhoeae
atcgaaatcaccgtccccga

SEQ ID NO: 55051 - DNA, 20 bp, Neisseria gonorrhoeae
gatgccggcttcggggacgg

SEQ ID NO: 55052 - DNA, 20 bp, Neisseria gonorrhoeae
atgccggcttcggggacggt

SEQ ID NO: 55053 - DNA, 20 bp, Neisseria gonorrhoeae
ggggacggtgatttcgatga

SEQ ID NO: 55054 - DNA, 20 bp, Neisseria gonorrhoeae
tcgtcggcactcaaatcgaa

SEQ ID NO: 55055 - DNA, 20 bp, Neisseria gonorrhoeae
tcttgtccaatatttatttg

SEQ ID NO: 55056 - DNA, 20 bp, Neisseria gonorrhoeae
cttgtccaatatttatttgg

SEQ ID NO: 55057 - DNA, 20 bp, Neisseria gonorrhoeae
ttgtccaatatttatttggg

SEQ ID NO: 55058 - DNA, 20 bp, Neisseria gonorrhoeae
tccaatatttatttggggtt

SEQ ID NO: 55059 - DNA, 20 bp, Neisseria gonorrhoeae
gaatcggctcggcgagcagc

SEQ ID NO: 55060 - DNA, 20 bp, Neisseria gonorrhoeae
aatcggctcggcgagcagct

SEQ ID NO: 55061 - DNA, 20 bp, Neisseria gonorrhoeae
ggttcgagcttgttcagacc

SEQ ID NO: 55062 - DNA, 20 bp, Neisseria gonorrhoeae
gagcttgttcagaccgcgca

SEQ ID NO: 55063 - DNA, 20 bp, Neisseria gonorrhoeae
ttcagaccgcgcaggtgggc

SEQ ID NO: 55064 - DNA, 20 bp, Neisseria gonorrhoeae
gccgatgatttcggcaagtt

SEQ ID NO: 55065 - DNA, 20 bp, Neisseria gonorrhoeae
ccgatgatttcggcaagttt

SEQ ID NO: 55066 - DNA, 20 bp, Neisseria gonorrhoeae
cggcaagtttgggcaggatg

SEQ ID NO: 55067 - DNA, 20 bp, Neisseria gonorrhoeae
ggcaagtttgggcaggatga

SEQ ID NO: 55068 - DNA, 20 bp, Neisseria gonorrhoeae
gggcaggatgacggtttcgc

SEQ ID NO: 55069 - DNA, 20 bp, Neisseria gonorrhoeae
ggtttctgctcgtgcggcag

SEQ ID NO: 55070 - DNA, 20 bp, Neisseria gonorrhoeae
ctgctcgtgcggcagggcaa

SEQ ID NO: 55071 - DNA, 20 bp, Neisseria gonorrhoeae
tgctcgtgcggcagggcaat

SEQ ID NO: 55072 - DNA, 20 bp, Neisseria gonorrhoeae
agccctaccgaaaccgactt

SEQ ID NO: 55073 - DNA, 20 bp, Neisseria gonorrhoeae
ccggcaaacgcgcccttgtt

SEQ ID NO: 55074 - DNA, 20 bp, Neisseria gonorrhoeae
ggtgcggacaggcgcgccga

SEQ ID NO: 55075 - DNA, 20 bp, Neisseria gonorrhoeae
gagcgcgtggacggcttctt

SEQ ID NO: 55076 - DNA, 20 bp, Neisseria gonorrhoeae
agcgcgtggacggcttcttc

SEQ ID NO: 55077 - DNA, 20 bp, Neisseria gonorrhoeae
ttcaaaggcgggaaccatta

SEQ ID NO: 55078 - DNA, 20 bp, Neisseria gonorrhoeae
aaaggcgggaaccattacgc

SEQ ID NO: 55079 - DNA, 20 bp, Neisseria gonorrhoeae
cgcgcctggtcgtagatttt

SEQ ID NO: 55080 - DNA, 20 bp, Neisseria gonorrhoeae
tgcggatggtactttccgcg

SEQ ID NO: 55081 - DNA, 20 bp, Neisseria gonorrhoeae
gcggatggtactttccgcgc

SEQ ID NO: 55082 - DNA, 20 bp, Neisseria gonorrhoeae
cggatggtactttccgcgcc

SEQ ID NO: 55083 - DNA, 20 bp, Neisseria gonorrhoeae
ccgcgccgacggcggcgttt

SEQ ID NO: 55084 - DNA, 20 bp, Neisseria gonorrhoeae
tgcatcactgcctgctggcg

SEQ ID NO: 55085 - DNA, 20 bp, Neisseria gonorrhoeae
gcatcactgcctgctggcgg

SEQ ID NO: 55086 - DNA, 20 bp, Neisseria gonorrhoeae
catcactgcctgctggcgga

SEQ ID NO: 55087 - DNA, 20 bp, Neisseria gonorrhoeae
ttcggcaatgatgttgtcgg

SEQ ID NO: 55088 - DNA, 20 bp, Neisseria gonorrhoeae
tcggcaatgatgttgtcggc

SEQ ID NO: 55089 - DNA, 20 bp, Neisseria gonorrhoeae
tgcgggtgcggcttcttttt

SEQ ID NO: 55090 - DNA, 20 bp, Neisseria gonorrhoeae
tttttgcgccgtggcggcag

SEQ ID NO: 55091 - DNA, 20 bp, Neisseria gonorrhoeae
ttgcgccgtggcggcagctt

SEQ ID NO: 55092 - DNA, 20 bp, Neisseria gonorrhoeae
tgcgccgtggcggcagcttt

SEQ ID NO: 55093 - DNA, 20 bp, Neisseria gonorrhoeae
gcgccgtggcggcagctttg

SEQ ID NO: 55094 - DNA, 20 bp, Neisseria gonorrhoeae
gcagccgccgtccgccttgt

SEQ ID NO: 55095 - DNA, 20 bp, Neisseria gonorrhoeae
cagccgccgtccgccttgtt

SEQ ID NO: 55096 - DNA, 20 bp, Neisseria gonorrhoeae
ttcggtttccatacggacgt

SEQ ID NO: 55097 - DNA, 20 bp, Neisseria gonorrhoeae
ggtttccatacggacgttgt

SEQ ID NO: 55098 - DNA, 20 bp, Neisseria gonorrhoeae
ccatacggacgttgtgcgct

SEQ ID NO: 55099 - DNA, 20 bp, Neisseria gonorrhoeae
cgttactgcaaaacaggcag

SEQ ID NO: 55100 - DNA, 20 bp, Neisseria gonorrhoeae
gttactgcaaaacaggcagg

SEQ ID NO: 55101 - DNA, 20 bp, Neisseria gonorrhoeae
ctgcaaaacaggcaggtcga

SEQ ID NO: 55102 - DNA, 20 bp, Neisseria gonorrhoeae
tgcggattcggacgcgccct

SEQ ID NO: 55103 - DNA, 20 bp, Neisseria gonorrhoeae
ggacgcgccctgcgcaccgc

SEQ ID NO: 55104 - DNA, 20 bp, Neisseria gonorrhoeae
gctccaaggttttcagacgg

SEQ ID NO: 55105 - DNA, 20 bp, Neisseria gonorrhoeae
tcagacggcatttgccgcag

SEQ ID NO: 55106 - DNA, 20 bp, Neisseria gonorrhoeae
cagacggcatttgccgcagg

SEQ ID NO: 55107 - DNA, 20 bp, Neisseria gonorrhoeae
agacggcatttgccgcaggg

SEQ ID NO: 55108 - DNA, 20 bp, Neisseria gonorrhoeae
gccgcagggtgcaaaacact

SEQ ID NO: 55109 - DNA, 20 bp, Neisseria gonorrhoeae
atcgattcgatacgcggcaa

SEQ ID NO: 55110 - DNA, 20 bp, Neisseria gonorrhoeae
gatacgcggcaaacaccgcc

SEQ ID NO: 55111 - DNA, 20 bp, Neisseria gonorrhoeae
ccgaaatcaaaaaggcaagc

SEQ ID NO: 55112 - DNA, 20 bp, Neisseria gonorrhoeae
cctttttgatttcggcaatg

SEQ ID NO: 55113 - DNA, 20 bp, Neisseria gonorrhoeae
ttgatttcggcaatgacggc

SEQ ID NO: 55114 - DNA, 20 bp, Neisseria gonorrhoeae
ccgatatgcttgccgccacg

SEQ ID NO: 55115 - DNA, 20 bp, Neisseria gonorrhoeae
ccgccacgcccgaaaccgaa

SEQ ID NO: 55116 - DNA, 20 bp, Neisseria gonorrhoeae
gaggtcggtttcggtttcgg

SEQ ID NO: 55117 - DNA, 20 bp, Neisseria gonorrhoeae
cggtttcgggcgtggcggca

SEQ ID NO: 55118 - DNA, 20 bp, Neisseria gonorrhoeae
ggtttcgggcgtggcggcaa

SEQ ID NO: 55119 - DNA, 20 bp, Neisseria gonorrhoeae
cagacgaatgtttcgatttc

SEQ ID NO: 55120 - DNA, 20 bp, Neisseria gonorrhoeae
agacgaatgtttcgatttcg

SEQ ID NO: 55121 - DNA, 20 bp, Neisseria gonorrhoeae
cgatttcgtcctacccgttc

SEQ ID NO: 55122 - DNA, 20 bp, Neisseria gonorrhoeae
gatttcgtcctacccgttcc

SEQ ID NO: 55123 - DNA, 20 bp, Neisseria gonorrhoeae
cgtcctacccgttccgctaa

SEQ ID NO: 55124 - DNA, 20 bp, Neisseria gonorrhoeae
caaaaaggcgacgttttact

SEQ ID NO: 55125 - DNA, 20 bp, Neisseria gonorrhoeae
aaaaaggcgacgttttactg

SEQ ID NO: 55126 - DNA, 20 bp, Neisseria gonorrhoeae
tactgttcgggccggaaacg

SEQ ID NO: 55127 - DNA, 20 bp, Neisseria gonorrhoeae
actgttcgggccggaaacgc

SEQ ID NO: 55128 - DNA, 20 bp, Neisseria gonorrhoeae
ctgttcgggccggaaacgcg

SEQ ID NO: 55129 - DNA, 20 bp, Neisseria gonorrhoeae
cggcggagaccgctacgata

SEQ ID NO: 55130 - DNA, 20 bp, Neisseria gonorrhoeae
accgccgcccacaaaaccct

SEQ ID NO: 55131 - DNA, 20 bp, Neisseria gonorrhoeae
ccgccgcccacaaaaccctg

SEQ ID NO: 55132 - DNA, 20 bp, Neisseria gonorrhoeae
ttggtgttggttacgcgcac

SEQ ID NO: 55133 - DNA, 20 bp, Neisseria gonorrhoeae
tggtgttggttacgcgcaca

SEQ ID NO: 55134 - DNA, 20 bp, Neisseria gonorrhoeae
cagaagaagatgtcaaacgc

SEQ ID NO: 55135 - DNA, 20 bp, Neisseria gonorrhoeae
ttttgccgattcccggagcg

SEQ ID NO: 55136 - DNA, 20 bp, Neisseria gonorrhoeae
tttgccgattcccggagcgg

SEQ ID NO: 55137 - DNA, 20 bp, Neisseria gonorrhoeae
ttgccgattcccggagcgga

SEQ ID NO: 55138 - DNA, 20 bp, Neisseria gonorrhoeae
tgccgattcccggagcggag

SEQ ID NO: 55139 - DNA, 20 bp, Neisseria gonorrhoeae
gccgaaaaaggttgggaact

SEQ ID NO: 55140 - DNA, 20 bp, Neisseria gonorrhoeae
ccgaaaaaggttgggaactg

SEQ ID NO: 55141 - DNA, 20 bp, Neisseria gonorrhoeae
ggaactggcggcaatggcgg

SEQ ID NO: 55142 - DNA, 20 bp, Neisseria gonorrhoeae
tcggtcgtgtgggcgtttgc

SEQ ID NO: 55143 - DNA, 20 bp, Neisseria gonorrhoeae
cggtcgtgtgggcgtttgcc

SEQ ID NO: 55144 - DNA, 20 bp, Neisseria gonorrhoeae
atggttacggtgcgcgccca

SEQ ID NO: 55145 - DNA, 20 bp, Neisseria gonorrhoeae
tggttacggtgcgcgcccaa

SEQ ID NO: 55146 - DNA, 20 bp, Neisseria gonorrhoeae
cggtgcgcgcccaaatgcgg

SEQ ID NO: 55147 - DNA, 20 bp, Neisseria gonorrhoeae
gtgcagcttcatcgtcaaca

SEQ ID NO: 55148 - DNA, 20 bp, Neisseria gonorrhoeae
acgatgaagctgcacgaatg

SEQ ID NO: 55149 - DNA, 20 bp, Neisseria gonorrhoeae
ctcagcgaacacgtcgagtg

SEQ ID NO: 55150 - DNA, 20 bp, Neisseria gonorrhoeae
ggacggcatcggttcagtcg

SEQ ID NO: 55151 - DNA, 20 bp, Neisseria gonorrhoeae
agtcgtgctgccactcgacg

SEQ ID NO: 55152 - DNA, 20 bp, Neisseria gonorrhoeae
gctgaggaagccgccgctct

SEQ ID NO: 55153 - DNA, 20 bp, Neisseria gonorrhoeae
cgcctgcggcgaccgcgtcc

SEQ ID NO: 55154 - DNA, 20 bp, Neisseria gonorrhoeae
gcctgcggcgaccgcgtccg

SEQ ID NO: 55155 - DNA, 20 bp, Neisseria gonorrhoeae
tttgcgggtgctggcttcgt

SEQ ID NO: 55156 - DNA, 20 bp, Neisseria gonorrhoeae
ttgcgggtgctggcttcgta

SEQ ID NO: 55157 - DNA, 20 bp, Neisseria gonorrhoeae
tgcgggtgctggcttcgtag

SEQ ID NO: 55158 - DNA, 20 bp, Neisseria gonorrhoeae
gcgcttgagcgcggccacgc

SEQ ID NO: 55159 - DNA, 20 bp, Neisseria gonorrhoeae
cgcttgagcgcggccacgcc

SEQ ID NO: 55160 - DNA, 20 bp, Neisseria gonorrhoeae
agcgcggccacgccgaacag

SEQ ID NO: 55161 - DNA, 20 bp, Neisseria gonorrhoeae
ggcgtggccgcgctcaagcg

SEQ ID NO: 55162 - DNA, 20 bp, Neisseria gonorrhoeae
cggacaccacctgatcgagc

SEQ ID NO: 55163 - DNA, 20 bp, Neisseria gonorrhoeae
gcgtttatggcgggcgcggt

SEQ ID NO: 55164 - DNA, 20 bp, Neisseria gonorrhoeae
atggcgggcgcggtcggctt

SEQ ID NO: 55165 - DNA, 20 bp, Neisseria gonorrhoeae
tggcgggcgcggtcggcttt

SEQ ID NO: 55166 - DNA, 20 bp, Neisseria gonorrhoeae
gcggcgggcctctattacgc

SEQ ID NO: 55167 - DNA, 20 bp, Neisseria gonorrhoeae
cggcgggcctctattacgcc

SEQ ID NO: 55168 - DNA, 20 bp, Neisseria gonorrhoeae
ccaacgcgccgtaatgcgtc

SEQ ID NO: 55169 - DNA, 20 bp, Neisseria gonorrhoeae
gtcatcactggcccacaagt

SEQ ID NO: 55170 - DNA, 20 bp, Neisseria gonorrhoeae
tcatcactggcccacaagtc

SEQ ID NO: 55171 - DNA, 20 bp, Neisseria gonorrhoeae
ttgttgccggcggacttgtg

SEQ ID NO: 55172 - DNA, 20 bp, Neisseria gonorrhoeae
ttgccggcggacttgtgggc

SEQ ID NO: 55173 - DNA, 20 bp, Neisseria gonorrhoeae
catcgaatcaggcagccaga

SEQ ID NO: 55174 - DNA, 20 bp, Neisseria gonorrhoeae
tgccgatttacccatcgcac

SEQ ID NO: 55175 - DNA, 20 bp, Neisseria gonorrhoeae
acccatcgcaccgacaaaca

SEQ ID NO: 55176 - DNA, 20 bp, Neisseria gonorrhoeae
cccatcgcaccgacaaacag

SEQ ID NO: 55177 - DNA, 20 bp, Neisseria gonorrhoeae
gattaccgtaacctgtttgc

SEQ ID NO: 55178 - DNA, 20 bp, Neisseria gonorrhoeae
gccctccccttccgtcttga

SEQ ID NO: 55179 - DNA, 20 bp, Neisseria gonorrhoeae
ccctccccttccgtcttgag

SEQ ID NO: 55180 - DNA, 20 bp, Neisseria gonorrhoeae
cgtcttgaggccgtctgaaa

SEQ ID NO: 55181 - DNA, 20 bp, Neisseria gonorrhoeae
aggccgtctgaaacttcgct

SEQ ID NO: 55182 - DNA, 20 bp, Neisseria gonorrhoeae
gctttcttcggcagattcga

SEQ ID NO: 55183 - DNA, 20 bp, Neisseria gonorrhoeae
gcatctggtgctgaccttct

SEQ ID NO: 55184 - DNA, 20 bp, Neisseria gonorrhoeae
catctggtgctgaccttctg

SEQ ID NO: 55185 - DNA, 20 bp, Neisseria gonorrhoeae
tgcgtgagcgcgatgatttg

SEQ ID NO: 55186 - DNA, 20 bp, Neisseria gonorrhoeae
ggatgctgatgcaggcggag

SEQ ID NO: 55187 - DNA, 20 bp, Neisseria gonorrhoeae
gatgctgatgcaggcggagt

SEQ ID NO: 55188 - DNA, 20 bp, Neisseria gonorrhoeae
gaggccgtctgaacgccctc

SEQ ID NO: 55189 - DNA, 20 bp, Neisseria gonorrhoeae
aggccgtctgaacgccctcc

SEQ ID NO: 55190 - DNA, 20 bp, Neisseria gonorrhoeae
tccagtttggacggcaggct

SEQ ID NO: 55191 - DNA, 20 bp, Neisseria gonorrhoeae
ggacggcaggctttccgcat

SEQ ID NO: 55192 - DNA, 20 bp, Neisseria gonorrhoeae
agacggcctcaaaccgcctc

SEQ ID NO: 55193 - DNA, 20 bp, Neisseria gonorrhoeae
atgtccgtggcagatttgtt

SEQ ID NO: 55194 - DNA, 20 bp, Neisseria gonorrhoeae
tgtccgtggcagatttgttc

SEQ ID NO: 55195 - DNA, 20 bp, Neisseria gonorrhoeae
ccgcacacgcccagccgcgc

SEQ ID NO: 55196 - DNA, 20 bp, Neisseria gonorrhoeae
cgcacacgcccagccgcgct

SEQ ID NO: 55197 - DNA, 20 bp, Neisseria gonorrhoeae
gacaccattgtgccgctgtt

SEQ ID NO: 55198 - DNA, 20 bp, Neisseria gonorrhoeae
cgccagttttttcagcaccc

SEQ ID NO: 55199 - DNA, 20 bp, Neisseria gonorrhoeae
tttcagcacccggttgcttt

SEQ ID NO: 55200 - DNA, 20 bp, Neisseria gonorrhoeae
ttcagcacccggttgctttt

SEQ ID NO: 55201 - DNA, 20 bp, Neisseria gonorrhoeae
tcagcacccggttgcttttt

SEQ ID NO: 55202 - DNA, 20 bp, Neisseria gonorrhoeae
cagcacccggttgctttttt

SEQ ID NO: 55203 - DNA, 20 bp, Neisseria gonorrhoeae
gcatccggactggtcaacgc

SEQ ID NO: 55204 - DNA, 20 bp, Neisseria gonorrhoeae
ggcaggacaattcctgttcg

SEQ ID NO: 55205 - DNA, 20 bp, Neisseria gonorrhoeae
tcctgccgaaccgcctgcgt

SEQ ID NO: 55206 - DNA, 20 bp, Neisseria gonorrhoeae
accagtccggatgccaagcc

SEQ ID NO: 55207 - DNA, 20 bp, Neisseria gonorrhoeae
gtgtgtggggacttgggcgg

SEQ ID NO: 55208 - DNA, 20 bp, Neisseria gonorrhoeae
ccggcggcaacaacgccgcc

SEQ ID NO: 55209 - DNA, 20 bp, Neisseria gonorrhoeae
tgactgcttctccgaggctt

SEQ ID NO: 55210 - DNA, 20 bp, Neisseria gonorrhoeae
gactgcttctccgaggcttt

SEQ ID NO: 55211 - DNA, 20 bp, Neisseria gonorrhoeae
actgcttctccgaggctttg

SEQ ID NO: 55212 - DNA, 20 bp, Neisseria gonorrhoeae
tccgaggctttgtccgtgtg

SEQ ID NO: 55213 - DNA, 20 bp, Neisseria gonorrhoeae
ctcggctcgtacatcggcgg

SEQ ID NO: 55214 - DNA, 20 bp, Neisseria gonorrhoeae
cacaattcggtgactacggc

SEQ ID NO: 55215 - DNA, 20 bp, Neisseria gonorrhoeae
ggtgactacggctggatgtg

SEQ ID NO: 55216 - DNA, 20 bp, Neisseria gonorrhoeae
tgtaatcacgatgccgccga

SEQ ID NO: 55217 - DNA, 20 bp, Neisseria gonorrhoeae
agcccaccgaaaccaatccc

SEQ ID NO: 55218 - DNA, 20 bp, Neisseria gonorrhoeae
tatcccgtcattctcgcgca

SEQ ID NO: 55219 - DNA, 20 bp, Neisseria gonorrhoeae
ctgtgccggtttgagccggt

SEQ ID NO: 55220 - DNA, 20 bp, Neisseria gonorrhoeae
gagccggtgaggttggtggc

SEQ ID NO: 55221 - DNA, 20 bp, Neisseria gonorrhoeae
agccggtgaggttggtggcg

SEQ ID NO: 55222 - DNA, 20 bp, Neisseria gonorrhoeae
cccgacctgaacaaagccgt

SEQ ID NO: 55223 - DNA, 20 bp, Neisseria gonorrhoeae
cgccacaaacaactgggact

SEQ ID NO: 55224 - DNA, 20 bp, Neisseria gonorrhoeae
tggacgctgctgcccgaagc

SEQ ID NO: 55225 - DNA, 20 bp, Neisseria gonorrhoeae
gggcagcagcgtccagaagt

SEQ ID NO: 55226 - DNA, 20 bp, Neisseria gonorrhoeae
tttgtggcggaacgcatatt

SEQ ID NO: 55227 - DNA, 20 bp, Neisseria gonorrhoeae
tcctgcttccgagaccgaag

SEQ ID NO: 55228 - DNA, 20 bp, Neisseria gonorrhoeae
cgagaccgaagcggcttccc

SEQ ID NO: 55229 - DNA, 20 bp, Neisseria gonorrhoeae
ccaagtacaggcctcggaag

SEQ ID NO: 55230 - DNA, 20 bp, Neisseria gonorrhoeae
cgaggcctgtacttgggaag

SEQ ID NO: 55231 - DNA, 20 bp, Neisseria gonorrhoeae
ggaagccgcttcggtctcgg

SEQ ID NO: 55232 - DNA, 20 bp, Neisseria gonorrhoeae
aatgctgcgctgctgggcag

SEQ ID NO: 55233 - DNA, 20 bp, Neisseria gonorrhoeae
tgggacggacgtgccgccga

SEQ ID NO: 55234 - DNA, 20 bp, Neisseria gonorrhoeae
gggacggacgtgccgccgat

SEQ ID NO: 55235 - DNA, 20 bp, Neisseria gonorrhoeae
ggacggacgtgccgccgatg

SEQ ID NO: 55236 - DNA, 20 bp, Neisseria gonorrhoeae
aggaacaggctggcgggcct

SEQ ID NO: 55237 - DNA, 20 bp, Neisseria gonorrhoeae
gaaggattccgccgcgctgc

SEQ ID NO: 55238 - DNA, 20 bp, Neisseria gonorrhoeae
aaggattccgccgcgctgcg

SEQ ID NO: 55239 - DNA, 20 bp, Neisseria gonorrhoeae
cgccgcgctgcgggagccgc

SEQ ID NO: 55240 - DNA, 20 bp, Neisseria gonorrhoeae
cttgccagaagcgtttgcct

SEQ ID NO: 55241 - DNA, 20 bp, Neisseria gonorrhoeae
ttgccagaagcgtttgcctg

SEQ ID NO: 55242 - DNA, 20 bp, Neisseria gonorrhoeae
gtccacttgggtaagcaggt

SEQ ID NO: 55243 - DNA, 20 bp, Neisseria gonorrhoeae
ggtaagcaggtggtgcagtc

SEQ ID NO: 55244 - DNA, 20 bp, Neisseria gonorrhoeae
cgtggaagagggtgaggatt

SEQ ID NO: 55245 - DNA, 20 bp, Neisseria gonorrhoeae
gtggaagagggtgaggattt

SEQ ID NO: 55246 - DNA, 20 bp, Neisseria gonorrhoeae
cgtcgtggcttaaacgcgct

SEQ ID NO: 55247 - DNA, 20 bp, Neisseria gonorrhoeae
ggtgatgccggtcagacgct

SEQ ID NO: 55248 - DNA, 20 bp, Neisseria gonorrhoeae
gcccagccggtgtgcgtttg

SEQ ID NO: 55249 - DNA, 20 bp, Neisseria gonorrhoeae
gacaacaacagctacaaaat

SEQ ID NO: 55250 - DNA, 20 bp, Neisseria gonorrhoeae
cccagtcggacagcgcgttg

SEQ ID NO: 55251 - DNA, 20 bp, Neisseria gonorrhoeae
acgacggatacgcccacgcc

SEQ ID NO: 55252 - DNA, 20 bp, Neisseria gonorrhoeae
tgtagctgttgttgtcgaat

SEQ ID NO: 55253 - DNA, 20 bp, Neisseria gonorrhoeae
gtagctgttgttgtcgaatt

SEQ ID NO: 55254 - DNA, 20 bp, Neisseria gonorrhoeae
ccgccccgaccaacggcgcg

SEQ ID NO: 55255 - DNA, 20 bp, Neisseria gonorrhoeae
ccgccgtattgcattatttc

SEQ ID NO: 55256 - DNA, 20 bp, Neisseria gonorrhoeae
cggaaataatgcaatacggc

SEQ ID NO: 55257 - DNA, 20 bp, Neisseria gonorrhoeae
gtcggggcggtaacgacgcg

SEQ ID NO: 55258 - DNA, 20 bp, Neisseria gonorrhoeae
ccggcgcggatgtcggttgt

SEQ ID NO: 55259 - DNA, 20 bp, Neisseria gonorrhoeae
cggcgcggatgtcggttgtc

SEQ ID NO: 55260 - DNA, 20 bp, Neisseria gonorrhoeae
tcagggcgaagtcggcgtag

SEQ ID NO: 55261 - DNA, 20 bp, Neisseria gonorrhoeae
aatggcggcgggtgcatacg

SEQ ID NO: 55262 - DNA, 20 bp, Neisseria gonorrhoeae
ggcgtatgcacccgccgcca

SEQ ID NO: 55263 - DNA, 20 bp, Neisseria gonorrhoeae
gaagacggcacggacaaaaa

SEQ ID NO: 55264 - DNA, 20 bp, Neisseria gonorrhoeae
tttgtccgtgccgtcttcca

SEQ ID NO: 55265 - DNA, 20 bp, Neisseria gonorrhoeae
ttgtccgtgccgtcttccaa

SEQ ID NO: 55266 - DNA, 20 bp, Neisseria gonorrhoeae
tgtccgtgccgtcttccaag

SEQ ID NO: 55267 - DNA, 20 bp, Neisseria gonorrhoeae
gtccgtgccgtcttccaaga

SEQ ID NO: 55268 - DNA, 20 bp, Neisseria gonorrhoeae
gatgccgtaagccgccatcg

SEQ ID NO: 55269 - DNA, 20 bp, Neisseria gonorrhoeae
atgccgtaagccgccatcgg

SEQ ID NO: 55270 - DNA, 20 bp, Neisseria gonorrhoeae
tgccgacggcgtatgcttct

SEQ ID NO: 55271 - DNA, 20 bp, Neisseria gonorrhoeae
gccgacggcgtatgcttctg

SEQ ID NO: 55272 - DNA, 20 bp, Neisseria gonorrhoeae
ccgacggcgtatgcttctgc

SEQ ID NO: 55273 - DNA, 20 bp, Neisseria gonorrhoeae
tccgacaaaatccggctcac

SEQ ID NO: 55274 - DNA, 20 bp, Neisseria gonorrhoeae
ccgacaaaatccggctcaca

SEQ ID NO: 55275 - DNA, 20 bp, Neisseria gonorrhoeae
cgacaaaatccggctcacaa

SEQ ID NO: 55276 - DNA, 20 bp, Neisseria gonorrhoeae
gcgatgtcgtccacggcgat

SEQ ID NO: 55277 - DNA, 20 bp, Neisseria gonorrhoeae
tgagccggattttgtcggaa

SEQ ID NO: 55278 - DNA, 20 bp, Neisseria gonorrhoeae
ccgaacgcgaagccgccgtc

SEQ ID NO: 55279 - DNA, 20 bp, Neisseria gonorrhoeae
cggacggcggcttcgcgttc

SEQ ID NO: 55280 - DNA, 20 bp, Neisseria gonorrhoeae
gcgttcggcaagcatggcct

SEQ ID NO: 55281 - DNA, 20 bp, Neisseria gonorrhoeae
ggcaagcatggccttgcgtt

SEQ ID NO: 55282 - DNA, 20 bp, Neisseria gonorrhoeae
cgttcgtcggcttcgcgctg

SEQ ID NO: 55283 - DNA, 20 bp, Neisseria gonorrhoeae
gggcgcgccgctgccgcaca

SEQ ID NO: 55284 - DNA, 20 bp, Neisseria gonorrhoeae
cgcaaaacagccgttgaccg

SEQ ID NO: 55285 - DNA, 20 bp, Neisseria gonorrhoeae
accgcaacccgatagctgcc

SEQ ID NO: 55286 - DNA, 20 bp, Neisseria gonorrhoeae
cgcagcgttttcgccagcga

SEQ ID NO: 55287 - DNA, 20 bp, Neisseria gonorrhoeae
cggtcaacggctgttttgcg

SEQ ID NO: 55288 - DNA, 20 bp, Neisseria gonorrhoeae
tccgcgccgtttcacggtcg

SEQ ID NO: 55289 - DNA, 20 bp, Neisseria gonorrhoeae
ccgcgccgtttcacggtcgt

SEQ ID NO: 55290 - DNA, 20 bp, Neisseria gonorrhoeae
cgcgccgtttcacggtcgtc

SEQ ID NO: 55291 - DNA, 20 bp, Neisseria gonorrhoeae
cacggtcgtcttccaagggc

SEQ ID NO: 55292 - DNA, 20 bp, Neisseria gonorrhoeae
acggtcgtcttccaagggca

SEQ ID NO: 55293 - DNA, 20 bp, Neisseria gonorrhoeae
cagacggcatttccttctcc

SEQ ID NO: 55294 - DNA, 20 bp, Neisseria gonorrhoeae
agacggcatttccttctccg

SEQ ID NO: 55295 - DNA, 20 bp, Neisseria gonorrhoeae
ccttctccgccacgcgcaca

SEQ ID NO: 55296 - DNA, 20 bp, Neisseria gonorrhoeae
cttctccgccacgcgcacag

SEQ ID NO: 55297 - DNA, 20 bp, Neisseria gonorrhoeae
tccgccacgcgcacaggcgg

SEQ ID NO: 55298 - DNA, 20 bp, Neisseria gonorrhoeae
cggacttttggaattgagcc

SEQ ID NO: 55299 - DNA, 20 bp, Neisseria gonorrhoeae
ggacttttggaattgagccg

SEQ ID NO: 55300 - DNA, 20 bp, Neisseria gonorrhoeae
tggaattgagccgccaacgc

SEQ ID NO: 55301 - DNA, 20 bp, Neisseria gonorrhoeae
ggaattgagccgccaacgcc

SEQ ID NO: 55302 - DNA, 20 bp, Neisseria gonorrhoeae
gaattgagccgccaacgcct

SEQ ID NO: 55303 - DNA, 20 bp, Neisseria gonorrhoeae
ctgctgaacgaaaaacgcgc

SEQ ID NO: 55304 - DNA, 20 bp, Neisseria gonorrhoeae
cattgcaaacagctcggcgc

SEQ ID NO: 55305 - DNA, 20 bp, Neisseria gonorrhoeae
caaacagctcggcgcgtttt

SEQ ID NO: 55306 - DNA, 20 bp, Neisseria gonorrhoeae
ttcgttcagcaggaaggtgg

SEQ ID NO: 55307 - DNA, 20 bp, Neisseria gonorrhoeae
tcgttcagcaggaaggtggc

SEQ ID NO: 55308 - DNA, 20 bp, Neisseria gonorrhoeae
cggcaacggcggcggtttcc

SEQ ID NO: 55309 - DNA, 20 bp, Neisseria gonorrhoeae
ggcaacggcggcggtttccg

SEQ ID NO: 55310 - DNA, 20 bp, Neisseria gonorrhoeae
ccggtgcggtttggccacgt

SEQ ID NO: 55311 - DNA, 20 bp, Neisseria gonorrhoeae
cggtgcggtttggccacgtt

SEQ ID NO: 55312 - DNA, 20 bp, Neisseria gonorrhoeae
ggccacgttcgttgcggctg

SEQ ID NO: 55313 - DNA, 20 bp, Neisseria gonorrhoeae
ccgtcagcattgccgatccg

SEQ ID NO: 55314 - DNA, 20 bp, Neisseria gonorrhoeae
ccgatccgctcatcgccaca

SEQ ID NO: 55315 - DNA, 20 bp, Neisseria gonorrhoeae
agacggcatcttccgccgtt

SEQ ID NO: 55316 - DNA, 20 bp, Neisseria gonorrhoeae
gaaacggcggaagatgccgt

SEQ ID NO: 55317 - DNA, 20 bp, Neisseria gonorrhoeae
aaacggcggaagatgccgtc

SEQ ID NO: 55318 - DNA, 20 bp, Neisseria gonorrhoeae
acggctgcggcggaacaggc

SEQ ID NO: 55319 - DNA, 20 bp, Neisseria gonorrhoeae
cggctgcggcggaacaggca

SEQ ID NO: 55320 - DNA, 20 bp, Neisseria gonorrhoeae
cgatcaggacgagtccgccg

SEQ ID NO: 55321 - DNA, 20 bp, Neisseria gonorrhoeae
gatcaggacgagtccgccgg

SEQ ID NO: 55322 - DNA, 20 bp, Neisseria gonorrhoeae
gtgcggtttcccgtgcctgt

SEQ ID NO: 55323 - DNA, 20 bp, Neisseria gonorrhoeae
ccgccaaatcgagcgcggtg

SEQ ID NO: 55324 - DNA, 20 bp, Neisseria gonorrhoeae
atccgcacctccgtcgatca

SEQ ID NO: 55325 - DNA, 20 bp, Neisseria gonorrhoeae
tccgcacctccgtcgatcac

SEQ ID NO: 55326 - DNA, 20 bp, Neisseria gonorrhoeae
ggcggcaaccggcagggcgg

SEQ ID NO: 55327 - DNA, 20 bp, Neisseria gonorrhoeae
gcggcaaccggcagggcgga

SEQ ID NO: 55328 - DNA, 20 bp, Neisseria gonorrhoeae
ttgtccggcaaaatccacat

SEQ ID NO: 55329 - DNA, 20 bp, Neisseria gonorrhoeae
tgtccggcaaaatccacatc

SEQ ID NO: 55330 - DNA, 20 bp, Neisseria gonorrhoeae
gtccggcaaaatccacatcg

SEQ ID NO: 55331 - DNA, 20 bp, Neisseria gonorrhoeae
tccggcaaaatccacatcgg

SEQ ID NO: 55332 - DNA, 20 bp, Neisseria gonorrhoeae
ggaaaactacgaaggcggcc

SEQ ID NO: 55333 - DNA, 20 bp, Neisseria gonorrhoeae
ggacaaaaactcagccgcga

SEQ ID NO: 55334 - DNA, 20 bp, Neisseria gonorrhoeae
gttacgccgcccgaacctcg

SEQ ID NO: 55335 - DNA, 20 bp, Neisseria gonorrhoeae
ttacgccgcccgaacctcga

SEQ ID NO: 55336 - DNA, 20 bp, Neisseria gonorrhoeae
cgccgcccgaacctcgatta

SEQ ID NO: 55337 - DNA, 20 bp, Neisseria gonorrhoeae
cgccgcgctgatgacgctcg

SEQ ID NO: 55338 - DNA, 20 bp, Neisseria gonorrhoeae
ccgcaccggccagcgcgcgg

SEQ ID NO: 55339 - DNA, 20 bp, Neisseria gonorrhoeae
cgcaccggccagcgcgcggt

SEQ ID NO: 55340 - DNA, 20 bp, Neisseria gonorrhoeae
gcacccagcacagcgtatcc

SEQ ID NO: 55341 - DNA, 20 bp, Neisseria gonorrhoeae
gctgcgtaccgccgccgact

SEQ ID NO: 55342 - DNA, 20 bp, Neisseria gonorrhoeae
ctgcgtaccgccgccgactg

SEQ ID NO: 55343 - DNA, 20 bp, Neisseria gonorrhoeae
gccgcgcgatgccagcgaag

SEQ ID NO: 55344 - DNA, 20 bp, Neisseria gonorrhoeae
ccgcgcgatgccagcgaagc

SEQ ID NO: 55345 - DNA, 20 bp, Neisseria gonorrhoeae
accgtcgtcgtcgttttgcc

SEQ ID NO: 55346 - DNA, 20 bp, Neisseria gonorrhoeae
ccgtcgtcgtcgttttgccc

SEQ ID NO: 55347 - DNA, 20 bp, Neisseria gonorrhoeae
tgcccacaccgcccttctga

SEQ ID NO: 55348 - DNA, 20 bp, Neisseria gonorrhoeae
ccgccgccaaactgctgccg

SEQ ID NO: 55349 - DNA, 20 bp, Neisseria gonorrhoeae
cagcggcagcagtttggcgg

SEQ ID NO: 55350 - DNA, 20 bp, Neisseria gonorrhoeae
agcggcagcagtttggcggc

SEQ ID NO: 55351 - DNA, 20 bp, Neisseria gonorrhoeae
ggcggcggcaatggcgatgg

SEQ ID NO: 55352 - DNA, 20 bp, Neisseria gonorrhoeae
gcggcggcaatggcgatggc

SEQ ID NO: 55353 - DNA, 20 bp, Neisseria gonorrhoeae
ggagcagaatatggtcaaaa

SEQ ID NO: 55354 - DNA, 20 bp, Neisseria gonorrhoeae
gagcagaatatggtcaaaat

SEQ ID NO: 55355 - DNA, 20 bp, Neisseria gonorrhoeae
cgcccgatgtggcggcgagg

SEQ ID NO: 55356 - DNA, 20 bp, Neisseria gonorrhoeae
gcccgatgtggcggcgaggt

SEQ ID NO: 55357 - DNA, 20 bp, Neisseria gonorrhoeae
tgaccatgcgtgcgttgatt

SEQ ID NO: 55358 - DNA, 20 bp, Neisseria gonorrhoeae
acactgctccaaaccgacct

SEQ ID NO: 55359 - DNA, 20 bp, Neisseria gonorrhoeae
gttgcaggtcggtttggagc

SEQ ID NO: 55360 - DNA, 20 bp, Neisseria gonorrhoeae
ttgcaggtcggtttggagca

SEQ ID NO: 55361 - DNA, 20 bp, Neisseria gonorrhoeae
caggtcggtttggagcagtg

SEQ ID NO: 55362 - DNA, 20 bp, Neisseria gonorrhoeae
ggagcagtgtgaagtggcgg

SEQ ID NO: 55363 - DNA, 20 bp, Neisseria gonorrhoeae
ctctggctcagcaccaatat

SEQ ID NO: 55364 - DNA, 20 bp, Neisseria gonorrhoeae
ccgccctcgtcatcctgctg

SEQ ID NO: 55365 - DNA, 20 bp, Neisseria gonorrhoeae
cgccctcgtcatcctgctgc

SEQ ID NO: 55366 - DNA, 20 bp, Neisseria gonorrhoeae
gcggcgggtgcgttgcagca

SEQ ID NO: 55367 - DNA, 20 bp, Neisseria gonorrhoeae
cggcgggtgcgttgcagcag

SEQ ID NO: 55368 - DNA, 20 bp, Neisseria gonorrhoeae
gagggcaatatggcggccaa

SEQ ID NO: 55369 - DNA, 20 bp, Neisseria gonorrhoeae
agggcaatatggcggccaaa

SEQ ID NO: 55370 - DNA, 20 bp, Neisseria gonorrhoeae
aaacttgggactgaacccgg

SEQ ID NO: 55371 - DNA, 20 bp, Neisseria gonorrhoeae
ggactgaacccggcagctgt

SEQ ID NO: 55372 - DNA, 20 bp, Neisseria gonorrhoeae
agtcccaagtttgaatcgcg

SEQ ID NO: 55373 - DNA, 20 bp, Neisseria gonorrhoeae
ggtctgggttgccgacgttt

SEQ ID NO: 55374 - DNA, 20 bp, Neisseria gonorrhoeae
gtctgggttgccgacgtttg

SEQ ID NO: 55375 - DNA, 20 bp, Neisseria gonorrhoeae
ccgacgtttgcgcgtatttc

SEQ ID NO: 55376 - DNA, 20 bp, Neisseria gonorrhoeae
gcgcgtatttcagcggcaag

SEQ ID NO: 55377 - DNA, 20 bp, Neisseria gonorrhoeae
cgcgtatttcagcggcaagg

SEQ ID NO: 55378 - DNA, 20 bp, Neisseria gonorrhoeae
aactacctgcccgtcaaagt

SEQ ID NO: 55379 - DNA, 20 bp, Neisseria gonorrhoeae
tgatgatggcactgccgtgt

SEQ ID NO: 55380 - DNA, 20 bp, Neisseria gonorrhoeae
gatgatggcactgccgtgtg

SEQ ID NO: 55381 - DNA, 20 bp, Neisseria gonorrhoeae
atgatggcactgccgtgtgt

SEQ ID NO: 55382 - DNA, 20 bp, Neisseria gonorrhoeae
taggtgtcgccgactttgac

SEQ ID NO: 55383 - DNA, 20 bp, Neisseria gonorrhoeae
ggtaatgctgtgggtgacgg

SEQ ID NO: 55384 - DNA, 20 bp, Neisseria gonorrhoeae
tgtcggcgatttcgatgtgt

SEQ ID NO: 55385 - DNA, 20 bp, Neisseria gonorrhoeae
gtcggcgatttcgatgtgtc

SEQ ID NO: 55386 - DNA, 20 bp, Neisseria gonorrhoeae
tcggcgatttcgatgtgtcc

SEQ ID NO: 55387 - DNA, 20 bp, Neisseria gonorrhoeae
cgatgtgtccgaccgtaccg

SEQ ID NO: 55388 - DNA, 20 bp, Neisseria gonorrhoeae
tggatgtggatgaccgctat

SEQ ID NO: 55389 - DNA, 20 bp, Neisseria gonorrhoeae
ccactgcagtcgccacgccg

SEQ ID NO: 55390 - DNA, 20 bp, Neisseria gonorrhoeae
cccgtaccgatggtggcgga

SEQ ID NO: 55391 - DNA, 20 bp, Neisseria gonorrhoeae
cacgatggacgacgtacgcg

SEQ ID NO: 55392 - DNA, 20 bp, Neisseria gonorrhoeae
acgatggacgacgtacgcgc

SEQ ID NO: 55393 - DNA, 20 bp, Neisseria gonorrhoeae
atacaggcgcacgaacactt

SEQ ID NO: 55394 - DNA, 20 bp, Neisseria gonorrhoeae
ggccacggtttcggcgcgta

SEQ ID NO: 55395 - DNA, 20 bp, Neisseria gonorrhoeae
cggcgcgtacgtcgtccatc

SEQ ID NO: 55396 - DNA, 20 bp, Neisseria gonorrhoeae
ccccgaaaccgacggcggcg

SEQ ID NO: 55397 - DNA, 20 bp, Neisseria gonorrhoeae
cccgaaaccgacggcggcga

SEQ ID NO: 55398 - DNA, 20 bp, Neisseria gonorrhoeae
ttcagacggcattcgggcaa

SEQ ID NO: 55399 - DNA, 20 bp, Neisseria gonorrhoeae
agacggcattcgggcaaatg

SEQ ID NO: 55400 - DNA, 20 bp, Neisseria gonorrhoeae
gcccgaatgccgtctgaaca

SEQ ID NO: 55401 - DNA, 20 bp, Neisseria gonorrhoeae
gcagcctcacaaatcaattt

SEQ ID NO: 55402 - DNA, 20 bp, Neisseria gonorrhoeae
cagcctcacaaatcaattta

SEQ ID NO: 55403 - DNA, 20 bp, Neisseria gonorrhoeae
agcacgagtagcaccaatac

SEQ ID NO: 55404 - DNA, 20 bp, Neisseria gonorrhoeae
gcacgagtagcaccaatacc

SEQ ID NO: 55405 - DNA, 20 bp, Neisseria gonorrhoeae
cgatgtgtgcgttattaggg

SEQ ID NO: 55406 - DNA, 20 bp, Neisseria gonorrhoeae
taaccaatgtaaccctaatc

SEQ ID NO: 55407 - DNA, 20 bp, Neisseria gonorrhoeae
aaccaatgtaaccctaatct

SEQ ID NO: 55408 - DNA, 20 bp, Neisseria gonorrhoeae
accaatgtaaccctaatctt

SEQ ID NO: 55409 - DNA, 20 bp, Neisseria gonorrhoeae
ttttgttcagccatggttaa

SEQ ID NO: 55410 - DNA, 20 bp, Neisseria gonorrhoeae
tttgttcagccatggttaac

SEQ ID NO: 55411 - DNA, 20 bp, Neisseria gonorrhoeae
cagaagcaacttgaacaccg

SEQ ID NO: 55412 - DNA, 20 bp, Neisseria gonorrhoeae
aacaccgaacagcagctcga

SEQ ID NO: 55413 - DNA, 20 bp, Neisseria gonorrhoeae
gatttcaggtttggttgcat

SEQ ID NO: 55414 - DNA, 20 bp, Neisseria gonorrhoeae
atttcaggtttggttgcatt

SEQ ID NO: 55415 - DNA, 20 bp, Neisseria gonorrhoeae
caggtttggttgcatttgcc

SEQ ID NO: 55416 - DNA, 20 bp, Neisseria gonorrhoeae
caccgaccgcactgtttttt

SEQ ID NO: 55417 - DNA, 20 bp, Neisseria gonorrhoeae
accgaccgcactgttttttg

SEQ ID NO: 55418 - DNA, 20 bp, Neisseria gonorrhoeae
tttgattttgttgttttgcc

SEQ ID NO: 55419 - DNA, 20 bp, Neisseria gonorrhoeae
ttgattttgttgttttgcct

SEQ ID NO: 55420 - DNA, 20 bp, Neisseria gonorrhoeae
tgattttgttgttttgcctt

SEQ ID NO: 55421 - DNA, 20 bp, Neisseria gonorrhoeae
ccccttcagacggcatcgca

SEQ ID NO: 55422 - DNA, 20 bp, Neisseria gonorrhoeae
cccttcagacggcatcgcag

SEQ ID NO: 55423 - DNA, 20 bp, Neisseria gonorrhoeae
agacggcatcgcagcccgac

SEQ ID NO: 55424 - DNA, 20 bp, Neisseria gonorrhoeae
acgtcggtagtcgggctgcg

SEQ ID NO: 55425 - DNA, 20 bp, Neisseria gonorrhoeae
gcagaggatgtgccgccggt

SEQ ID NO: 55426 - DNA, 20 bp, Neisseria gonorrhoeae
agttacatccaccagacgac

SEQ ID NO: 55427 - DNA, 20 bp, Neisseria gonorrhoeae
catccaccagacgacgggtc

SEQ ID NO: 55428 - DNA, 20 bp, Neisseria gonorrhoeae
gcggttttcaacgcggtatc

SEQ ID NO: 55429 - DNA, 20 bp, Neisseria gonorrhoeae
tcaacgcggtatccgccaaa

SEQ ID NO: 55430 - DNA, 20 bp, Neisseria gonorrhoeae
caacgcggtatccgccaaac

SEQ ID NO: 55431 - DNA, 20 bp, Neisseria gonorrhoeae
gccgccaaactgagctttac

SEQ ID NO: 55432 - DNA, 20 bp, Neisseria gonorrhoeae
accgcccagaggttgttgag

SEQ ID NO: 55433 - DNA, 20 bp, Neisseria gonorrhoeae
ccgcccagaggttgttgagt

SEQ ID NO: 55434 - DNA, 20 bp, Neisseria gonorrhoeae
ttgagtaaccagactgtacg

SEQ ID NO: 55435 - DNA, 20 bp, Neisseria gonorrhoeae
agtaaccagactgtacgggc

SEQ ID NO: 55436 - DNA, 20 bp, Neisseria gonorrhoeae
agacggcatcggtatcggcg

SEQ ID NO: 55437 - DNA, 20 bp, Neisseria gonorrhoeae
ggcgtgcgctaccgcttctg

SEQ ID NO: 55438 - DNA, 20 bp, Neisseria gonorrhoeae
tgattcgccgataccgatgc

SEQ ID NO: 55439 - DNA, 20 bp, Neisseria gonorrhoeae
gccgataccgatgccgtctg

SEQ ID NO: 55440 - DNA, 20 bp, Neisseria gonorrhoeae
agacggcatttttgatgcgc

SEQ ID NO: 55441 - DNA, 20 bp, Neisseria gonorrhoeae
gcgccccatttctgccgcca

SEQ ID NO: 55442 - DNA, 20 bp, Neisseria gonorrhoeae
ctgccgccaggccggcggta

SEQ ID NO: 55443 - DNA, 20 bp, Neisseria gonorrhoeae
tgccgccaggccggcggtaa

SEQ ID NO: 55444 - DNA, 20 bp, Neisseria gonorrhoeae
gaatccggttcgctgattac

SEQ ID NO: 55445 - DNA, 20 bp, Neisseria gonorrhoeae
gctgattaccgccggcctgg

SEQ ID NO: 55446 - DNA, 20 bp, Neisseria gonorrhoeae
attcgcgcagcggcaggtta

SEQ ID NO: 55447 - DNA, 20 bp, Neisseria gonorrhoeae
gcgcagcggcaggttaaagt

SEQ ID NO: 55448 - DNA, 20 bp, Neisseria gonorrhoeae
aagtcgaacccgcacgccat

SEQ ID NO: 55449 - DNA, 20 bp, Neisseria gonorrhoeae
cgtcggcaggcacgccgcgc

SEQ ID NO: 55450 - DNA, 20 bp, Neisseria gonorrhoeae
ttcggcactggggcgcggcg

SEQ ID NO: 55451 - DNA, 20 bp, Neisseria gonorrhoeae
gccacttcaccccacgcggc

SEQ ID NO: 55452 - DNA, 20 bp, Neisseria gonorrhoeae
accccacgcggcttcttttt

SEQ ID NO: 55453 - DNA, 20 bp, Neisseria gonorrhoeae
tttttgcgcgcgtatcagca

SEQ ID NO: 55454 - DNA, 20 bp, Neisseria gonorrhoeae
ttgcgcgcgtatcagcacgg

SEQ ID NO: 55455 - DNA, 20 bp, Neisseria gonorrhoeae
tgcgcgcgtatcagcacggt

SEQ ID NO: 55456 - DNA, 20 bp, Neisseria gonorrhoeae
gattaccccggtgcgcaccc

SEQ ID NO: 55457 - DNA, 20 bp, Neisseria gonorrhoeae
attaccccggtgcgcacccg

SEQ ID NO: 55458 - DNA, 20 bp, Neisseria gonorrhoeae
ccccggtgcgcacccgttcg

SEQ ID NO: 55459 - DNA, 20 bp, Neisseria gonorrhoeae
gatacagccgctggtggtcg

SEQ ID NO: 55460 - DNA, 20 bp, Neisseria gonorrhoeae
ccgaaatacagcagggcgac

SEQ ID NO: 55461 - DNA, 20 bp, Neisseria gonorrhoeae
agcagcagcggcagcgcgtt

SEQ ID NO: 55462 - DNA, 20 bp, Neisseria gonorrhoeae
gcccactcccacagcgaagg

SEQ ID NO: 55463 - DNA, 20 bp, Neisseria gonorrhoeae
cggatgttggggctggtggc

SEQ ID NO: 55464 - DNA, 20 bp, Neisseria gonorrhoeae
gggctggtggcggtattggc

SEQ ID NO: 55465 - DNA, 20 bp, Neisseria gonorrhoeae
gcgttcagcgcgccttcgct

SEQ ID NO: 55466 - DNA, 20 bp, Neisseria gonorrhoeae
gacggcaccgatgcggtgat

SEQ ID NO: 55467 - DNA, 20 bp, Neisseria gonorrhoeae
cgccgaaaccgccgtcggcg

SEQ ID NO: 55468 - DNA, 20 bp, Neisseria gonorrhoeae
gaaaccgtcagccaaatggc

SEQ ID NO: 55469 - DNA, 20 bp, Neisseria gonorrhoeae
aaaccgtcagccaaatggcg

SEQ ID NO: 55470 - DNA, 20 bp, Neisseria gonorrhoeae
ggctgacggtttcaaacgga

SEQ ID NO: 55471 - DNA, 20 bp, Neisseria gonorrhoeae
tggcaaccagcaccgaccac

SEQ ID NO: 55472 - DNA, 20 bp, Neisseria gonorrhoeae
ggcaaccagcaccgaccacg

SEQ ID NO: 55473 - DNA, 20 bp, Neisseria gonorrhoeae
gcaaccagcaccgaccacga

SEQ ID NO: 55474 - DNA, 20 bp, Neisseria gonorrhoeae
aacgaagtcgaaacgatgct

SEQ ID NO: 55475 - DNA, 20 bp, Neisseria gonorrhoeae
tgttccaccagcatcgtttc

SEQ ID NO: 55476 - DNA, 20 bp, Neisseria gonorrhoeae
caaagtttcacacacgctca

SEQ ID NO: 55477 - DNA, 20 bp, Neisseria gonorrhoeae
cacacacgctcaaaggcgat

SEQ ID NO: 55478 - DNA, 20 bp, Neisseria gonorrhoeae
acacacgctcaaaggcgatg

SEQ ID NO: 55479 - DNA, 20 bp, Neisseria gonorrhoeae
ggcatcgcctttgagcgtgt

SEQ ID NO: 55480 - DNA, 20 bp, Neisseria gonorrhoeae
gagcgtgtgtgaaactttgg

SEQ ID NO: 55481 - DNA, 20 bp, Neisseria gonorrhoeae
gtacggtaagtctgacaata

SEQ ID NO: 55482 - DNA, 20 bp, Neisseria gonorrhoeae
caacagaaagcaattgttgg

SEQ ID NO: 55483 - DNA, 20 bp, Neisseria gonorrhoeae
aacagaaagcaattgttgga

SEQ ID NO: 55484 - DNA, 20 bp, Neisseria gonorrhoeae
ttggaatccggcttgttcaa

SEQ ID NO: 55485 - DNA, 20 bp, Neisseria gonorrhoeae
gaatccggcttgttcaaaac

SEQ ID NO: 55486 - DNA, 20 bp, Neisseria gonorrhoeae
cagcaccttcactttgacca

SEQ ID NO: 55487 - DNA, 20 bp, Neisseria gonorrhoeae
actttgaccacgtcgccggc

SEQ ID NO: 55488 - DNA, 20 bp, Neisseria gonorrhoeae
gaccacgtcgccggctttca

SEQ ID NO: 55489 - DNA, 20 bp, Neisseria gonorrhoeae
accacgtcgccggctttcac

SEQ ID NO: 55490 - DNA, 20 bp, Neisseria gonorrhoeae
caccacgtcgcgcgggtctt

SEQ ID NO: 55491 - DNA, 20 bp, Neisseria gonorrhoeae
ggttcacgtcgtgctgatac

SEQ ID NO: 55492 - DNA, 20 bp, Neisseria gonorrhoeae
gttcacgtcgtgctgatact

SEQ ID NO: 55493 - DNA, 20 bp, Neisseria gonorrhoeae
acgtcgtgctgatactgccc

SEQ ID NO: 55494 - DNA, 20 bp, Neisseria gonorrhoeae
ggggtcgattttgaccaact

SEQ ID NO: 55495 - DNA, 20 bp, Neisseria gonorrhoeae
gggtcgattttgaccaactc

SEQ ID NO: 55496 - DNA, 20 bp, Neisseria gonorrhoeae
ggaaacgacgattttgtgca

SEQ ID NO: 55497 - DNA, 20 bp, Neisseria gonorrhoeae
tgtgcaggctgctttcgggc

SEQ ID NO: 55498 - DNA, 20 bp, Neisseria gonorrhoeae
gtgcaggctgctttcgggca

SEQ ID NO: 55499 - DNA, 20 bp, Neisseria gonorrhoeae
tgcaggctgctttcgggcat

SEQ ID NO: 55500 - DNA, 20 bp, Neisseria gonorrhoeae
cgggcattccgcgcaccagt

SEQ ID NO: 55501 - DNA, 20 bp, Neisseria gonorrhoeae
cagccgctcggcaagctggc

SEQ ID NO: 55502 - DNA, 20 bp, Neisseria gonorrhoeae
tttacggtaacgcgcgataa

SEQ ID NO: 55503 - DNA, 20 bp, Neisseria gonorrhoeae
acggtaacgcgcgataaagg

SEQ ID NO: 55504 - DNA, 20 bp, Neisseria gonorrhoeae
cggtaacgcgcgataaaggg

SEQ ID NO: 55505 - DNA, 20 bp, Neisseria gonorrhoeae
atcgcgcgttaccgtaaaga

SEQ ID NO: 55506 - DNA, 20 bp, Neisseria gonorrhoeae
ccgcaccgataaaacgcact

SEQ ID NO: 55507 - DNA, 20 bp, Neisseria gonorrhoeae
ttccttccacagcttcatcg

SEQ ID NO: 55508 - DNA, 20 bp, Neisseria gonorrhoeae
tccttccacagcttcatcgc

SEQ ID NO: 55509 - DNA, 20 bp, Neisseria gonorrhoeae
ccttccacagcttcatcgca

SEQ ID NO: 55510 - DNA, 20 bp, Neisseria gonorrhoeae
cttccacagcttcatcgcaa

SEQ ID NO: 55511 - DNA, 20 bp, Neisseria gonorrhoeae
gggtttctttggggacggtg

SEQ ID NO: 55512 - DNA, 20 bp, Neisseria gonorrhoeae
ggtttctttggggacggtga

SEQ ID NO: 55513 - DNA, 20 bp, Neisseria gonorrhoeae
ctttggggacggtgagcttg

SEQ ID NO: 55514 - DNA, 20 bp, Neisseria gonorrhoeae
tttggggacggtgagcttga

SEQ ID NO: 55515 - DNA, 20 bp, Neisseria gonorrhoeae
ggggacggtgagcttgactt

SEQ ID NO: 55516 - DNA, 20 bp, Neisseria gonorrhoeae
gggtttcggctgtcgaagga

SEQ ID NO: 55517 - DNA, 20 bp, Neisseria gonorrhoeae
ggtttcggctgtcgaaggaa

SEQ ID NO: 55518 - DNA, 20 bp, Neisseria gonorrhoeae
cggctgtcgaaggaagggct

SEQ ID NO: 55519 - DNA, 20 bp, Neisseria gonorrhoeae
ggctgtcgaaggaagggctt

SEQ ID NO: 55520 - DNA, 20 bp, Neisseria gonorrhoeae
tttgcaaaggtctcagaatg

SEQ ID NO: 55521 - DNA, 20 bp, Neisseria gonorrhoeae
ccccgaggtaacggctgagc

SEQ ID NO: 55522 - DNA, 20 bp, Neisseria gonorrhoeae
gtgctttctgtcgcagccgg

SEQ ID NO: 55523 - DNA, 20 bp, Neisseria gonorrhoeae
ctgtcgcagccggattgtcg

SEQ ID NO: 55524 - DNA, 20 bp, Neisseria gonorrhoeae
tgtcgcagccggattgtcgg

SEQ ID NO: 55525 - DNA, 20 bp, Neisseria gonorrhoeae
tcggtcggtacgctcagccg

SEQ ID NO: 55526 - DNA, 20 bp, Neisseria gonorrhoeae
cccgccggagagaaagaaat

SEQ ID NO: 55527 - DNA, 20 bp, Neisseria gonorrhoeae
ggacagcatggaacgcacca

SEQ ID NO: 55528 - DNA, 20 bp, Neisseria gonorrhoeae
ctttctctccggcggggaat

SEQ ID NO: 55529 - DNA, 20 bp, Neisseria gonorrhoeae
tttctctccggcggggaata

SEQ ID NO: 55530 - DNA, 20 bp, Neisseria gonorrhoeae
ctctccggcggggaatacgt

SEQ ID NO: 55531 - DNA, 20 bp, Neisseria gonorrhoeae
gggcgagctgcatcgcgtat

SEQ ID NO: 55532 - DNA, 20 bp, Neisseria gonorrhoeae
ggcgagctgcatcgcgtatt

SEQ ID NO: 55533 - DNA, 20 bp, Neisseria gonorrhoeae
catactttccctgctgcgga

SEQ ID NO: 55534 - DNA, 20 bp, Neisseria gonorrhoeae
ccctgctgcggacttcgccg

SEQ ID NO: 55535 - DNA, 20 bp, Neisseria gonorrhoeae
cctgctgcggacttcgccga

SEQ ID NO: 55536 - DNA, 20 bp, Neisseria gonorrhoeae
accgccgcctccatcgtctg

SEQ ID NO: 55537 - DNA, 20 bp, Neisseria gonorrhoeae
ccgccgcctccatcgtctgg

SEQ ID NO: 55538 - DNA, 20 bp, Neisseria gonorrhoeae
gtactcggcatcatcgccgg

SEQ ID NO: 55539 - DNA, 20 bp, Neisseria gonorrhoeae
ggttcgcctagctgccagac

SEQ ID NO: 55540 - DNA, 20 bp, Neisseria gonorrhoeae
gcctagctgccagacgatgg

SEQ ID NO: 55541 - DNA, 20 bp, Neisseria gonorrhoeae
atgattttatgcggcaccgt

SEQ ID NO: 55542 - DNA, 20 bp, Neisseria gonorrhoeae
tatgcggcaccgtactgtac

SEQ ID NO: 55543 - DNA, 20 bp, Neisseria gonorrhoeae
atgcggcaccgtactgtaca

SEQ ID NO: 55544 - DNA, 20 bp, Neisseria gonorrhoeae
tgcggcaccgtactgtacag

SEQ ID NO: 55545 - DNA, 20 bp, Neisseria gonorrhoeae
caaatcatcctgccccaccg

SEQ ID NO: 55546 - DNA, 20 bp, Neisseria gonorrhoeae
cagacggcaacgacagtccc

SEQ ID NO: 55547 - DNA, 20 bp, Neisseria gonorrhoeae
agacggcaacgacagtcccg

SEQ ID NO: 55548 - DNA, 20 bp, Neisseria gonorrhoeae
tcgacaacctcggcagcgtc

SEQ ID NO: 55549 - DNA, 20 bp, Neisseria gonorrhoeae
tcgagaaggcggctcaggtg

SEQ ID NO: 55550 - DNA, 20 bp, Neisseria gonorrhoeae
ccgtctgaaaggaggcgcag

SEQ ID NO: 55551 - DNA, 20 bp, Neisseria gonorrhoeae
cgccatgccgtccgcctgtc

SEQ ID NO: 55552 - DNA, 20 bp, Neisseria gonorrhoeae
gaggttcagctgcggacgga

SEQ ID NO: 55553 - DNA, 20 bp, Neisseria gonorrhoeae
agctgcggacggattgcctg

SEQ ID NO: 55554 - DNA, 20 bp, Neisseria gonorrhoeae
cgccgagtacggtgccggcg

SEQ ID NO: 55555 - DNA, 20 bp, Neisseria gonorrhoeae
gtacacgcggcttttggtgg

SEQ ID NO: 55556 - DNA, 20 bp, Neisseria gonorrhoeae
accctgctcaaaaccggcta

SEQ ID NO: 55557 - DNA, 20 bp, Neisseria gonorrhoeae
ccctgctcaaaaccggctac

SEQ ID NO: 55558 - DNA, 20 bp, Neisseria gonorrhoeae
ttcgtgcatttcgctgcggt

SEQ ID NO: 55559 - DNA, 20 bp, Neisseria gonorrhoeae
gtgcatttcgctgcggtatg

SEQ ID NO: 55560 - DNA, 20 bp, Neisseria gonorrhoeae
cgctgcggtatgcgccgagg

SEQ ID NO: 55561 - DNA, 20 bp, Neisseria gonorrhoeae
cagacggcattggatacact

SEQ ID NO: 55562 - DNA, 20 bp, Neisseria gonorrhoeae
agacggcattggatacactg

SEQ ID NO: 55563 - DNA, 20 bp, Neisseria gonorrhoeae
gatacactgcgcggcgaact

SEQ ID NO: 55564 - DNA, 20 bp, Neisseria gonorrhoeae
gagctgttggaggaggatgt

SEQ ID NO: 55565 - DNA, 20 bp, Neisseria gonorrhoeae
gaggaggatgtggctttgtg

SEQ ID NO: 55566 - DNA, 20 bp, Neisseria gonorrhoeae
tatagcggattaacaaaaac

SEQ ID NO: 55567 - DNA, 20 bp, Neisseria gonorrhoeae
atagcggattaacaaaaacc

SEQ ID NO: 55568 - DNA, 20 bp, Neisseria gonorrhoeae
tagcggattaacaaaaaccg

SEQ ID NO: 55569 - DNA, 20 bp, Neisseria gonorrhoeae
acaaaaaccggtacggcgtt

SEQ ID NO: 55570 - DNA, 20 bp, Neisseria gonorrhoeae
ccccgccccggctcaaaggg

SEQ ID NO: 55571 - DNA, 20 bp, Neisseria gonorrhoeae
gcccgctgtgtttcgtcgtt

SEQ ID NO: 55572 - DNA, 20 bp, Neisseria gonorrhoeae
cgtcgttcaaagaacagcgc

SEQ ID NO: 55573 - DNA, 20 bp, Neisseria gonorrhoeae
gtcgttcaaagaacagcgcg

SEQ ID NO: 55574 - DNA, 20 bp, Neisseria gonorrhoeae
aaagaacagcgcgtgcagac

SEQ ID NO: 55575 - DNA, 20 bp, Neisseria gonorrhoeae
gcccgaaccgccacgcccgt

SEQ ID NO: 55576 - DNA, 20 bp, Neisseria gonorrhoeae
cccaagccgcgcccgtcgcc

SEQ ID NO: 55577 - DNA, 20 bp, Neisseria gonorrhoeae
atggcgggcgaactcgacgc

SEQ ID NO: 55578 - DNA, 20 bp, Neisseria gonorrhoeae
gggcaaagccttgaaacagc

SEQ ID NO: 55579 - DNA, 20 bp, Neisseria gonorrhoeae
ggcaaagccttgaaacagcc

SEQ ID NO: 55580 - DNA, 20 bp, Neisseria gonorrhoeae
caaggctttgcccaaagcgt

SEQ ID NO: 55581 - DNA, 20 bp, Neisseria gonorrhoeae
gccgccgatgccgaagcggt

SEQ ID NO: 55582 - DNA, 20 bp, Neisseria gonorrhoeae
ccgccgatgccgaagcggtg

SEQ ID NO: 55583 - DNA, 20 bp, Neisseria gonorrhoeae
ccgaagacgagatgattttg

SEQ ID NO: 55584 - DNA, 20 bp, Neisseria gonorrhoeae
tggacatcggcccgaaatcc

SEQ ID NO: 55585 - DNA, 20 bp, Neisseria gonorrhoeae
ggacatcggcccgaaatccg

SEQ ID NO: 55586 - DNA, 20 bp, Neisseria gonorrhoeae
tgagggtaagcagtgtgccg

SEQ ID NO: 55587 - DNA, 20 bp, Neisseria gonorrhoeae
gcgcagaagctgtttgagtg

SEQ ID NO: 55588 - DNA, 20 bp, Neisseria gonorrhoeae
gagtgcggagcgcgcggatt

SEQ ID NO: 55589 - DNA, 20 bp, Neisseria gonorrhoeae
agtgcggagcgcgcggattc

SEQ ID NO: 55590 - DNA, 20 bp, Neisseria gonorrhoeae
tgcgccaacccttcggcaca

SEQ ID NO: 55591 - DNA, 20 bp, Neisseria gonorrhoeae
gtcaaaggcgaaatctccat

SEQ ID NO: 55592 - DNA, 20 bp, Neisseria gonorrhoeae
ttgcccgcgccgacggtacg

SEQ ID NO: 55593 - DNA, 20 bp, Neisseria gonorrhoeae
cccgcgccgacggtacgccg

SEQ ID NO: 55594 - DNA, 20 bp, Neisseria gonorrhoeae
taggtcggcgtaccgtcggc

SEQ ID NO: 55595 - DNA, 20 bp, Neisseria gonorrhoeae
gttggggatggagatttcgc

SEQ ID NO: 55596 - DNA, 20 bp, Neisseria gonorrhoeae
gagggtttcggcaactggca

SEQ ID NO: 55597 - DNA, 20 bp, Neisseria gonorrhoeae
agggtttcggcaactggcag

SEQ ID NO: 55598 - DNA, 20 bp, Neisseria gonorrhoeae
cggcaactggcagggtttcg

SEQ ID NO: 55599 - DNA, 20 bp, Neisseria gonorrhoeae
ggcaactggcagggtttcgg

SEQ ID NO: 55600 - DNA, 20 bp, Neisseria gonorrhoeae
cggggaaaacggctttaagg

SEQ ID NO: 55601 - DNA, 20 bp, Neisseria gonorrhoeae
cgatgcgcacgactttgcgc

SEQ ID NO: 55602 - DNA, 20 bp, Neisseria gonorrhoeae
gcgctccaccggccctttgc

SEQ ID NO: 55603 - DNA, 20 bp, Neisseria gonorrhoeae
cgctccaccggccctttgcc

SEQ ID NO: 55604 - DNA, 20 bp, Neisseria gonorrhoeae
gcccgcgccgacttcgccga

SEQ ID NO: 55605 - DNA, 20 bp, Neisseria gonorrhoeae
cccgcgccgacttcgccgac

SEQ ID NO: 55606 - DNA, 20 bp, Neisseria gonorrhoeae
gaatacttcgcaggcaaaat

SEQ ID NO: 55607 - DNA, 20 bp, Neisseria gonorrhoeae
gcaggcaaaatctaaggctt

SEQ ID NO: 55608 - DNA, 20 bp, Neisseria gonorrhoeae
aacaaacctgtggataagta

SEQ ID NO: 55609 - DNA, 20 bp, Neisseria gonorrhoeae
cgttcagacggcattgttta

SEQ ID NO: 55610 - DNA, 20 bp, Neisseria gonorrhoeae
agacggcattgtttatctgt

SEQ ID NO: 55611 - DNA, 20 bp, Neisseria gonorrhoeae
gggaaacgaggctgaaaaag

SEQ ID NO: 55612 - DNA, 20 bp, Neisseria gonorrhoeae
cagacgggctgccgtttacc

SEQ ID NO: 55613 - DNA, 20 bp, Neisseria gonorrhoeae
accatagtgtgcgctaaaat

SEQ ID NO: 55614 - DNA, 20 bp, Neisseria gonorrhoeae
ccatagtgtgcgctaaaatg

SEQ ID NO: 55615 - DNA, 20 bp, Neisseria gonorrhoeae
attttagcgcacactatggt

SEQ ID NO: 55616 - DNA, 20 bp, Neisseria gonorrhoeae
ataccgataccgatccgatt

SEQ ID NO: 55617 - DNA, 20 bp, Neisseria gonorrhoeae
taccgataccgatccgatta

SEQ ID NO: 55618 - DNA, 20 bp, Neisseria gonorrhoeae
aaacaggcgttcaagtttcg

SEQ ID NO: 55619 - DNA, 20 bp, Neisseria gonorrhoeae
aagtttcggctattgcaaaa

SEQ ID NO: 55620 - DNA, 20 bp, Neisseria gonorrhoeae
cggctattgcaaaaaatgtg

SEQ ID NO: 55621 - DNA, 20 bp, Neisseria gonorrhoeae
cgacattagccaaagcactc

SEQ ID NO: 55622 - DNA, 20 bp, Neisseria gonorrhoeae
gccaaagcactcggtaagtt

SEQ ID NO: 55623 - DNA, 20 bp, Neisseria gonorrhoeae
gcgcatttgaaaaaaaggcc

SEQ ID NO: 55624 - DNA, 20 bp, Neisseria gonorrhoeae
gaaaaaaaggccgcaacaca

SEQ ID NO: 55625 - DNA, 20 bp, Neisseria gonorrhoeae
aaaaaaaggccgcaacacaa

SEQ ID NO: 55626 - DNA, 20 bp, Neisseria gonorrhoeae
tgatggcggttgcaagtgcg

SEQ ID NO: 55627 - DNA, 20 bp, Neisseria gonorrhoeae
gatggcggttgcaagtgcgg

SEQ ID NO: 55628 - DNA, 20 bp, Neisseria gonorrhoeae
atggcggttgcaagtgcggc

SEQ ID NO: 55629 - DNA, 20 bp, Neisseria gonorrhoeae
caagtgcggcgatgagggtg

SEQ ID NO: 55630 - DNA, 20 bp, Neisseria gonorrhoeae
tgccctgtccttttgaaagc

SEQ ID NO: 55631 - DNA, 20 bp, Neisseria gonorrhoeae
gggcgggacaggatgcggta

SEQ ID NO: 55632 - DNA, 20 bp, Neisseria gonorrhoeae
gtcgaacaccgcgccgatat

SEQ ID NO: 55633 - DNA, 20 bp, Neisseria gonorrhoeae
tcgaacaccgcgccgatatc

SEQ ID NO: 55634 - DNA, 20 bp, Neisseria gonorrhoeae
tccatgctgaccgtgccgga

SEQ ID NO: 55635 - DNA, 20 bp, Neisseria gonorrhoeae
ccatgctgaccgtgccggag

SEQ ID NO: 55636 - DNA, 20 bp, Neisseria gonorrhoeae
aatgcgcccaagtcgggaag

SEQ ID NO: 55637 - DNA, 20 bp, Neisseria gonorrhoeae
gccatattgccgccgaaggc

SEQ ID NO: 55638 - DNA, 20 bp, Neisseria gonorrhoeae
ccatattgccgccgaaggcg

SEQ ID NO: 55639 - DNA, 20 bp, Neisseria gonorrhoeae
ggcggcaatatggcaaatac

SEQ ID NO: 55640 - DNA, 20 bp, Neisseria gonorrhoeae
cagcctcccttcccgacttg

SEQ ID NO: 55641 - DNA, 20 bp, Neisseria gonorrhoeae
tcagggaaaatgcgttcaaa

SEQ ID NO: 55642 - DNA, 20 bp, Neisseria gonorrhoeae
cagggaaaatgcgttcaaac

SEQ ID NO: 55643 - DNA, 20 bp, Neisseria gonorrhoeae
agggaaaatgcgttcaaacc

SEQ ID NO: 55644 - DNA, 20 bp, Neisseria gonorrhoeae
aaacccaaagcctgcccgcc

SEQ ID NO: 55645 - DNA, 20 bp, Neisseria gonorrhoeae
gccggctgatattgaggtag

SEQ ID NO: 55646 - DNA, 20 bp, Neisseria gonorrhoeae
atatcggcgcgcatcgggcg

SEQ ID NO: 55647 - DNA, 20 bp, Neisseria gonorrhoeae
tgtcgggcgagcctttgagg

SEQ ID NO: 55648 - DNA, 20 bp, Neisseria gonorrhoeae
taccctcaaaggctcgcccg

SEQ ID NO: 55649 - DNA, 20 bp, Neisseria gonorrhoeae
accctcaaaggctcgcccga

SEQ ID NO: 55650 - DNA, 20 bp, Neisseria gonorrhoeae
ccctcaaaggctcgcccgac

SEQ ID NO: 55651 - DNA, 20 bp, Neisseria gonorrhoeae
agcaggcggtctttaaacag

SEQ ID NO: 55652 - DNA, 20 bp, Neisseria gonorrhoeae
aaacagctcgagatagcctt

SEQ ID NO: 55653 - DNA, 20 bp, Neisseria gonorrhoeae
aacagctcgagatagccttg

SEQ ID NO: 55654 - DNA, 20 bp, Neisseria gonorrhoeae
cgcggtcaggctgccttccc

SEQ ID NO: 55655 - DNA, 20 bp, Neisseria gonorrhoeae
aaagaccgcctgctcaagct

SEQ ID NO: 55656 - DNA, 20 bp, Neisseria gonorrhoeae
gaggttttgggaggaaatgt

SEQ ID NO: 55657 - DNA, 20 bp, Neisseria gonorrhoeae
aggttttgggaggaaatgtt

SEQ ID NO: 55658 - DNA, 20 bp, Neisseria gonorrhoeae
tgggaggaaatgtttacgcc

SEQ ID NO: 55659 - DNA, 20 bp, Neisseria gonorrhoeae
gggaggaaatgtttacgccg

SEQ ID NO: 55660 - DNA, 20 bp, Neisseria gonorrhoeae
ggaggaaatgtttacgccga

SEQ ID NO: 55661 - DNA, 20 bp, Neisseria gonorrhoeae
tttgttttcgggcgtgaaga

SEQ ID NO: 55662 - DNA, 20 bp, Neisseria gonorrhoeae
ttgttttcgggcgtgaagaa

SEQ ID NO: 55663 - DNA, 20 bp, Neisseria gonorrhoeae
tgttttcgggcgtgaagaaa

SEQ ID NO: 55664 - DNA, 20 bp, Neisseria gonorrhoeae
gttttcgggcgtgaagaaat

SEQ ID NO: 55665 - DNA, 20 bp, Neisseria gonorrhoeae
ttttcgggcgtgaagaaata

SEQ ID NO: 55666 - DNA, 20 bp, Neisseria gonorrhoeae
cccaaatcgacatccgagcc

SEQ ID NO: 55667 - DNA, 20 bp, Neisseria gonorrhoeae
tccggccttctgcgagaaat

SEQ ID NO: 55668 - DNA, 20 bp, Neisseria gonorrhoeae
ccggccttctgcgagaaatt

SEQ ID NO: 55669 - DNA, 20 bp, Neisseria gonorrhoeae
cggccttctgcgagaaattc

SEQ ID NO: 55670 - DNA, 20 bp, Neisseria gonorrhoeae
tgcgagaaattccgccccca

SEQ ID NO: 55671 - DNA, 20 bp, Neisseria gonorrhoeae
ttgctgaaaatgccggggaa

SEQ ID NO: 55672 - DNA, 20 bp, Neisseria gonorrhoeae
ctgaaaatgccggggaaggg

SEQ ID NO: 55673 - DNA, 20 bp, Neisseria gonorrhoeae
cgtcctgcgtatcggtttgc

SEQ ID NO: 55674 - DNA, 20 bp, Neisseria gonorrhoeae
gcggcgcaccgcccgctgcc

SEQ ID NO: 55675 - DNA, 20 bp, Neisseria gonorrhoeae
cggcgcaccgcccgctgcct

SEQ ID NO: 55676 - DNA, 20 bp, Neisseria gonorrhoeae
tccatactagtaggtgctcc

SEQ ID NO: 55677 - DNA, 20 bp, Neisseria gonorrhoeae
acaacatcaaccctgtcgcc

SEQ ID NO: 55678 - DNA, 20 bp, Neisseria gonorrhoeae
gcgacagggttgatgttgtt

SEQ ID NO: 55679 - DNA, 20 bp, Neisseria gonorrhoeae
atgttgttaatatgcctgat

SEQ ID NO: 55680 - DNA, 20 bp, Neisseria gonorrhoeae
ttaatatgcctgatggagca

SEQ ID NO: 55681 - DNA, 20 bp, Neisseria gonorrhoeae
gatgtgcatcatgaaacggg

SEQ ID NO: 55682 - DNA, 20 bp, Neisseria gonorrhoeae
gcgcgaggcggtttgcgatg

SEQ ID NO: 55683 - DNA, 20 bp, Neisseria gonorrhoeae
cgcgaggcggtttgcgatgg

SEQ ID NO: 55684 - DNA, 20 bp, Neisseria gonorrhoeae
gcgatggggaggtttggaag

SEQ ID NO: 55685 - DNA, 20 bp, Neisseria gonorrhoeae
cgatggggaggtttggaagc

SEQ ID NO: 55686 - DNA, 20 bp, Neisseria gonorrhoeae
ttgtacaaccgaataacctg

SEQ ID NO: 55687 - DNA, 20 bp, Neisseria gonorrhoeae
tacaaccgaataacctgcat

SEQ ID NO: 55688 - DNA, 20 bp, Neisseria gonorrhoeae
tcggcaacctgctggcaggc

SEQ ID NO: 55689 - DNA, 20 bp, Neisseria gonorrhoeae
cggcaacctgctggcaggcg

SEQ ID NO: 55690 - DNA, 20 bp, Neisseria gonorrhoeae
ggcaacctgctggcaggcgt

SEQ ID NO: 55691 - DNA, 20 bp, Neisseria gonorrhoeae
ggatgaggcggcgtggtggt

SEQ ID NO: 55692 - DNA, 20 bp, Neisseria gonorrhoeae
gggttgggcggcatcttgtc

SEQ ID NO: 55693 - DNA, 20 bp, Neisseria gonorrhoeae
ggcggcatcttgtccgacgg

SEQ ID NO: 55694 - DNA, 20 bp, Neisseria gonorrhoeae
tccgacggcgccgtttggca

SEQ ID NO: 55695 - DNA, 20 bp, Neisseria gonorrhoeae
ggcagccagaattcggtttc

SEQ ID NO: 55696 - DNA, 20 bp, Neisseria gonorrhoeae
ggggcgtgtagcctttggtt

SEQ ID NO: 55697 - DNA, 20 bp, Neisseria gonorrhoeae
gggcgtgtagcctttggttt

SEQ ID NO: 55698 - DNA, 20 bp, Neisseria gonorrhoeae
ggtttggttgttttggcgca

SEQ ID NO: 55699 - DNA, 20 bp, Neisseria gonorrhoeae
gtttggttgttttggcgcag

SEQ ID NO: 55700 - DNA, 20 bp, Neisseria gonorrhoeae
ggttgttttggcgcaggtag

SEQ ID NO: 55701 - DNA, 20 bp, Neisseria gonorrhoeae
tcctgaatgcgggcggtgcg

SEQ ID NO: 55702 - DNA, 20 bp, Neisseria gonorrhoeae
cctgaatgcgggcggtgcgc

SEQ ID NO: 55703 - DNA, 20 bp, Neisseria gonorrhoeae
ctgaatgcgggcggtgcgcg

SEQ ID NO: 55704 - DNA, 20 bp, Neisseria gonorrhoeae
agcagaacgtcggtgtcttt

SEQ ID NO: 55705 - DNA, 20 bp, Neisseria gonorrhoeae
tgctcaacgtcccccatccg

SEQ ID NO: 55706 - DNA, 20 bp, Neisseria gonorrhoeae
ccgacctcacctaccacgga

SEQ ID NO: 55707 - DNA, 20 bp, Neisseria gonorrhoeae
ggcaacatccacttcaaatc

SEQ ID NO: 55708 - DNA, 20 bp, Neisseria gonorrhoeae
acggaggatttgaagtggat

SEQ ID NO: 55709 - DNA, 20 bp, Neisseria gonorrhoeae
gaagtggatgttgcccaagc

SEQ ID NO: 55710 - DNA, 20 bp, Neisseria gonorrhoeae
aagtggatgttgcccaagcc

SEQ ID NO: 55711 - DNA, 20 bp, Neisseria gonorrhoeae
ttaggcatgcccaacgccgg

SEQ ID NO: 55712 - DNA, 20 bp, Neisseria gonorrhoeae
ggcatgcccaacgccggcaa

SEQ ID NO: 55713 - DNA, 20 bp, Neisseria gonorrhoeae
ccgccgtctccgccgcacgc

SEQ ID NO: 55714 - DNA, 20 bp, Neisseria gonorrhoeae
gcgattttggggcgtgcggc

SEQ ID NO: 55715 - DNA, 20 bp, Neisseria gonorrhoeae
tggggcgtgcggcggagacg

SEQ ID NO: 55716 - DNA, 20 bp, Neisseria gonorrhoeae
ctcaaacacctatcacgcac

SEQ ID NO: 55717 - DNA, 20 bp, Neisseria gonorrhoeae
cacgttgtcgatttggcacc

SEQ ID NO: 55718 - DNA, 20 bp, Neisseria gonorrhoeae
tcgatttggcacccttcgac

SEQ ID NO: 55719 - DNA, 20 bp, Neisseria gonorrhoeae
gtcgaagggtgccaaatcga

SEQ ID NO: 55720 - DNA, 20 bp, Neisseria gonorrhoeae
gaggaagcggtggccgaggc

SEQ ID NO: 55721 - DNA, 20 bp, Neisseria gonorrhoeae
tacatggtggagcaaccgcg

SEQ ID NO: 55722 - DNA, 20 bp, Neisseria gonorrhoeae
cgcatacgcctgcccgcggt

SEQ ID NO: 55723 - DNA, 20 bp, Neisseria gonorrhoeae
gcatacgcctgcccgcggtt

SEQ ID NO: 55724 - DNA, 20 bp, Neisseria gonorrhoeae
ctccaccatgtataacccgg

SEQ ID NO: 55725 - DNA, 20 bp, Neisseria gonorrhoeae
gtcgccgacggtgaacgcgc

SEQ ID NO: 55726 - DNA, 20 bp, Neisseria gonorrhoeae
gccgcccatgcccagtttgc

SEQ ID NO: 55727 - DNA, 20 bp, Neisseria gonorrhoeae
gcggatgcgtccgacaggga

SEQ ID NO: 55728 - DNA, 20 bp, Neisseria gonorrhoeae
cggatgcgtccgacagggac

SEQ ID NO: 55729 - DNA, 20 bp, Neisseria gonorrhoeae
accgtcggcgaccaactttt

SEQ ID NO: 55730 - DNA, 20 bp, Neisseria gonorrhoeae
gcgcatatttttcgcgcccg

SEQ ID NO: 55731 - DNA, 20 bp, Neisseria gonorrhoeae
ttcgcgcccgcgccggaagc

SEQ ID NO: 55732 - DNA, 20 bp, Neisseria gonorrhoeae
tcgcgcccgcgccggaagcg

SEQ ID NO: 55733 - DNA, 20 bp, Neisseria gonorrhoeae
cgcgcccgcgccggaagcgg

SEQ ID NO: 55734 - DNA, 20 bp, Neisseria gonorrhoeae
gcgcccgcgccggaagcggc

SEQ ID NO: 55735 - DNA, 20 bp, Neisseria gonorrhoeae
atcggcaagattttcggtcg

SEQ ID NO: 55736 - DNA, 20 bp, Neisseria gonorrhoeae
tcggtcgcactgtggcagac

SEQ ID NO: 55737 - DNA, 20 bp, Neisseria gonorrhoeae
cggtcgcactgtggcagacc

SEQ ID NO: 55738 - DNA, 20 bp, Neisseria gonorrhoeae
ggtcgcactgtggcagaccg

SEQ ID NO: 55739 - DNA, 20 bp, Neisseria gonorrhoeae
ccgatgaagttgccgccgcc

SEQ ID NO: 55740 - DNA, 20 bp, Neisseria gonorrhoeae
gcgcgtgaggcggacatgaa

SEQ ID NO: 55741 - DNA, 20 bp, Neisseria gonorrhoeae
ttggcagcagatgccggcgc

SEQ ID NO: 55742 - DNA, 20 bp, Neisseria gonorrhoeae
tggcagcagatgccggcgca

SEQ ID NO: 55743 - DNA, 20 bp, Neisseria gonorrhoeae
ggcagcagatgccggcgcat

SEQ ID NO: 55744 - DNA, 20 bp, Neisseria gonorrhoeae
gcagcagatgccggcgcata

SEQ ID NO: 55745 - DNA, 20 bp, Neisseria gonorrhoeae
cggctgggcgtttgaccggc

SEQ ID NO: 55746 - DNA, 20 bp, Neisseria gonorrhoeae
ggctgggcgtttgaccggcc

SEQ ID NO: 55747 - DNA, 20 bp, Neisseria gonorrhoeae
gaccggccgcagtatgagtt

SEQ ID NO: 55748 - DNA, 20 bp, Neisseria gonorrhoeae
accggccgcagtatgagttg

SEQ ID NO: 55749 - DNA, 20 bp, Neisseria gonorrhoeae
ggttcgctgtcgcctgttgc

SEQ ID NO: 55750 - DNA, 20 bp, Neisseria gonorrhoeae
ccgtgccgaagcggcgggat

SEQ ID NO: 55751 - DNA, 20 bp, Neisseria gonorrhoeae
cgtgccgaagcggcgggatt

SEQ ID NO: 55752 - DNA, 20 bp, Neisseria gonorrhoeae
ggaacgttttttgctgttgg

SEQ ID NO: 55753 - DNA, 20 bp, Neisseria gonorrhoeae
tttgctgttggacggcggga

SEQ ID NO: 55754 - DNA, 20 bp, Neisseria gonorrhoeae
ttgctgttggacggcgggaa

SEQ ID NO: 55755 - DNA, 20 bp, Neisseria gonorrhoeae
ccgatgccggattcggcggg

SEQ ID NO: 55756 - DNA, 20 bp, Neisseria gonorrhoeae
ggcggggcgcatattgtcga

SEQ ID NO: 55757 - DNA, 20 bp, Neisseria gonorrhoeae
tcgaacactttgccgaagcc

SEQ ID NO: 55758 - DNA, 20 bp, Neisseria gonorrhoeae
gccgaagccgacaggcagga

SEQ ID NO: 55759 - DNA, 20 bp, Neisseria gonorrhoeae
ccgaagccgacaggcaggac

SEQ ID NO: 55760 - DNA, 20 bp, Neisseria gonorrhoeae
gtgcctgtcggaaagaagcc

SEQ ID NO: 55761 - DNA, 20 bp, Neisseria gonorrhoeae
gaacaaccgtccgatttggt

SEQ ID NO: 55762 - DNA, 20 bp, Neisseria gonorrhoeae
aacaaccgtccgatttggtg

SEQ ID NO: 55763 - DNA, 20 bp, Neisseria gonorrhoeae
ggtgcggacagggttgccat

SEQ ID NO: 55764 - DNA, 20 bp, Neisseria gonorrhoeae
gtgcggacagggttgccatt

SEQ ID NO: 55765 - DNA, 20 bp, Neisseria gonorrhoeae
acggggtcgccgctgcgtga

SEQ ID NO: 55766 - DNA, 20 bp, Neisseria gonorrhoeae
agcaatacgccgtcaaaacc

SEQ ID NO: 55767 - DNA, 20 bp, Neisseria gonorrhoeae
catcacttgcgccgcctgcg

SEQ ID NO: 55768 - DNA, 20 bp, Neisseria gonorrhoeae
tgacggcgtattgctgaaca

SEQ ID NO: 55769 - DNA, 20 bp, Neisseria gonorrhoeae
gacggcgtattgctgaacac

SEQ ID NO: 55770 - DNA, 20 bp, Neisseria gonorrhoeae
ggtcgtggtctggaaaatcg

SEQ ID NO: 55771 - DNA, 20 bp, Neisseria gonorrhoeae
gtcgtggtctggaaaatcgc

SEQ ID NO: 55772 - DNA, 20 bp, Neisseria gonorrhoeae
ggcgacggagtgcgtactca

SEQ ID NO: 55773 - DNA, 20 bp, Neisseria gonorrhoeae
ggtttgagtacgcactccgt

SEQ ID NO: 55774 - DNA, 20 bp, Neisseria gonorrhoeae
gagtacgcactccgtcgccg

SEQ ID NO: 55775 - DNA, 20 bp, Neisseria gonorrhoeae
gccgcgtatgccgcgcaagg

SEQ ID NO: 55776 - DNA, 20 bp, Neisseria gonorrhoeae
gttccacgcggttttcgcgc

SEQ ID NO: 55777 - DNA, 20 bp, Neisseria gonorrhoeae
cacgcggttttcgcgccgta

SEQ ID NO: 55778 - DNA, 20 bp, Neisseria gonorrhoeae
tcgcgccgtagccccggcag

SEQ ID NO: 55779 - DNA, 20 bp, Neisseria gonorrhoeae
cgcgccgtagccccggcagt

SEQ ID NO: 55780 - DNA, 20 bp, Neisseria gonorrhoeae
tcctgcccgtgccacacaat

SEQ ID NO: 55781 - DNA, 20 bp, Neisseria gonorrhoeae
tcctgcatcatcgtgagcgt

SEQ ID NO: 55782 - DNA, 20 bp, Neisseria gonorrhoeae
cctgcatcatcgtgagcgtg

SEQ ID NO: 55783 - DNA, 20 bp, Neisseria gonorrhoeae
ctgcatcatcgtgagcgtgt

SEQ ID NO: 55784 - DNA, 20 bp, Neisseria gonorrhoeae
agacggcatcggatgccgcg

SEQ ID NO: 55785 - DNA, 20 bp, Neisseria gonorrhoeae
ccgcaaacgggcggcgtgct

SEQ ID NO: 55786 - DNA, 20 bp, Neisseria gonorrhoeae
gcgcgtgtagtcggcggcca

SEQ ID NO: 55787 - DNA, 20 bp, Neisseria gonorrhoeae
gactgccgttccgaaggtca

SEQ ID NO: 55788 - DNA, 20 bp, Neisseria gonorrhoeae
ggaacggcagtcgaactgtc

SEQ ID NO: 55789 - DNA, 20 bp, Neisseria gonorrhoeae
cctggctgccgctggccgcc

SEQ ID NO: 55790 - DNA, 20 bp, Neisseria gonorrhoeae
cggcaatcgataccgccgcg

SEQ ID NO: 55791 - DNA, 20 bp, Neisseria gonorrhoeae
ggcaatcgataccgccgcgc

SEQ ID NO: 55792 - DNA, 20 bp, Neisseria gonorrhoeae
ggttcggcgcggcggtatcg

SEQ ID NO: 55793 - DNA, 20 bp, Neisseria gonorrhoeae
gttcggcgcggcggtatcga

SEQ ID NO: 55794 - DNA, 20 bp, Neisseria gonorrhoeae
ggcgcggcggtatcgattgc

SEQ ID NO: 55795 - DNA, 20 bp, Neisseria gonorrhoeae
gacctgcgaatacgatatgg

SEQ ID NO: 55796 - DNA, 20 bp, Neisseria gonorrhoeae
acctgcgaatacgatatggt

SEQ ID NO: 55797 - DNA, 20 bp, Neisseria gonorrhoeae
acctcgcccgtctggacggc

SEQ ID NO: 55798 - DNA, 20 bp, Neisseria gonorrhoeae
cctcgcccgtctggacggca

SEQ ID NO: 55799 - DNA, 20 bp, Neisseria gonorrhoeae
aggcgcaccatcgggcggat

SEQ ID NO: 55800 - DNA, 20 bp, Neisseria gonorrhoeae
gaacgcgtcggactgctaga

SEQ ID NO: 55801 - DNA, 20 bp, Neisseria gonorrhoeae
ccggcggtcagaaacagcgc

SEQ ID NO: 55802 - DNA, 20 bp, Neisseria gonorrhoeae
cggcggtcagaaacagcgca

SEQ ID NO: 55803 - DNA, 20 bp, Neisseria gonorrhoeae
ctgaccgccggaaagttcgc

SEQ ID NO: 55804 - DNA, 20 bp, Neisseria gonorrhoeae
tgaccgccggaaagttcgcg

SEQ ID NO: 55805 - DNA, 20 bp, Neisseria gonorrhoeae
acgttgaaatcgccaaagac

SEQ ID NO: 55806 - DNA, 20 bp, Neisseria gonorrhoeae
aaatcgccaaagacctggcc

SEQ ID NO: 55807 - DNA, 20 bp, Neisseria gonorrhoeae
gtcctgaccgaggccgcaaa

SEQ ID NO: 55808 - DNA, 20 bp, Neisseria gonorrhoeae
gacgcggtttgcggcctcgg

SEQ ID NO: 55809 - DNA, 20 bp, Neisseria gonorrhoeae
gcggcctcggtcaggacgaa

SEQ ID NO: 55810 - DNA, 20 bp, Neisseria gonorrhoeae
ggcaacagcaaaggtatggc

SEQ ID NO: 55811 - DNA, 20 bp, Neisseria gonorrhoeae
gcgatgctggtggtggggct

SEQ ID NO: 55812 - DNA, 20 bp, Neisseria gonorrhoeae
ccaaaagccccaccaccagc

SEQ ID NO: 55813 - DNA, 20 bp, Neisseria gonorrhoeae
gctgttgccgaatatcgcca

SEQ ID NO: 55814 - DNA, 20 bp, Neisseria gonorrhoeae
ctgttgccgaatatcgccat

SEQ ID NO: 55815 - DNA, 20 bp, Neisseria gonorrhoeae
ccaccgccgccattgtcggc

SEQ ID NO: 55816 - DNA, 20 bp, Neisseria gonorrhoeae
tcggcacggcgggggcgttg

SEQ ID NO: 55817 - DNA, 20 bp, Neisseria gonorrhoeae
ggcgatgccggttcgcccgc

SEQ ID NO: 55818 - DNA, 20 bp, Neisseria gonorrhoeae
gcccgcgtccgattccacgc

SEQ ID NO: 55819 - DNA, 20 bp, Neisseria gonorrhoeae
cacgctgggcccgacgatgg

SEQ ID NO: 55820 - DNA, 20 bp, Neisseria gonorrhoeae
ccagcccccttccaaggcac

SEQ ID NO: 55821 - DNA, 20 bp, Neisseria gonorrhoeae
caaggcacggtaaaccgcca

SEQ ID NO: 55822 - DNA, 20 bp, Neisseria gonorrhoeae
gcccgcttccagcaggattt

SEQ ID NO: 55823 - DNA, 20 bp, Neisseria gonorrhoeae
cagcaggattttcagagcct

SEQ ID NO: 55824 - DNA, 20 bp, Neisseria gonorrhoeae
tcagagcctccgccgcctgt

SEQ ID NO: 55825 - DNA, 20 bp, Neisseria gonorrhoeae
ccatccgccgcgtcaaagtc

SEQ ID NO: 55826 - DNA, 20 bp, Neisseria gonorrhoeae
catccgccgcgtcaaagtca

SEQ ID NO: 55827 - DNA, 20 bp, Neisseria gonorrhoeae
ttcggtgcgggcgatttctt

SEQ ID NO: 55828 - DNA, 20 bp, Neisseria gonorrhoeae
ggtgcgggcgatttcttcgt

SEQ ID NO: 55829 - DNA, 20 bp, Neisseria gonorrhoeae
cttcgtcaggcgagagggct

SEQ ID NO: 55830 - DNA, 20 bp, Neisseria gonorrhoeae
gaaaccttggttgccgcgac

SEQ ID NO: 55831 - DNA, 20 bp, Neisseria gonorrhoeae
gttgccgcgactttggaagc

SEQ ID NO: 55832 - DNA, 20 bp, Neisseria gonorrhoeae
ccgcgactttggaagccagc

SEQ ID NO: 55833 - DNA, 20 bp, Neisseria gonorrhoeae
ggaagccagcatcctgccgg

SEQ ID NO: 55834 - DNA, 20 bp, Neisseria gonorrhoeae
gaagccagcatcctgccgga

SEQ ID NO: 55835 - DNA, 20 bp, Neisseria gonorrhoeae
gcgcaataccggctgatagt

SEQ ID NO: 55836 - DNA, 20 bp, Neisseria gonorrhoeae
cgcaataccggctgatagtg

SEQ ID NO: 55837 - DNA, 20 bp, Neisseria gonorrhoeae
cgcaaaccttgcgccacgcc

SEQ ID NO: 55838 - DNA, 20 bp, Neisseria gonorrhoeae
cgccacgccgttgatggtca

SEQ ID NO: 55839 - DNA, 20 bp, Neisseria gonorrhoeae
atggtcaggtgcaccatcag

SEQ ID NO: 55840 - DNA, 20 bp, Neisseria gonorrhoeae
tcctttcccgaaaccttgga

SEQ ID NO: 55841 - DNA, 20 bp, Neisseria gonorrhoeae
cctttcccgaaaccttggaa

SEQ ID NO: 55842 - DNA, 20 bp, Neisseria gonorrhoeae
ctttcccgaaaccttggaag

SEQ ID NO: 55843 - DNA, 20 bp, Neisseria gonorrhoeae
cccgaaaccttggaagtgtg

SEQ ID NO: 55844 - DNA, 20 bp, Neisseria gonorrhoeae
ccgaaaccttggaagtgtgt

SEQ ID NO: 55845 - DNA, 20 bp, Neisseria gonorrhoeae
cctccgcaatgggcgcgcag

SEQ ID NO: 55846 - DNA, 20 bp, Neisseria gonorrhoeae
ccggcatcggcgatctcatc

SEQ ID NO: 55847 - DNA, 20 bp, Neisseria gonorrhoeae
acctgtaccggtgcactttc

SEQ ID NO: 55848 - DNA, 20 bp, Neisseria gonorrhoeae
cgcgaaagtgcaccggtaca

SEQ ID NO: 55849 - DNA, 20 bp, Neisseria gonorrhoeae
tgggctgcgcgcccattgcg

SEQ ID NO: 55850 - DNA, 20 bp, Neisseria gonorrhoeae
gcgttcgaacagcggcgtgc

SEQ ID NO: 55851 - DNA, 20 bp, Neisseria gonorrhoeae
cgttcgaacagcggcgtgcc

SEQ ID NO: 55852 - DNA, 20 bp, Neisseria gonorrhoeae
gaacagcggcgtgccgtagt

SEQ ID NO: 55853 - DNA, 20 bp, Neisseria gonorrhoeae
tcgagcatacggatctggtg

SEQ ID NO: 55854 - DNA, 20 bp, Neisseria gonorrhoeae
cgagcatacggatctggtgg

SEQ ID NO: 55855 - DNA, 20 bp, Neisseria gonorrhoeae
cgtcccgacattgcccccgc

SEQ ID NO: 55856 - DNA, 20 bp, Neisseria gonorrhoeae
cccccgccgatttgggcgca

SEQ ID NO: 55857 - DNA, 20 bp, Neisseria gonorrhoeae
gggcgcagactggaagggcg

SEQ ID NO: 55858 - DNA, 20 bp, Neisseria gonorrhoeae
ggcgcagactggaagggcgg

SEQ ID NO: 55859 - DNA, 20 bp, Neisseria gonorrhoeae
ttctgcccgtgccacggttc

SEQ ID NO: 55860 - DNA, 20 bp, Neisseria gonorrhoeae
ctcgaagcgccgaacttcga

SEQ ID NO: 55861 - DNA, 20 bp, Neisseria gonorrhoeae
gatgcggcaaatgcgctgaa

SEQ ID NO: 55862 - DNA, 20 bp, Neisseria gonorrhoeae
tcagcgcatttgccgcatcg

SEQ ID NO: 55863 - DNA, 20 bp, Neisseria gonorrhoeae
cagcgcatttgccgcatcga

SEQ ID NO: 55864 - DNA, 20 bp, Neisseria gonorrhoeae
agcgcatttgccgcatcgaa

SEQ ID NO: 55865 - DNA, 20 bp, Neisseria gonorrhoeae
cagacggcatcattctaaaa

SEQ ID NO: 55866 - DNA, 20 bp, Neisseria gonorrhoeae
agacggcatcattctaaaaa

SEQ ID NO: 55867 - DNA, 20 bp, Neisseria gonorrhoeae
taaaaatgtcaggcatcggg

SEQ ID NO: 55868 - DNA, 20 bp, Neisseria gonorrhoeae
atcagggtttgtggcagatt

SEQ ID NO: 55869 - DNA, 20 bp, Neisseria gonorrhoeae
agttcccgatgcctgacatt

SEQ ID NO: 55870 - DNA, 20 bp, Neisseria gonorrhoeae
tcgccatcacgtccgcgccc

SEQ ID NO: 55871 - DNA, 20 bp, Neisseria gonorrhoeae
cgccatcacgtccgcgcccg

SEQ ID NO: 55872 - DNA, 20 bp, Neisseria gonorrhoeae
gccatcacgtccgcgcccga

SEQ ID NO: 55873 - DNA, 20 bp, Neisseria gonorrhoeae
ggtgtgccggcgcagcggcg

SEQ ID NO: 55874 - DNA, 20 bp, Neisseria gonorrhoeae
gtgtgccggcgcagcggcga

SEQ ID NO: 55875 - DNA, 20 bp, Neisseria gonorrhoeae
accgacttaatcaacgacta

SEQ ID NO: 55876 - DNA, 20 bp, Neisseria gonorrhoeae
atcaacgactacttcggcga

SEQ ID NO: 55877 - DNA, 20 bp, Neisseria gonorrhoeae
ggcgagggcgaataatgagt

SEQ ID NO: 55878 - DNA, 20 bp, Neisseria gonorrhoeae
gcccgccgccacgccgtgca

SEQ ID NO: 55879 - DNA, 20 bp, Neisseria gonorrhoeae
cccgccgccacgccgtgcag

SEQ ID NO: 55880 - DNA, 20 bp, Neisseria gonorrhoeae
ttccatgtgcgggcgaggtg

SEQ ID NO: 55881 - DNA, 20 bp, Neisseria gonorrhoeae
catgtgcgggcgaggtgctg

SEQ ID NO: 55882 - DNA, 20 bp, Neisseria gonorrhoeae
agaaaaatgccgtctgaaga

SEQ ID NO: 55883 - DNA, 20 bp, Neisseria gonorrhoeae
agacggcatttttctgaatg

SEQ ID NO: 55884 - DNA, 20 bp, Neisseria gonorrhoeae
ttctgaatgcggacggctgg

SEQ ID NO: 55885 - DNA, 20 bp, Neisseria gonorrhoeae
cgcgacaacgccctgagcaa

SEQ ID NO: 55886 - DNA, 20 bp, Neisseria gonorrhoeae
gaaacgcgccttgctcaggg

SEQ ID NO: 55887 - DNA, 20 bp, Neisseria gonorrhoeae
ctcagggcgttgtcgcgtaa

SEQ ID NO: 55888 - DNA, 20 bp, Neisseria gonorrhoeae
tcgcgtaattgcgcgtccgg

SEQ ID NO: 55889 - DNA, 20 bp, Neisseria gonorrhoeae
cgcgtccggccagcctttgg

SEQ ID NO: 55890 - DNA, 20 bp, Neisseria gonorrhoeae
gtgtcgatttttttggtgtc

SEQ ID NO: 55891 - DNA, 20 bp, Neisseria gonorrhoeae
ttttggtgtcgtcggcggtg

SEQ ID NO: 55892 - DNA, 20 bp, Neisseria gonorrhoeae
tttggtgtcgtcggcggtgc

SEQ ID NO: 55893 - DNA, 20 bp, Neisseria gonorrhoeae
ttggtgtcgtcggcggtgcc

SEQ ID NO: 55894 - DNA, 20 bp, Neisseria gonorrhoeae
tggtgtcgtcggcggtgccg

SEQ ID NO: 55895 - DNA, 20 bp, Neisseria gonorrhoeae
gcggcggtttgcggcaacac

SEQ ID NO: 55896 - DNA, 20 bp, Neisseria gonorrhoeae
gcggcaacacgggggcgagg

SEQ ID NO: 55897 - DNA, 20 bp, Neisseria gonorrhoeae
cggcaacacgggggcgaggt

SEQ ID NO: 55898 - DNA, 20 bp, Neisseria gonorrhoeae
atgagttcgctgcatacttc

SEQ ID NO: 55899 - DNA, 20 bp, Neisseria gonorrhoeae
accatgctgaccgcctacct

SEQ ID NO: 55900 - DNA, 20 bp, Neisseria gonorrhoeae
gattttgccgtcggtgttga

SEQ ID NO: 55901 - DNA, 20 bp, Neisseria gonorrhoeae
attttgccgtcggtgttgac

SEQ ID NO: 55902 - DNA, 20 bp, Neisseria gonorrhoeae
tgccgtcggtgttgacggca

SEQ ID NO: 55903 - DNA, 20 bp, Neisseria gonorrhoeae
gccgtcggtgttgacggcaa

SEQ ID NO: 55904 - DNA, 20 bp, Neisseria gonorrhoeae
ccgtcggtgttgacggcaat

SEQ ID NO: 55905 - DNA, 20 bp, Neisseria gonorrhoeae
tgcgcgcggtgatggggaat

SEQ ID NO: 55906 - DNA, 20 bp, Neisseria gonorrhoeae
tcgattgtgccgctgttttt

SEQ ID NO: 55907 - DNA, 20 bp, Neisseria gonorrhoeae
tgccgctgttttttcccgtc

SEQ ID NO: 55908 - DNA, 20 bp, Neisseria gonorrhoeae
cccgattccccatcaccgcg

SEQ ID NO: 55909 - DNA, 20 bp, Neisseria gonorrhoeae
ccgattccccatcaccgcgc

SEQ ID NO: 55910 - DNA, 20 bp, Neisseria gonorrhoeae
gcggtttttcaaattggcgc

SEQ ID NO: 55911 - DNA, 20 bp, Neisseria gonorrhoeae
ttcaaattggcgcagccgag

SEQ ID NO: 55912 - DNA, 20 bp, Neisseria gonorrhoeae
tcaaattggcgcagccgagg

SEQ ID NO: 55913 - DNA, 20 bp, Neisseria gonorrhoeae
caaattggcgcagccgaggc

SEQ ID NO: 55914 - DNA, 20 bp, Neisseria gonorrhoeae
aaattggcgcagccgaggcg

SEQ ID NO: 55915 - DNA, 20 bp, Neisseria gonorrhoeae
cttgccgtggcgcgcgaagg

SEQ ID NO: 55916 - DNA, 20 bp, Neisseria gonorrhoeae
ttgccgtggcgcgcgaaggt

SEQ ID NO: 55917 - DNA, 20 bp, Neisseria gonorrhoeae
ccgtggcgcgcgaaggtttg

SEQ ID NO: 55918 - DNA, 20 bp, Neisseria gonorrhoeae
ggagagcgtttttttcctgc

SEQ ID NO: 55919 - DNA, 20 bp, Neisseria gonorrhoeae
gagagcgtttttttcctgct

SEQ ID NO: 55920 - DNA, 20 bp, Neisseria gonorrhoeae
aaatggtgggcacagatgcg

SEQ ID NO: 55921 - DNA, 20 bp, Neisseria gonorrhoeae
aatggtgggcacagatgcgg

SEQ ID NO: 55922 - DNA, 20 bp, Neisseria gonorrhoeae
ggcgaccttcacgccgttct

SEQ ID NO: 55923 - DNA, 20 bp, Neisseria gonorrhoeae
gcgaccttcacgccgttctg

SEQ ID NO: 55924 - DNA, 20 bp, Neisseria gonorrhoeae
acgccgttctgccgcatctg

SEQ ID NO: 55925 - DNA, 20 bp, Neisseria gonorrhoeae
acaagccgagagaagaaacg

SEQ ID NO: 55926 - DNA, 20 bp, Neisseria gonorrhoeae
tcctgatgttccgtcttttg

SEQ ID NO: 55927 - DNA, 20 bp, Neisseria gonorrhoeae
cctgatgttccgtcttttgg

SEQ ID NO: 55928 - DNA, 20 bp, Neisseria gonorrhoeae
ctgatgttccgtcttttggg

SEQ ID NO: 55929 - DNA, 20 bp, Neisseria gonorrhoeae
cgtcttttgggtttttatgt

SEQ ID NO: 55930 - DNA, 20 bp, Neisseria gonorrhoeae
gggcggtccggaacggccgg

SEQ ID NO: 55931 - DNA, 20 bp, Neisseria gonorrhoeae
ggcggtccggaacggccggg

SEQ ID NO: 55932 - DNA, 20 bp, Neisseria gonorrhoeae
ttccgggctgtccgtccgta

SEQ ID NO: 55933 - DNA, 20 bp, Neisseria gonorrhoeae
cgggctgtccgtccgtatcg

SEQ ID NO: 55934 - DNA, 20 bp, Neisseria gonorrhoeae
gcatcgggattcaaatcggg

SEQ ID NO: 55935 - DNA, 20 bp, Neisseria gonorrhoeae
tctttcggccattcgccgtg

SEQ ID NO: 55936 - DNA, 20 bp, Neisseria gonorrhoeae
cggccattcgccgtgattcg

SEQ ID NO: 55937 - DNA, 20 bp, Neisseria gonorrhoeae
ggccattcgccgtgattcgg

SEQ ID NO: 55938 - DNA, 20 bp, Neisseria gonorrhoeae
gccgtgattcgggcaatacc

SEQ ID NO: 55939 - DNA, 20 bp, Neisseria gonorrhoeae
gggcaatacccggcaacgat

SEQ ID NO: 55940 - DNA, 20 bp, Neisseria gonorrhoeae
ggtagagttggcggatttgg

SEQ ID NO: 55941 - DNA, 20 bp, Neisseria gonorrhoeae
gcggatttggcaggcctcaa

SEQ ID NO: 55942 - DNA, 20 bp, Neisseria gonorrhoeae
ggcaggcctcaacccatcct

SEQ ID NO: 55943 - DNA, 20 bp, Neisseria gonorrhoeae
gcaggcctcaacccatcctg

SEQ ID NO: 55944 - DNA, 20 bp, Neisseria gonorrhoeae
gtaaaaggcgggcagggtgg

SEQ ID NO: 55945 - DNA, 20 bp, Neisseria gonorrhoeae
tgatccgctgttttgcttcg

SEQ ID NO: 55946 - DNA, 20 bp, Neisseria gonorrhoeae
gatccgctgttttgcttcgg

SEQ ID NO: 55947 - DNA, 20 bp, Neisseria gonorrhoeae
atccgctgttttgcttcggg

SEQ ID NO: 55948 - DNA, 20 bp, Neisseria gonorrhoeae
tgcttcgggcgtgtaggggg

SEQ ID NO: 55949 - DNA, 20 bp, Neisseria gonorrhoeae
gcttcgggcgtgtagggggc

SEQ ID NO: 55950 - DNA, 20 bp, Neisseria gonorrhoeae
caaaaagtcccgcagcagcg

SEQ ID NO: 55951 - DNA, 20 bp, Neisseria gonorrhoeae
ttcgggcgcgccttcgggga

SEQ ID NO: 55952 - DNA, 20 bp, Neisseria gonorrhoeae
tcgggcgcgccttcggggac

SEQ ID NO: 55953 - DNA, 20 bp, Neisseria gonorrhoeae
cgggcgcgccttcggggacg

SEQ ID NO: 55954 - DNA, 20 bp, Neisseria gonorrhoeae
gggcgcgccttcggggacgc

SEQ ID NO: 55955 - DNA, 20 bp, Neisseria gonorrhoeae
ggtgtttggcgcagatgacg

SEQ ID NO: 55956 - DNA, 20 bp, Neisseria gonorrhoeae
gtgtttggcgcagatgacgg

SEQ ID NO: 55957 - DNA, 20 bp, Neisseria gonorrhoeae
ggcgcagatgacggaggggc

SEQ ID NO: 55958 - DNA, 20 bp, Neisseria gonorrhoeae
gcgcagatgacggaggggcg

SEQ ID NO: 55959 - DNA, 20 bp, Neisseria gonorrhoeae
cgcgccgatgatgcggtatt

SEQ ID NO: 55960 - DNA, 20 bp, Neisseria gonorrhoeae
tttcgcgtcggcgctgtttg

SEQ ID NO: 55961 - DNA, 20 bp, Neisseria gonorrhoeae
ttcgcgtcggcgctgtttgt

SEQ ID NO: 55962 - DNA, 20 bp, Neisseria gonorrhoeae
tcgcgtcggcgctgtttgtc

SEQ ID NO: 55963 - DNA, 20 bp, Neisseria gonorrhoeae
cgcgtcggcgctgtttgtct

SEQ ID NO: 55964 - DNA, 20 bp, Neisseria gonorrhoeae
gcgtcggcgctgtttgtctt

SEQ ID NO: 55965 - DNA, 20 bp, Neisseria gonorrhoeae
ttccaagcaccccggcgcgg

SEQ ID NO: 55966 - DNA, 20 bp, Neisseria gonorrhoeae
tccaagcaccccggcgcggt

SEQ ID NO: 55967 - DNA, 20 bp, Neisseria gonorrhoeae
ccaagcaccccggcgcggta

SEQ ID NO: 55968 - DNA, 20 bp, Neisseria gonorrhoeae
caagcaccccggcgcggtaa

SEQ ID NO: 55969 - DNA, 20 bp, Neisseria gonorrhoeae
ttgaacctgccgatgtcctg

SEQ ID NO: 55970 - DNA, 20 bp, Neisseria gonorrhoeae
gcaggcggcgtactgatgga

SEQ ID NO: 55971 - DNA, 20 bp, Neisseria gonorrhoeae
caggcggcgtactgatggag

SEQ ID NO: 55972 - DNA, 20 bp, Neisseria gonorrhoeae
ggaagccaaagacggcttca

SEQ ID NO: 55973 - DNA, 20 bp, Neisseria gonorrhoeae
gaagccaaagacggcttcat

SEQ ID NO: 55974 - DNA, 20 bp, Neisseria gonorrhoeae
atgcgtgcgaatatggcgat

SEQ ID NO: 55975 - DNA, 20 bp, Neisseria gonorrhoeae
gggcatatcggtgcagaagc

SEQ ID NO: 55976 - DNA, 20 bp, Neisseria gonorrhoeae
ttcatcgggcggggaagcgg

SEQ ID NO: 55977 - DNA, 20 bp, Neisseria gonorrhoeae
tcatcgggcggggaagcggt

SEQ ID NO: 55978 - DNA, 20 bp, Neisseria gonorrhoeae
catcgggcggggaagcggtg

SEQ ID NO: 55979 - DNA, 20 bp, Neisseria gonorrhoeae
atcgggcggggaagcggtga

SEQ ID NO: 55980 - DNA, 20 bp, Neisseria gonorrhoeae
ggcggtggcgtagttgctgc

SEQ ID NO: 55981 - DNA, 20 bp, Neisseria gonorrhoeae
gcggtggcgtagttgctgcg

SEQ ID NO: 55982 - DNA, 20 bp, Neisseria gonorrhoeae
ctgcggttgcggcgtatggc

SEQ ID NO: 55983 - DNA, 20 bp, Neisseria gonorrhoeae
cggcgtatggcgaggcggtc

SEQ ID NO: 55984 - DNA, 20 bp, Neisseria gonorrhoeae
tccgacggtgagcgaaattt

SEQ ID NO: 55985 - DNA, 20 bp, Neisseria gonorrhoeae
tgccgcctactgcgctgccg

SEQ ID NO: 55986 - DNA, 20 bp, Neisseria gonorrhoeae
gccgcctactgcgctgccga

SEQ ID NO: 55987 - DNA, 20 bp, Neisseria gonorrhoeae
ccgcctactgcgctgccgat

SEQ ID NO: 55988 - DNA, 20 bp, Neisseria gonorrhoeae
cgctcaccgtcggacaactc

SEQ ID NO: 55989 - DNA, 20 bp, Neisseria gonorrhoeae
cgttttggcgggcaagccgg

SEQ ID NO: 55990 - DNA, 20 bp, Neisseria gonorrhoeae
tggcgggcaagccggcctgc

SEQ ID NO: 55991 - DNA, 20 bp, Neisseria gonorrhoeae
ggcgggcaagccggcctgcc

SEQ ID NO: 55992 - DNA, 20 bp, Neisseria gonorrhoeae
gcgggcaagccggcctgcct

SEQ ID NO: 55993 - DNA, 20 bp, Neisseria gonorrhoeae
cctgcctgaaaggttcggat

SEQ ID NO: 55994 - DNA, 20 bp, Neisseria gonorrhoeae
cgatgcgtggtggacggaag

SEQ ID NO: 55995 - DNA, 20 bp, Neisseria gonorrhoeae
cgaaatcgatgcgctgaagg

SEQ ID NO: 55996 - DNA, 20 bp, Neisseria gonorrhoeae
agcgcatcgatttcggaaca

SEQ ID NO: 55997 - DNA, 20 bp, Neisseria gonorrhoeae
cggaacacagcagcgcggca

SEQ ID NO: 55998 - DNA, 20 bp, Neisseria gonorrhoeae
ggaacacagcagcgcggcat

SEQ ID NO: 55999 - DNA, 20 bp, Neisseria gonorrhoeae
gccttcggctccgcgcagaa

SEQ ID NO: 56000 - DNA, 20 bp, Neisseria gonorrhoeae
ccttcggctccgcgcagaat

SEQ ID NO: 56001 - DNA, 20 bp, Neisseria gonorrhoeae
ggctccgcgcagaatgtcgc

SEQ ID NO: 56002 - DNA, 20 bp, Neisseria gonorrhoeae
gagggcggaacaggttacga

SEQ ID NO: 56003 - DNA, 20 bp, Neisseria gonorrhoeae
agggcggaacaggttacgat

SEQ ID NO: 56004 - DNA, 20 bp, Neisseria gonorrhoeae
tcgcggttggcttgggtgtg

SEQ ID NO: 56005 - DNA, 20 bp, Neisseria gonorrhoeae
gcttgggtgtggaactcgtc

SEQ ID NO: 56006 - DNA, 20 bp, Neisseria gonorrhoeae
ggtgtggaactcgtcgcctt

SEQ ID NO: 56007 - DNA, 20 bp, Neisseria gonorrhoeae
ggcatagggacattgaccga

SEQ ID NO: 56008 - DNA, 20 bp, Neisseria gonorrhoeae
accgaggtgtttctgcaggg

SEQ ID NO: 56009 - DNA, 20 bp, Neisseria gonorrhoeae
ccgatgccggaagcgcgcaa

SEQ ID NO: 56010 - DNA, 20 bp, Neisseria gonorrhoeae
cgtgattctgattaccggcg

SEQ ID NO: 56011 - DNA, 20 bp, Neisseria gonorrhoeae
tgattaccggcgcgggcggt

SEQ ID NO: 56012 - DNA, 20 bp, Neisseria gonorrhoeae
ccggcgcgggcggtatgttc

SEQ ID NO: 56013 - DNA, 20 bp, Neisseria gonorrhoeae
ggcggcgttttgcgcgcttc

SEQ ID NO: 56014 - DNA, 20 bp, Neisseria gonorrhoeae
gggaacgggaacatggatgg

SEQ ID NO: 56015 - DNA, 20 bp, Neisseria gonorrhoeae
gccgagcatatagccgctga

SEQ ID NO: 56016 - DNA, 20 bp, Neisseria gonorrhoeae
ccgagcatatagccgctgaa

SEQ ID NO: 56017 - DNA, 20 bp, Neisseria gonorrhoeae
atcacatggtatttcagcgg

SEQ ID NO: 56018 - DNA, 20 bp, Neisseria gonorrhoeae
cagcggctatatgctcggca

SEQ ID NO: 56019 - DNA, 20 bp, Neisseria gonorrhoeae
catgcgccgtgcggtggcga

SEQ ID NO: 56020 - DNA, 20 bp, Neisseria gonorrhoeae
atgcgccgtgcggtggcgaa

SEQ ID NO: 56021 - DNA, 20 bp, Neisseria gonorrhoeae
gccaccgcacggcgcatgaa

SEQ ID NO: 56022 - DNA, 20 bp, Neisseria gonorrhoeae
gcgcttgcctccgtcggcgc

SEQ ID NO: 56023 - DNA, 20 bp, Neisseria gonorrhoeae
cctccgtcggcgcattttcc

SEQ ID NO: 56024 - DNA, 20 bp, Neisseria gonorrhoeae
cggcagggcggcggcaggtt

SEQ ID NO: 56025 - DNA, 20 bp, Neisseria gonorrhoeae
gggcgcaaacggctttcaga

SEQ ID NO: 56026 - DNA, 20 bp, Neisseria gonorrhoeae
ggcgcaaacggctttcagac

SEQ ID NO: 56027 - DNA, 20 bp, Neisseria gonorrhoeae
cagacggcatgccgtatcac

SEQ ID NO: 56028 - DNA, 20 bp, Neisseria gonorrhoeae
agacggcatgccgtatcacg

SEQ ID NO: 56029 - DNA, 20 bp, Neisseria gonorrhoeae
ggttgatgaggccgtcgccg

SEQ ID NO: 56030 - DNA, 20 bp, Neisseria gonorrhoeae
atgaggccgtcgccgaatac

SEQ ID NO: 56031 - DNA, 20 bp, Neisseria gonorrhoeae
ggacgcgacgccgcctacgc

SEQ ID NO: 56032 - DNA, 20 bp, Neisseria gonorrhoeae
ttcgggtttgatttctttga

SEQ ID NO: 56033 - DNA, 20 bp, Neisseria gonorrhoeae
tcgggtttgatttctttgag

SEQ ID NO: 56034 - DNA, 20 bp, Neisseria gonorrhoeae
catcaactgttccataagca

SEQ ID NO: 56035 - DNA, 20 bp, Neisseria gonorrhoeae
cataagcaccttatcacttg

SEQ ID NO: 56036 - DNA, 20 bp, Neisseria gonorrhoeae
tcacttgtagccggaacacc

SEQ ID NO: 56037 - DNA, 20 bp, Neisseria gonorrhoeae
tagccggaacaccttggctc

SEQ ID NO: 56038 - DNA, 20 bp, Neisseria gonorrhoeae
gctcgttccaaatttccaag

SEQ ID NO: 56039 - DNA, 20 bp, Neisseria gonorrhoeae
acgctcaccgtctcgcccag

SEQ ID NO: 56040 - DNA, 20 bp, Neisseria gonorrhoeae
ggattacgggcggtttggcg

SEQ ID NO: 56041 - DNA, 20 bp, Neisseria gonorrhoeae
gattacgggcggtttggcgg

SEQ ID NO: 56042 - DNA, 20 bp, Neisseria gonorrhoeae
cgggcggtttggcggtgttt

SEQ ID NO: 56043 - DNA, 20 bp, Neisseria gonorrhoeae
ggcggtgtttgcctacctga

SEQ ID NO: 56044 - DNA, 20 bp, Neisseria gonorrhoeae
tttggcttgtggggcagggt

SEQ ID NO: 56045 - DNA, 20 bp, Neisseria gonorrhoeae
ggcttgtggggcagggtcgg

SEQ ID NO: 56046 - DNA, 20 bp, Neisseria gonorrhoeae
gcttgtggggcagggtcgga

SEQ ID NO: 56047 - DNA, 20 bp, Neisseria gonorrhoeae
tggggcagggtcggaatttt

SEQ ID NO: 56048 - DNA, 20 bp, Neisseria gonorrhoeae
tgcggcgaacacgcgcccaa

SEQ ID NO: 56049 - DNA, 20 bp, Neisseria gonorrhoeae
gccgtgggtttgcagcgcgt

SEQ ID NO: 56050 - DNA, 20 bp, Neisseria gonorrhoeae
ccgtgggtttgcagcgcgtc

SEQ ID NO: 56051 - DNA, 20 bp, Neisseria gonorrhoeae
gcagcgcgtcatacaggcgc

SEQ ID NO: 56052 - DNA, 20 bp, Neisseria gonorrhoeae
cagcgcgtcatacaggcgcg

SEQ ID NO: 56053 - DNA, 20 bp, Neisseria gonorrhoeae
cgcgctgcaacacgccgcgt

SEQ ID NO: 56054 - DNA, 20 bp, Neisseria gonorrhoeae
cagcgcggaacgggttactt

SEQ ID NO: 56055 - DNA, 20 bp, Neisseria gonorrhoeae
ctttggcagggtcgagtacg

SEQ ID NO: 56056 - DNA, 20 bp, Neisseria gonorrhoeae
ggcagggtcgagtacgccca

SEQ ID NO: 56057 - DNA, 20 bp, Neisseria gonorrhoeae
gcagggtcgagtacgcccat

SEQ ID NO: 56058 - DNA, 20 bp, Neisseria gonorrhoeae
tgacggcgggcatcccgctg

SEQ ID NO: 56059 - DNA, 20 bp, Neisseria gonorrhoeae
tgccatcggccaccgttacc

SEQ ID NO: 56060 - DNA, 20 bp, Neisseria gonorrhoeae
ccggggttctgcgcccttgg

SEQ ID NO: 56061 - DNA, 20 bp, Neisseria gonorrhoeae
tgcgcccttggctttccgcc

SEQ ID NO: 56062 - DNA, 20 bp, Neisseria gonorrhoeae
gctttccgccgcctcggacg

SEQ ID NO: 56063 - DNA, 20 bp, Neisseria gonorrhoeae
ccgccatcatcatcggcggc

SEQ ID NO: 56064 - DNA, 20 bp, Neisseria gonorrhoeae
ccggaattacgcaggcacct

SEQ ID NO: 56065 - DNA, 20 bp, Neisseria gonorrhoeae
cgcaggcacctgaacgcctt

SEQ ID NO: 56066 - DNA, 20 bp, Neisseria gonorrhoeae
tcctccatccgcgtcggcgg

SEQ ID NO: 56067 - DNA, 20 bp, Neisseria gonorrhoeae
aggtgcctgcgtaattccgg

SEQ ID NO: 56068 - DNA, 20 bp, Neisseria gonorrhoeae
gcgggttggatgggcgcgct

SEQ ID NO: 56069 - DNA, 20 bp, Neisseria gonorrhoeae
gatgggcgcgcttttcggca

SEQ ID NO: 56070 - DNA, 20 bp, Neisseria gonorrhoeae
tcggcagggtgcgaagcggc

SEQ ID NO: 56071 - DNA, 20 bp, Neisseria gonorrhoeae
cggcagggtgcgaagcggcg

SEQ ID NO: 56072 - DNA, 20 bp, Neisseria gonorrhoeae
ggcagggtgcgaagcggcgg

SEQ ID NO: 56073 - DNA, 20 bp, Neisseria gonorrhoeae
tggcgcacctctccggtgac

SEQ ID NO: 56074 - DNA, 20 bp, Neisseria gonorrhoeae
ccgcatttcaaagcggcgaa

SEQ ID NO: 56075 - DNA, 20 bp, Neisseria gonorrhoeae
caaagcggcgaagacgtaca

SEQ ID NO: 56076 - DNA, 20 bp, Neisseria gonorrhoeae
aaagcggcgaagacgtacac

SEQ ID NO: 56077 - DNA, 20 bp, Neisseria gonorrhoeae
ggcggcggtgcggcggtgta

SEQ ID NO: 56078 - DNA, 20 bp, Neisseria gonorrhoeae
cccgaaaacggcaccgtggg

SEQ ID NO: 56079 - DNA, 20 bp, Neisseria gonorrhoeae
cccacggtgccgttttcggg

SEQ ID NO: 56080 - DNA, 20 bp, Neisseria gonorrhoeae
tcgggcaatacggcatcggc

SEQ ID NO: 56081 - DNA, 20 bp, Neisseria gonorrhoeae
cgggcaatacggcatcggca

SEQ ID NO: 56082 - DNA, 20 bp, Neisseria gonorrhoeae
gggcaatacggcatcggcag

SEQ ID NO: 56083 - DNA, 20 bp, Neisseria gonorrhoeae
ttctgcataccgatttggcg

SEQ ID NO: 56084 - DNA, 20 bp, Neisseria gonorrhoeae
tctgcataccgatttggcgc

SEQ ID NO: 56085 - DNA, 20 bp, Neisseria gonorrhoeae
ctgcataccgatttggcgca

SEQ ID NO: 56086 - DNA, 20 bp, Neisseria gonorrhoeae
tgcataccgatttggcgcag

SEQ ID NO: 56087 - DNA, 20 bp, Neisseria gonorrhoeae
ggcgcaggtcggtttgttgg

SEQ ID NO: 56088 - DNA, 20 bp, Neisseria gonorrhoeae
cgaacccaaatggggaatct

SEQ ID NO: 56089 - DNA, 20 bp, Neisseria gonorrhoeae
cccatttgggttcggaacgc

SEQ ID NO: 56090 - DNA, 20 bp, Neisseria gonorrhoeae
gggttcggaacgcgcgcacg

SEQ ID NO: 56091 - DNA, 20 bp, Neisseria gonorrhoeae
ggttcggaacgcgcgcacgc

SEQ ID NO: 56092 - DNA, 20 bp, Neisseria gonorrhoeae
ggaacgcgcgcacgcgggct

SEQ ID NO: 56093 - DNA, 20 bp, Neisseria gonorrhoeae
ccagccgcattcgcgatatt

SEQ ID NO: 56094 - DNA, 20 bp, Neisseria gonorrhoeae
cagccgcattcgcgatattc

SEQ ID NO: 56095 - DNA, 20 bp, Neisseria gonorrhoeae
gcgatattcggcggcggggt

SEQ ID NO: 56096 - DNA, 20 bp, Neisseria gonorrhoeae
ggcggcggggtcgctgtcga

SEQ ID NO: 56097 - DNA, 20 bp, Neisseria gonorrhoeae
cggcatcgtcatcgacagcg

SEQ ID NO: 56098 - DNA, 20 bp, Neisseria gonorrhoeae
gagcgacagggtgcggatga

SEQ ID NO: 56099 - DNA, 20 bp, Neisseria gonorrhoeae
agcgacagggtgcggatgac

SEQ ID NO: 56100 - DNA, 20 bp, Neisseria gonorrhoeae
aacgcgccttcaaaccccaa

SEQ ID NO: 56101 - DNA, 20 bp, Neisseria gonorrhoeae
aaaccccaagccgccggaac

SEQ ID NO: 56102 - DNA, 20 bp, Neisseria gonorrhoeae
gaacccgtgttccggcggct

SEQ ID NO: 56103 - DNA, 20 bp, Neisseria gonorrhoeae
tcggcgcggtttttcgggtc

SEQ ID NO: 56104 - DNA, 20 bp, Neisseria gonorrhoeae
cggcgcggtttttcgggtct

SEQ ID NO: 56105 - DNA, 20 bp, Neisseria gonorrhoeae
ggcgcggtttttcgggtctg

SEQ ID NO: 56106 - DNA, 20 bp, Neisseria gonorrhoeae
ttcgggtctgcttgcaactc

SEQ ID NO: 56107 - DNA, 20 bp, Neisseria gonorrhoeae
tcgggtctgcttgcaactcg

SEQ ID NO: 56108 - DNA, 20 bp, Neisseria gonorrhoeae
cggatacggaggattgcggc

SEQ ID NO: 56109 - DNA, 20 bp, Neisseria gonorrhoeae
ggatacggaggattgcggcg

SEQ ID NO: 56110 - DNA, 20 bp, Neisseria gonorrhoeae
cggcgtggaaatgccggcgg

SEQ ID NO: 56111 - DNA, 20 bp, Neisseria gonorrhoeae
cccgacattcagacggcctc

SEQ ID NO: 56112 - DNA, 20 bp, Neisseria gonorrhoeae
agacggcctccccgccggca

SEQ ID NO: 56113 - DNA, 20 bp, Neisseria gonorrhoeae
gcaccttgtttgacggcccg

SEQ ID NO: 56114 - DNA, 20 bp, Neisseria gonorrhoeae
tttgacggcccgttccactt

SEQ ID NO: 56115 - DNA, 20 bp, Neisseria gonorrhoeae
gacggcccgttccacttttt

SEQ ID NO: 56116 - DNA, 20 bp, Neisseria gonorrhoeae
acggcccgttccactttttc

SEQ ID NO: 56117 - DNA, 20 bp, Neisseria gonorrhoeae
cactttttcggcaacggctt

SEQ ID NO: 56118 - DNA, 20 bp, Neisseria gonorrhoeae
cagttttcatgccgcctgaa

SEQ ID NO: 56119 - DNA, 20 bp, Neisseria gonorrhoeae
tcatgccgcctgaaaacccc

SEQ ID NO: 56120 - DNA, 20 bp, Neisseria gonorrhoeae
catgccgcctgaaaaccccc

SEQ ID NO: 56121 - DNA, 20 bp, Neisseria gonorrhoeae
atgccgcctgaaaacccccg

SEQ ID NO: 56122 - DNA, 20 bp, Neisseria gonorrhoeae
tgctgacccagacgattaca

SEQ ID NO: 56123 - DNA, 20 bp, Neisseria gonorrhoeae
atggcgtttgcctggctgtg

SEQ ID NO: 56124 - DNA, 20 bp, Neisseria gonorrhoeae
gcctggctgtggcccggcgt

SEQ ID NO: 56125 - DNA, 20 bp, Neisseria gonorrhoeae
cctggctgtggcccggcgtg

SEQ ID NO: 56126 - DNA, 20 bp, Neisseria gonorrhoeae
tcccacgatttgtggaatcc

SEQ ID NO: 56127 - DNA, 20 bp, Neisseria gonorrhoeae
cccacgatttgtggaatcct

SEQ ID NO: 56128 - DNA, 20 bp, Neisseria gonorrhoeae
ccaactgggcggcaggcgtt

SEQ ID NO: 56129 - DNA, 20 bp, Neisseria gonorrhoeae
ccctgacctgggctttgctg

SEQ ID NO: 56130 - DNA, 20 bp, Neisseria gonorrhoeae
gctgatgacgctgttcctgc

SEQ ID NO: 56131 - DNA, 20 bp, Neisseria gonorrhoeae
ctgatgacgctgttcctgcc

SEQ ID NO: 56132 - DNA, 20 bp, Neisseria gonorrhoeae
ctgccgtggctggacgcggc

SEQ ID NO: 56133 - DNA, 20 bp, Neisseria gonorrhoeae
cgcgctgttgaccgccatat

SEQ ID NO: 56134 - DNA, 20 bp, Neisseria gonorrhoeae
accgccatatcgtaaaaacc

SEQ ID NO: 56135 - DNA, 20 bp, Neisseria gonorrhoeae
gcgcggcggccagcagcttg

SEQ ID NO: 56136 - DNA, 20 bp, Neisseria gonorrhoeae
cgcggcggccagcagcttgt

SEQ ID NO: 56137 - DNA, 20 bp, Neisseria gonorrhoeae
tcttcgtcaaagccgcgtgt

SEQ ID NO: 56138 - DNA, 20 bp, Neisseria gonorrhoeae
tgtaccgccgtcaaacgggc

SEQ ID NO: 56139 - DNA, 20 bp, Neisseria gonorrhoeae
cgcgcgtctgtggtttggcg

SEQ ID NO: 56140 - DNA, 20 bp, Neisseria gonorrhoeae
ggcggccggccagcagtccg

SEQ ID NO: 56141 - DNA, 20 bp, Neisseria gonorrhoeae
gcggccggccagcagtccgc

SEQ ID NO: 56142 - DNA, 20 bp, Neisseria gonorrhoeae
ccgccgcattgggcagcccg

SEQ ID NO: 56143 - DNA, 20 bp, Neisseria gonorrhoeae
ggcgacctcgccatccgcta

SEQ ID NO: 56144 - DNA, 20 bp, Neisseria gonorrhoeae
atcgtcgccctcctcgtgct

SEQ ID NO: 56145 - DNA, 20 bp, Neisseria gonorrhoeae
ggtttggtagcggtagtagc

SEQ ID NO: 56146 - DNA, 20 bp, Neisseria gonorrhoeae
ggtagcggtagtagccgtag

SEQ ID NO: 56147 - DNA, 20 bp, Neisseria gonorrhoeae
gtagcggtagtagccgtagc

SEQ ID NO: 56148 - DNA, 20 bp, Neisseria gonorrhoeae
atattgtccaaatgggcaag

SEQ ID NO: 56149 - DNA, 20 bp, Neisseria gonorrhoeae
tccaaatgggcaaggttcag

SEQ ID NO: 56150 - DNA, 20 bp, Neisseria gonorrhoeae
agcggcgtttcgcgcaccat

SEQ ID NO: 56151 - DNA, 20 bp, Neisseria gonorrhoeae
cgcgcaccatcagcaccagc

SEQ ID NO: 56152 - DNA, 20 bp, Neisseria gonorrhoeae
gcgcaccatcagcaccagcc

SEQ ID NO: 56153 - DNA, 20 bp, Neisseria gonorrhoeae
agacggcattggaagggcag

SEQ ID NO: 56154 - DNA, 20 bp, Neisseria gonorrhoeae
gaagggcaggcacgccgtct

SEQ ID NO: 56155 - DNA, 20 bp, Neisseria gonorrhoeae
ccgccgatgaagccctgttg

SEQ ID NO: 56156 - DNA, 20 bp, Neisseria gonorrhoeae
gtccaacagggcttcatcgg

SEQ ID NO: 56157 - DNA, 20 bp, Neisseria gonorrhoeae
atcggcggcaacggtcgcgt

SEQ ID NO: 56158 - DNA, 20 bp, Neisseria gonorrhoeae
ccgacaaactggaaaccctg

SEQ ID NO: 56159 - DNA, 20 bp, Neisseria gonorrhoeae
ggggcatcggtttgattcct

SEQ ID NO: 56160 - DNA, 20 bp, Neisseria gonorrhoeae
gggcatcggtttgattccta

SEQ ID NO: 56161 - DNA, 20 bp, Neisseria gonorrhoeae
gattcctaccggcgacaaag

SEQ ID NO: 56162 - DNA, 20 bp, Neisseria gonorrhoeae
attcctaccggcgacaaaga

SEQ ID NO: 56163 - DNA, 20 bp, Neisseria gonorrhoeae
ggcgcggttaacgaaagcct

SEQ ID NO: 56164 - DNA, 20 bp, Neisseria gonorrhoeae
cgttaaccgcgcccaactcg

SEQ ID NO: 56165 - DNA, 20 bp, Neisseria gonorrhoeae
gttaaccgcgcccaactcgg

SEQ ID NO: 56166 - DNA, 20 bp, Neisseria gonorrhoeae
accgcgcccaactcggcatc

SEQ ID NO: 56167 - DNA, 20 bp, Neisseria gonorrhoeae
tttcagcaggttttgcacgc

SEQ ID NO: 56168 - DNA, 20 bp, Neisseria gonorrhoeae
cgtcccgccataccgacccg

SEQ ID NO: 56169 - DNA, 20 bp, Neisseria gonorrhoeae
acctcgaccgtaccaatacg

SEQ ID NO: 56170 - DNA, 20 bp, Neisseria gonorrhoeae
cctcgaccgtaccaatacgg

SEQ ID NO: 56171 - DNA, 20 bp, Neisseria gonorrhoeae
ttgcggctcggcaaagccgt

SEQ ID NO: 56172 - DNA, 20 bp, Neisseria gonorrhoeae
cggctcggcaaagccgtggc

SEQ ID NO: 56173 - DNA, 20 bp, Neisseria gonorrhoeae
gatgttgagcgaggcggaca

SEQ ID NO: 56174 - DNA, 20 bp, Neisseria gonorrhoeae
agcgaggcggacattgccgc

SEQ ID NO: 56175 - DNA, 20 bp, Neisseria gonorrhoeae
ccgcgcagacggcatttgcc

SEQ ID NO: 56176 - DNA, 20 bp, Neisseria gonorrhoeae
gccgccgcgttgccgcttct

SEQ ID NO: 56177 - DNA, 20 bp, Neisseria gonorrhoeae
ccgccgcgttgccgcttctg

SEQ ID NO: 56178 - DNA, 20 bp, Neisseria gonorrhoeae
ggcggtgggcggcaggattt

SEQ ID NO: 56179 - DNA, 20 bp, Neisseria gonorrhoeae
gcggtacggcgcgtatgtgc

SEQ ID NO: 56180 - DNA, 20 bp, Neisseria gonorrhoeae
tcgactacatcatcgctact

SEQ ID NO: 56181 - DNA, 20 bp, Neisseria gonorrhoeae
gggcggtaaatgtttggcgg

SEQ ID NO: 56182 - DNA, 20 bp, Neisseria gonorrhoeae
ggcggtaaatgtttggcggg

SEQ ID NO: 56183 - DNA, 20 bp, Neisseria gonorrhoeae
ggcgggtttcttcgggcagg

SEQ ID NO: 56184 - DNA, 20 bp, Neisseria gonorrhoeae
gcgggtttcttcgggcaggg

SEQ ID NO: 56185 - DNA, 20 bp, Neisseria gonorrhoeae
cttcgggcagggcgcgggtc

SEQ ID NO: 56186 - DNA, 20 bp, Neisseria gonorrhoeae
gtccaataataatatcggcg

SEQ ID NO: 56187 - DNA, 20 bp, Neisseria gonorrhoeae
caaaatggcgcgggcaatgg

SEQ ID NO: 56188 - DNA, 20 bp, Neisseria gonorrhoeae
aaaatggcgcgggcaatggc

SEQ ID NO: 56189 - DNA, 20 bp, Neisseria gonorrhoeae
ccgctgtccgccggataagt

SEQ ID NO: 56190 - DNA, 20 bp, Neisseria gonorrhoeae
tccggcggacagcggcaacg

SEQ ID NO: 56191 - DNA, 20 bp, Neisseria gonorrhoeae
gtcctgttcgggcggggtgt

SEQ ID NO: 56192 - DNA, 20 bp, Neisseria gonorrhoeae
tcctgttcgggcggggtgtc

SEQ ID NO: 56193 - DNA, 20 bp, Neisseria gonorrhoeae
gggcggggtgtcgagaaatg

SEQ ID NO: 56194 - DNA, 20 bp, Neisseria gonorrhoeae
ccaacatcagcatccctatg

SEQ ID NO: 56195 - DNA, 20 bp, Neisseria gonorrhoeae
ctcgccgccgacggcgtatg

SEQ ID NO: 56196 - DNA, 20 bp, Neisseria gonorrhoeae
atcaggggggcgatgaaggc

SEQ ID NO: 56197 - DNA, 20 bp, Neisseria gonorrhoeae
ggcgttgccgccaccgaaag

SEQ ID NO: 56198 - DNA, 20 bp, Neisseria gonorrhoeae
ccgccaccgaaagctatctt

SEQ ID NO: 56199 - DNA, 20 bp, Neisseria gonorrhoeae
ccgccttcatcgcccccctg

SEQ ID NO: 56200 - DNA, 20 bp, Neisseria gonorrhoeae
atcgcccccctgatcaacca

SEQ ID NO: 56201 - DNA, 20 bp, Neisseria gonorrhoeae
ggctccggcttctttggcgg

SEQ ID NO: 56202 - DNA, 20 bp, Neisseria gonorrhoeae
gctccggcttctttggcggc

SEQ ID NO: 56203 - DNA, 20 bp, Neisseria gonorrhoeae
tttggcggcagccatggtgc

SEQ ID NO: 56204 - DNA, 20 bp, Neisseria gonorrhoeae
ggcggcagccatggtgcgtc

SEQ ID NO: 56205 - DNA, 20 bp, Neisseria gonorrhoeae
gcggcagccatggtgcgtcc

SEQ ID NO: 56206 - DNA, 20 bp, Neisseria gonorrhoeae
tgatcatacctgtttcccgc

SEQ ID NO: 56207 - DNA, 20 bp, Neisseria gonorrhoeae
cccgcatccggttgcggggt

SEQ ID NO: 56208 - DNA, 20 bp, Neisseria gonorrhoeae
ccgcatccggttgcggggtt

SEQ ID NO: 56209 - DNA, 20 bp, Neisseria gonorrhoeae
cggggttgccgaacatgagt

SEQ ID NO: 56210 - DNA, 20 bp, Neisseria gonorrhoeae
ccgaacatgagttgtgccag

SEQ ID NO: 56211 - DNA, 20 bp, Human papillomavirus type 129
tttgacttaaaactaccatg

SEQ ID NO: 56212 - DNA, 20 bp, Human papillomavirus type 129
ttgacttaaaactaccatgt

SEQ ID NO: 56213 - DNA, 20 bp, Human papillomavirus type 129
tgacttaaaactaccatgta

SEQ ID NO: 56214 - DNA, 20 bp, Human papillomavirus type 129
gacttaaaactaccatgtat

SEQ ID NO: 56215 - DNA, 20 bp, Human papillomavirus type 129
acttaaaactaccatgtata

SEQ ID NO: 56216 - DNA, 20 bp, Human papillomavirus type 129
tctacggatgaggaaccaga

SEQ ID NO: 56217 - DNA, 20 bp, Human papillomavirus type 129
ccaagttgacagttggtgtc

SEQ ID NO: 56218 - DNA, 20 bp, Human papillomavirus type 129
acagttggtgtcctaattgt

SEQ ID NO: 56219 - DNA, 20 bp, Human papillomavirus type 129
gtgtcctaattgtaacaaag

SEQ ID NO: 56220 - DNA, 20 bp, Human papillomavirus type 129
taacaaaggtgtaagagttt

SEQ ID NO: 56221 - DNA, 20 bp, Human papillomavirus type 129
cagatattagtccgagactg

SEQ ID NO: 56222 - DNA, 20 bp, Human papillomavirus type 129
gtccgagactggaagcgatt

SEQ ID NO: 56223 - DNA, 20 bp, Human papillomavirus type 129
gtatatctccagaaaaagaa

SEQ ID NO: 56224 - DNA, 20 bp, Human papillomavirus type 129
tatatctccagaaaaagaaa

SEQ ID NO: 56225 - DNA, 20 bp, Human papillomavirus type 129
ttgtttgaggacagtggaat

SEQ ID NO: 56226 - DNA, 20 bp, Human papillomavirus type 129
atatttttataaaaaggagc

SEQ ID NO: 56227 - DNA, 20 bp, Human papillomavirus type 129
tatttttataaaaaggagca

SEQ ID NO: 56228 - DNA, 20 bp, Human papillomavirus type 129
ttataaaaaggagcatacgg

SEQ ID NO: 56229 - DNA, 20 bp, Human papillomavirus type 129
tataaaaaggagcatacgga

SEQ ID NO: 56230 - DNA, 20 bp, Human papillomavirus type 129
ataaaaaggagcatacggaa

SEQ ID NO: 56231 - DNA, 20 bp, Human papillomavirus type 129
caatacaaatgggcatcgtt

SEQ ID NO: 56232 - DNA, 20 bp, Human papillomavirus type 129
taaaatcccttgcgaaatct

SEQ ID NO: 56233 - DNA, 20 bp, Human papillomavirus type 129
aaaatcccttgcgaaatcta

SEQ ID NO: 56234 - DNA, 20 bp, Human papillomavirus type 129
aaatcccttgcgaaatctaa

SEQ ID NO: 56235 - DNA, 20 bp, Human papillomavirus type 129
cgaaatctaaatatgcagca

SEQ ID NO: 56236 - DNA, 20 bp, Human papillomavirus type 129
tattatgtggacaaagatgg

SEQ ID NO: 56237 - DNA, 20 bp, Human papillomavirus type 129
tgtggacaaagatggaaaca

SEQ ID NO: 56238 - DNA, 20 bp, Human papillomavirus type 129
ttttctattgttttttgaag

SEQ ID NO: 56239 - DNA, 20 bp, Human papillomavirus type 129
tctattgttttttgaagatg

SEQ ID NO: 56240 - DNA, 20 bp, Human papillomavirus type 129
ctattgttttttgaagatgc

SEQ ID NO: 56241 - DNA, 20 bp, Human papillomavirus type 129
ctcagaggcccagctaacaa

SEQ ID NO: 56242 - DNA, 20 bp, Human papillomavirus type 129
aagtgctggaggtatagatg

SEQ ID NO: 56243 - DNA, 20 bp, Human papillomavirus type 129
ggtcccctggctttagtaca

SEQ ID NO: 56244 - DNA, 20 bp, Human papillomavirus type 129
agtacagtctttaaatgggt

SEQ ID NO: 56245 - DNA, 20 bp, Human papillomavirus type 129
aaagactgtactaaagccag

SEQ ID NO: 56246 - DNA, 20 bp, Human papillomavirus type 129
ccagtggagcctggtgcttc

SEQ ID NO: 56247 - DNA, 20 bp, Human papillomavirus type 129
atctattgttcctttagctg

SEQ ID NO: 56248 - DNA, 20 bp, Human papillomavirus type 129
ttcctttagctgaaggttta

SEQ ID NO: 56249 - DNA, 20 bp, Human papillomavirus type 129
ctttagctgaaggtttacct

SEQ ID NO: 56250 - DNA, 20 bp, Human papillomavirus type 129
agctgaaggtttacctgata

SEQ ID NO: 56251 - DNA, 20 bp, Human papillomavirus type 129
atctgaaaggctgatcaata

SEQ ID NO: 56252 - DNA, 20 bp, Human papillomavirus type 129
tctgaaaggctgatcaatag

SEQ ID NO: 56253 - DNA, 20 bp, Human papillomavirus type 129
caacaagacaggttttaaat

SEQ ID NO: 56254 - DNA, 20 bp, Human papillomavirus type 129
taaatgtcaccgcccctagg

SEQ ID NO: 56255 - DNA, 20 bp, Human papillomavirus type 129
aaatgtcaccgcccctaggg

SEQ ID NO: 56256 - DNA, 20 bp, Human papillomavirus type 129
ccagaatcctttagtggagg

SEQ ID NO: 56257 - DNA, 20 bp, Human papillomavirus type 129
agtggaggtcacttaattgt

SEQ ID NO: 56258 - DNA, 20 bp, Human papillomavirus type 129
gtggaggtcacttaattgtt

SEQ ID NO: 56259 - DNA, 20 bp, Human papillomavirus type 129
attgttaccactacagacac

SEQ ID NO: 56260 - DNA, 20 bp, Human papillomavirus type 129
ttaccactacagacacacag

SEQ ID NO: 56261 - DNA, 20 bp, Human papillomavirus type 129
gccttagttgattcttcagt

SEQ ID NO: 56262 - DNA, 20 bp, Human papillomavirus type 129
ccttagttgattcttcagta

SEQ ID NO: 56263 - DNA, 20 bp, Human papillomavirus type 129
gttgattcttcagtatatga

SEQ ID NO: 56264 - DNA, 20 bp, Human papillomavirus type 129
attcttcagtatatgatcct

SEQ ID NO: 56265 - DNA, 20 bp, Human papillomavirus type 129
ttcagtatatgatcctcaaa

SEQ ID NO: 56266 - DNA, 20 bp, Human papillomavirus type 129
ttttttggaaaaagagaaca

SEQ ID NO: 56267 - DNA, 20 bp, Human papillomavirus type 129
tttggaaaaagagaacaact

SEQ ID NO: 56268 - DNA, 20 bp, Human papillomavirus type 129
ttggaaaaagagaacaactt

SEQ ID NO: 56269 - DNA, 20 bp, Human papillomavirus type 129
tggaaaaagagaacaacttt

SEQ ID NO: 56270 - DNA, 20 bp, Human papillomavirus type 129
ggaaaaagagaacaacttta

SEQ ID NO: 56271 - DNA, 20 bp, Human papillomavirus type 129
gcaaagtaccgttagaagca

SEQ ID NO: 56272 - DNA, 20 bp, Human papillomavirus type 129
caaagtaccgttagaagcag

SEQ ID NO: 56273 - DNA, 20 bp, Human papillomavirus type 129
gaagcagatgttttagctca

SEQ ID NO: 56274 - DNA, 20 bp, Human papillomavirus type 129
tagctcatattaatgcaatg

SEQ ID NO: 56275 - DNA, 20 bp, Human papillomavirus type 129
agctcatattaatgcaatgg

SEQ ID NO: 56276 - DNA, 20 bp, Human papillomavirus type 129
ctaatatgcattccatgtta

SEQ ID NO: 56277 - DNA, 20 bp, Human papillomavirus type 129
catgttaaactgtgaatgtt

SEQ ID NO: 56278 - DNA, 20 bp, Human papillomavirus type 129
aactgtgaatgtttacattg

SEQ ID NO: 56279 - DNA, 20 bp, Human papillomavirus type 129
acattgtacttgaatatcct

SEQ ID NO: 56280 - DNA, 20 bp, Human papillomavirus type 129
cattgtacttgaatatcctg

SEQ ID NO: 56281 - DNA, 20 bp, Influenza A virus
tcgaacttgcggaaaaggca

SEQ ID NO: 56282 - DNA, 20 bp, Influenza A virus
cggaaaaggcaatgaaagag

SEQ ID NO: 56283 - DNA, 20 bp, Influenza A virus
gcagcaatatgcactcactt

SEQ ID NO: 56284 - DNA, 20 bp, Influenza A virus
cagcaatatgcactcacttg

SEQ ID NO: 56285 - DNA, 20 bp, Influenza A virus
caagtgagtgcatattgctg

SEQ ID NO: 56286 - DNA, 20 bp, Influenza A virus
gcaacaccacaggagctgag

SEQ ID NO: 56287 - DNA, 20 bp, Influenza A virus
caacaccacaggagctgaga

SEQ ID NO: 56288 - DNA, 20 bp, Influenza A virus
ctgccagatttgtatgatta

SEQ ID NO: 56289 - DNA, 20 bp, Influenza A virus
tgccagatttgtatgattac

SEQ ID NO: 56290 - DNA, 20 bp, Influenza A virus
gtatgattacaaggagaata

SEQ ID NO: 56291 - DNA, 20 bp, Influenza A virus
gacttccggatgggcctcct

SEQ ID NO: 56292 - DNA, 20 bp, Influenza A virus
cggatgggcctccttgtttt

SEQ ID NO: 56293 - DNA, 20 bp, Influenza A virus
ttttcagcggtccaaattcc

SEQ ID NO: 56294 - DNA, 20 bp, Influenza A virus
tcagcggtccaaattcctgc

SEQ ID NO: 56295 - DNA, 20 bp, Influenza A virus
cagcggtccaaattcctgct

SEQ ID NO: 56296 - DNA, 20 bp, Influenza A virus
agaatgaggagaagattcca

SEQ ID NO: 56297 - DNA, 20 bp, Influenza A virus
caagaactaaaaacatgaag

SEQ ID NO: 56298 - DNA, 20 bp, Influenza A virus
gtgagaacatggcaccagag

SEQ ID NO: 56299 - DNA, 20 bp, Influenza A virus
tctggtgccatgttctcacc

SEQ ID NO: 56300 - DNA, 20 bp, Influenza A virus
tcaccaagtgcccactttag

SEQ ID NO: 56301 - DNA, 20 bp, Influenza A virus
gagaagacgtggctccaatt

SEQ ID NO: 56302 - DNA, 20 bp, Influenza A virus
aacacattgcaagcatgaga

SEQ ID NO: 56303 - DNA, 20 bp, Influenza A virus
caagcatgagaaggaattac

SEQ ID NO: 56304 - DNA, 20 bp, Influenza A virus
cttcacagcagaggtgtccc

SEQ ID NO: 56305 - DNA, 20 bp, Influenza A virus
acagcagaggtgtcccattg

SEQ ID NO: 56306 - DNA, 20 bp, Influenza A virus
aggaatgacaccgacgtggt

SEQ ID NO: 56307 - DNA, 20 bp, Influenza A virus
gtgagcatggagttttctct

SEQ ID NO: 56308 - DNA, 20 bp, Influenza A virus
tgagcatggagttttctctc

SEQ ID NO: 56309 - DNA, 20 bp, Influenza A virus
tctctcactgacccgagact

SEQ ID NO: 56310 - DNA, 20 bp, Influenza A virus
ctctcactgacccgagactt

SEQ ID NO: 56311 - DNA, 20 bp, Influenza A virus
aagccgagtcctctgtcaaa

SEQ ID NO: 56312 - DNA, 20 bp, Influenza A virus
tttgagaataaatcagaaac

SEQ ID NO: 56313 - DNA, 20 bp, Influenza A virus
ttgagaataaatcagaaaca

SEQ ID NO: 56314 - DNA, 20 bp, Influenza A virus
tgagaataaatcagaaacat

SEQ ID NO: 56315 - DNA, 20 bp, Influenza A virus
gagaataaatcagaaacatg

SEQ ID NO: 56316 - DNA, 20 bp, Hepatitis delta virus
agcgaacagagagcgcatcg

SEQ ID NO: 56317 - DNA, 20 bp, Hepatitis delta virus
ggggagaccgaagcgaggag

SEQ ID NO: 56318 - DNA, 20 bp, Hepatitis delta virus
gctttcctcctcgcttcggt

SEQ ID NO: 56319 - DNA, 20 bp, Hepatitis delta virus
ctttcctcctcgcttcggtc

SEQ ID NO: 56320 - DNA, 20 bp, Hepatitis delta virus
cctcctcgcttcggtctccc

SEQ ID NO: 56321 - DNA, 20 bp, Hepatitis delta virus
gaacattggggaccagtgga

SEQ ID NO: 56322 - DNA, 20 bp, Hepatitis delta virus
aacattggggaccagtggag

SEQ ID NO: 56323 - DNA, 20 bp, Hepatitis delta virus
gggaccagtggagccatggg

SEQ ID NO: 56324 - DNA, 20 bp, Hepatitis delta virus
cgcccaagctccttcccccc

SEQ ID NO: 56325 - DNA, 20 bp, Hepatitis delta virus
gggggaaggagcttgggcgg

SEQ ID NO: 56326 - DNA, 20 bp, Hepatitis delta virus
gccatccgagtggacgtgcg

SEQ ID NO: 56327 - DNA, 20 bp, Hepatitis delta virus
ggatgcccaggtcggaccgc

SEQ ID NO: 56328 - DNA, 20 bp, Hepatitis delta virus
catgctggggacgaagccgc

SEQ ID NO: 56329 - DNA, 20 bp, Hepatitis delta virus
caccttcgagggggttcaca

SEQ ID NO: 56330 - DNA, 20 bp, Hepatitis delta virus
gagggggttcacacccccaa

SEQ ID NO: 56331 - DNA, 20 bp, Hepatitis delta virus
ggggtgtgaaccccctcgaa

SEQ ID NO: 56332 - DNA, 20 bp, Hepatitis delta virus
gtccccagcatgcaaggagt

SEQ ID NO: 56333 - DNA, 20 bp, Hepatitis delta virus
gtcggtgatcctgcctctcc

SEQ ID NO: 56334 - DNA, 20 bp, Hepatitis delta virus
tcggtgaatcctcccctgga

SEQ ID NO: 56335 - DNA, 20 bp, Hepatitis delta virus
ctaggtccggagtctacttc

SEQ ID NO: 56336 - DNA, 20 bp, Hepatitis delta virus
catctggtccgttcgggccc

SEQ ID NO: 56337 - DNA, 20 bp, Hepatitis delta virus
gggccctcttcgccggggga

SEQ ID NO: 56338 - DNA, 20 bp, Human papillomavirus type 26
gaggatcctagagaacgacc

SEQ ID NO: 56339 - DNA, 20 bp, Human papillomavirus type 26
aatactactttgcaaaattt

SEQ ID NO: 56340 - DNA, 20 bp, Human papillomavirus type 26
tgcaaagtagtattcaagct

SEQ ID NO: 56341 - DNA, 20 bp, Human papillomavirus type 26
gcaaagtagtattcaagctt

SEQ ID NO: 56342 - DNA, 20 bp, Human papillomavirus type 26
caaagtagtattcaagcttt

SEQ ID NO: 56343 - DNA, 20 bp, Human papillomavirus type 26
actaaaaaaagtttatgtaa

SEQ ID NO: 56344 - DNA, 20 bp, Human papillomavirus type 26
atgtaatttgttaataaggt

SEQ ID NO: 56345 - DNA, 20 bp, Human papillomavirus type 26
tgtaatttgttaataaggtg

SEQ ID NO: 56346 - DNA, 20 bp, Human papillomavirus type 26
gttaataaggtgtcatagat

SEQ ID NO: 56347 - DNA, 20 bp, Human papillomavirus type 26
ttaataaggtgtcatagatg

SEQ ID NO: 56348 - DNA, 20 bp, Human papillomavirus type 26
acctacgctgctacgaacaa

SEQ ID NO: 56349 - DNA, 20 bp, Human papillomavirus type 26
gactatgaacaatttgacag

SEQ ID NO: 56350 - DNA, 20 bp, Human papillomavirus type 26
gacagctcagatgaggatga

SEQ ID NO: 56351 - DNA, 20 bp, Human papillomavirus type 26
acagctcagatgaggatgaa

SEQ ID NO: 56352 - DNA, 20 bp, Human papillomavirus type 26
tctgtttcatcctcatctga

SEQ ID NO: 56353 - DNA, 20 bp, Human papillomavirus type 26
tcagtagaagctatagtgga

SEQ ID NO: 56354 - DNA, 20 bp, Human papillomavirus type 26
cagtagaagctatagtggaa

SEQ ID NO: 56355 - DNA, 20 bp, Human papillomavirus type 26
agtagaagctatagtggaaa

SEQ ID NO: 56356 - DNA, 20 bp, Human papillomavirus type 26
tgtcccctgtatgtttttcc

SEQ ID NO: 56357 - DNA, 20 bp, Human papillomavirus type 26
ttccactatagcttctactg

SEQ ID NO: 56358 - DNA, 20 bp, Human papillomavirus type 26
aggcacaacaaaaacaggca

SEQ ID NO: 56359 - DNA, 20 bp, Human papillomavirus type 26
aaaacgaaagttactaggta

SEQ ID NO: 56360 - DNA, 20 bp, Human papillomavirus type 26
aaacgaaagttactaggtag

SEQ ID NO: 56361 - DNA, 20 bp, Human papillomavirus type 26
ctaggtagtcagaacagccc

SEQ ID NO: 56362 - DNA, 20 bp, Human papillomavirus type 26
caagacataacaaatcaaca

SEQ ID NO: 56363 - DNA, 20 bp, Human papillomavirus type 26
actgatgtaaattggaaaag

SEQ ID NO: 56364 - DNA, 20 bp, Human papillomavirus type 26
gaaaagctttttttccacca

SEQ ID NO: 56365 - DNA, 20 bp, Human papillomavirus type 26
ttttccaccacctggtccag

SEQ ID NO: 56366 - DNA, 20 bp, Human papillomavirus type 26
tttccaccacctggtccaga

SEQ ID NO: 56367 - DNA, 20 bp, Human papillomavirus type 26
ttccaccacctggtccagat

SEQ ID NO: 56368 - DNA, 20 bp, Human papillomavirus type 26
tgtgtaaacaaaaggcatgg

SEQ ID NO: 56369 - DNA, 20 bp, Human papillomavirus type 26
aaatacatatagcattgcag

SEQ ID NO: 56370 - DNA, 20 bp, Human papillomavirus type 26
cagtcgttaataaacacgga

SEQ ID NO: 56371 - DNA, 20 bp, Human papillomavirus type 26
ataaacacggactataatac

SEQ ID NO: 56372 - DNA, 20 bp, Human papillomavirus type 26
gacaatgcgagacacaagct

SEQ ID NO: 56373 - DNA, 20 bp, Human papillomavirus type 26
atgcaaaagggatatattat

SEQ ID NO: 56374 - DNA, 20 bp, Human papillomavirus type 26
tacacaaggggcatataagc

SEQ ID NO: 56375 - DNA, 20 bp, Human papillomavirus type 26
cgtggactttaaacaagagg

SEQ ID NO: 56376 - DNA, 20 bp, Human papillomavirus type 26
aaacaagaggcggaaaaata

SEQ ID NO: 56377 - DNA, 20 bp, Human papillomavirus type 26
aacaagaggcggaaaaatat

SEQ ID NO: 56378 - DNA, 20 bp, Human papillomavirus type 26
ttgtttgtatagtccactga

SEQ ID NO: 56379 - DNA, 20 bp, Human papillomavirus type 26
tttgtatagtccactgactg

SEQ ID NO: 56380 - DNA, 20 bp, Human papillomavirus type 26
gtatagtccactgactgtcc

SEQ ID NO: 56381 - DNA, 20 bp, Human papillomavirus type 26
tatagtccactgactgtccg

SEQ ID NO: 56382 - DNA, 20 bp, Human papillomavirus type 26
tatagttactttggtggagg

SEQ ID NO: 56383 - DNA, 20 bp, Human papillomavirus type 26
ctttggtggaggaatctagt

SEQ ID NO: 56384 - DNA, 20 bp, Human papillomavirus type 26
ggtggaggaatctagtatta

SEQ ID NO: 56385 - DNA, 20 bp, Human papillomavirus type 26
gtggaggaatctagtattat

SEQ ID NO: 56386 - DNA, 20 bp, Human papillomavirus type 26
tacaatctggagcccctata

SEQ ID NO: 56387 - DNA, 20 bp, Human papillomavirus type 26
tttggacattattgcattgc

SEQ ID NO: 56388 - DNA, 20 bp, Human papillomavirus type 26
ttggacattattgcattgca

SEQ ID NO: 56389 - DNA, 20 bp, Human papillomavirus type 26
tggacattattgcattgcat

SEQ ID NO: 56390 - DNA, 20 bp, Human papillomavirus type 26
ggacattattgcattgcatc

SEQ ID NO: 56391 - DNA, 20 bp, Human papillomavirus type 26
gacattattgcattgcatcg

SEQ ID NO: 56392 - DNA, 20 bp, Human papillomavirus type 26
ctagcatacatacgccgcgc

SEQ ID NO: 56393 - DNA, 20 bp, Human papillomavirus type 26
ccctacaacattaccagttc

SEQ ID NO: 56394 - DNA, 20 bp, Human papillomavirus type 26
ccagttccaagatatgcctc

SEQ ID NO: 56395 - DNA, 20 bp, Human papillomavirus type 26
caagatatgcctccaatgtg

SEQ ID NO: 56396 - DNA, 20 bp, Human papillomavirus type 26
atagaggaaaacacattgga

SEQ ID NO: 56397 - DNA, 20 bp, Human papillomavirus type 26
atttaatccataaacgccgt

SEQ ID NO: 56398 - DNA, 20 bp, Human papillomavirus type 26
tttaatccataaacgccgta

SEQ ID NO: 56399 - DNA, 20 bp, Human papillomavirus type 26
aatccataaacgccgtaaac

SEQ ID NO: 56400 - DNA, 20 bp, Human papillomavirus type 26
atccataaacgccgtaaacg

SEQ ID NO: 56401 - DNA, 20 bp, Human papillomavirus type 26
ttttttttcagatggctttg

SEQ ID NO: 56402 - DNA, 20 bp, Human papillomavirus type 26
agagtgcacctacctgatcc

SEQ ID NO: 56403 - DNA, 20 bp, Human papillomavirus type 26
gagtgcacctacctgatcct

SEQ ID NO: 56404 - DNA, 20 bp, Human papillomavirus type 26
ggattgcctgatccacagtt

SEQ ID NO: 56405 - DNA, 20 bp, Human papillomavirus type 26
gattgcctgatccacagtta

SEQ ID NO: 56406 - DNA, 20 bp, Human papillomavirus type 26
cctgatccacagttatataa

SEQ ID NO: 56407 - DNA, 20 bp, Human papillomavirus type 26
ggagagcactggggtattgg

SEQ ID NO: 56408 - DNA, 20 bp, Human papillomavirus type 26
gcactatatgtaaaaataca

SEQ ID NO: 56409 - DNA, 20 bp, Human papillomavirus type 26
cccccccttagaattaattt

SEQ ID NO: 56410 - DNA, 20 bp, Human papillomavirus type 26
gaattaatttccagcattat

SEQ ID NO: 56411 - DNA, 20 bp, Human papillomavirus type 26
atttccagcattattgagga

SEQ ID NO: 56412 - DNA, 20 bp, Human papillomavirus type 26
gccgggaacaattatttgcc

SEQ ID NO: 56413 - DNA, 20 bp, Human papillomavirus type 26
tttgccagacatttttataa

SEQ ID NO: 56414 - DNA, 20 bp, Human papillomavirus type 26
gccagacatttttataataa

SEQ ID NO: 56415 - DNA, 20 bp, Human papillomavirus type 26
ccagacatttttataataag

SEQ ID NO: 56416 - DNA, 20 bp, Human papillomavirus type 26
ttataataaggcgggggctg

SEQ ID NO: 56417 - DNA, 20 bp, Human papillomavirus type 26
ctaaataattccgcatgttt

SEQ ID NO: 56418 - DNA, 20 bp, Human papillomavirus type 26
cgcatgtttgtgtgtgtgta

SEQ ID NO: 56419 - DNA, 20 bp, Human papillomavirus type 26
gtgtgtgtgtatatgtttgt

SEQ ID NO: 56420 - DNA, 20 bp, Human papillomavirus type 26
tgtgtgtgtatatgtttgtg

SEQ ID NO: 56421 - DNA, 20 bp, Human papillomavirus type 26
gtggtatgttatgtaaggtg

SEQ ID NO: 56422 - DNA, 20 bp, Hepatitis GB virus B
cccctgcccgtctgcagaag

SEQ ID NO: 56423 - DNA, 20 bp, Hepatitis GB virus B
ccctgcccgtctgcagaagg

SEQ ID NO: 56424 - DNA, 20 bp, Hepatitis GB virus B
gtatgtaggcggcgggactc

SEQ ID NO: 56425 - DNA, 20 bp, Hepatitis GB virus B
gcgcttgtcatcacgcgagc

SEQ ID NO: 56426 - DNA, 20 bp, Hepatitis GB virus B
tcatcacgcgagcgtcatga

SEQ ID NO: 56427 - DNA, 20 bp, Hepatitis GB virus B
ggatggttggggttagccat

SEQ ID NO: 56428 - DNA, 20 bp, Hepatitis GB virus B
gggttagccatccataccgt

SEQ ID NO: 56429 - DNA, 20 bp, Hepatitis GB virus B
gccatccataccgtactgcc

SEQ ID NO: 56430 - DNA, 20 bp, Hepatitis GB virus B
cgaggggatctgggagtctc

SEQ ID NO: 56431 - DNA, 20 bp, Hepatitis GB virus B
tttgagtagaaataacaggc

SEQ ID NO: 56432 - DNA, 20 bp, Hepatitis GB virus B
gaccagtctgccagatagta

SEQ ID NO: 56433 - DNA, 20 bp, Hepatitis GB virus B
ctggaggatggagtcaactg

SEQ ID NO: 56434 - DNA, 20 bp, Hepatitis GB virus B
gttcggtgtccacctttttg

SEQ ID NO: 56435 - DNA, 20 bp, Hepatitis GB virus B
ggtgtccacctttttgtggt

SEQ ID NO: 56436 - DNA, 20 bp, Hepatitis GB virus B
actccatcctccagcaagcg

SEQ ID NO: 56437 - DNA, 20 bp, Hepatitis GB virus B
tgtgatctgtgcggacgagt

SEQ ID NO: 56438 - DNA, 20 bp, Hepatitis GB virus B
ccgccaatccgtacatctca

SEQ ID NO: 56439 - DNA, 20 bp, Hepatitis GB virus B
caattggactggcacggact

SEQ ID NO: 56440 - DNA, 20 bp, Hepatitis GB virus B
gactggcacggactccttct

SEQ ID NO: 56441 - DNA, 20 bp, Hepatitis GB virus B
ttggctgaccacattgattt

SEQ ID NO: 56442 - DNA, 20 bp, Hepatitis GB virus B
gtacccctatacaatccctg

SEQ ID NO: 56443 - DNA, 20 bp, Hepatitis GB virus B
aattcaaaaataacacatgg

SEQ ID NO: 56444 - DNA, 20 bp, Hepatitis GB virus B
aaaaataacacatggggttg

SEQ ID NO: 56445 - DNA, 20 bp, Hepatitis GB virus B
ctgccgtattcgcaatgtgc

SEQ ID NO: 56446 - DNA, 20 bp, Hepatitis GB virus B
cgaatacggcagcaacccca

SEQ ID NO: 56447 - DNA, 20 bp, Hepatitis GB virus B
acttttatgaccctgtgaat

SEQ ID NO: 56448 - DNA, 20 bp, Hepatitis GB virus B
cttttatgaccctgtgaatt

SEQ ID NO: 56449 - DNA, 20 bp, Hepatitis GB virus B
tatgaccctgtgaattccac

SEQ ID NO: 56450 - DNA, 20 bp, Hepatitis GB virus B
atgaccctgtgaattccact

SEQ ID NO: 56451 - DNA, 20 bp, Hepatitis GB virus B
tgaccctgtgaattccactc

SEQ ID NO: 56452 - DNA, 20 bp, Hepatitis GB virus B
taggtccttggcctctggta

SEQ ID NO: 56453 - DNA, 20 bp, Hepatitis GB virus B
gcctctggtagcgcttttaa

SEQ ID NO: 56454 - DNA, 20 bp, Hepatitis GB virus B
taaccctcttgcatttggtt

SEQ ID NO: 56455 - DNA, 20 bp, Hepatitis GB virus B
aaccctcttgcatttggtta

SEQ ID NO: 56456 - DNA, 20 bp, Hepatitis GB virus B
accctcttgcatttggttac

SEQ ID NO: 56457 - DNA, 20 bp, Hepatitis GB virus B
tatgtttaacatccagtgca

SEQ ID NO: 56458 - DNA, 20 bp, Hepatitis GB virus B
aacatccagtgcagcatcgt

SEQ ID NO: 56459 - DNA, 20 bp, Hepatitis GB virus B
acatccagtgcagcatcgtt

SEQ ID NO: 56460 - DNA, 20 bp, Hepatitis GB virus B
tttgggactgactctagggt

SEQ ID NO: 56461 - DNA, 20 bp, Hepatitis GB virus B
gggactgactctagggttag

SEQ ID NO: 56462 - DNA, 20 bp, Hepatitis GB virus B
ttgcgcgtctcggcgacctt

SEQ ID NO: 56463 - DNA, 20 bp, Hepatitis GB virus B
cgcgtctcggcgaccttgtt

SEQ ID NO: 56464 - DNA, 20 bp, Hepatitis GB virus B
ttttcgcagggttggctatg

SEQ ID NO: 56465 - DNA, 20 bp, Hepatitis GB virus B
tcgcagggttggctatgccg

SEQ ID NO: 56466 - DNA, 20 bp, Hepatitis GB virus B
cgcagggttggctatgccgc

SEQ ID NO: 56467 - DNA, 20 bp, Hepatitis GB virus B
ctcggtgctcttgcggggag

SEQ ID NO: 56468 - DNA, 20 bp, Hepatitis GB virus B
cggggagaccaaggggtatc

SEQ ID NO: 56469 - DNA, 20 bp, Hepatitis GB virus B
ccagataccccttggtctcc

SEQ ID NO: 56470 - DNA, 20 bp, Hepatitis GB virus B
gtctccccgcaagagcaccg

SEQ ID NO: 56471 - DNA, 20 bp, Hepatitis GB virus B
atagatgtcctggtcattag

SEQ ID NO: 56472 - DNA, 20 bp, Hepatitis GB virus B
agtgcaaattttaattgccc

SEQ ID NO: 56473 - DNA, 20 bp, Hepatitis GB virus B
taattgcccccactggcagc

SEQ ID NO: 56474 - DNA, 20 bp, Hepatitis GB virus B
aattgcccccactggcagcg

SEQ ID NO: 56475 - DNA, 20 bp, Hepatitis GB virus B
attgcccccactggcagcgg

SEQ ID NO: 56476 - DNA, 20 bp, Hepatitis GB virus B
cccccactggcagcggcaag

SEQ ID NO: 56477 - DNA, 20 bp, Hepatitis GB virus B
ggctagtggttcttgccacg

SEQ ID NO: 56478 - DNA, 20 bp, Hepatitis GB virus B
ttgccacggctaccccccct

SEQ ID NO: 56479 - DNA, 20 bp, Hepatitis GB virus B
ccacggctaccccccctgga

SEQ ID NO: 56480 - DNA, 20 bp, Hepatitis GB virus B
aattaaccgatgaaggcact

SEQ ID NO: 56481 - DNA, 20 bp, Hepatitis GB virus B
accgatgaaggcactatccc

SEQ ID NO: 56482 - DNA, 20 bp, Hepatitis GB virus B
gtcatcaacagaagctcaaa

SEQ ID NO: 56483 - DNA, 20 bp, Hepatitis GB virus B
tcatcaacagaagctcaaac

SEQ ID NO: 56484 - DNA, 20 bp, Hepatitis GB virus B
tggacacctatcgcacccaa

SEQ ID NO: 56485 - DNA, 20 bp, Hepatitis GB virus B
cctgcgataggagcaaattt

SEQ ID NO: 56486 - DNA, 20 bp, Hepatitis GB virus B
ggacgagtgggctgatctct

SEQ ID NO: 56487 - DNA, 20 bp, Hepatitis GB virus B
cacattggaaaccgcccttg

SEQ ID NO: 56488 - DNA, 20 bp, Hepatitis GB virus B
acattggaaaccgcccttga

SEQ ID NO: 56489 - DNA, 20 bp, Hepatitis GB virus B
gaaaccgcccttgaaaaact

SEQ ID NO: 56490 - DNA, 20 bp, Hepatitis GB virus B
aaaaacttaacacctttctt

SEQ ID NO: 56491 - DNA, 20 bp, Hepatitis GB virus B
acacctttcttgggcctcat

SEQ ID NO: 56492 - DNA, 20 bp, Hepatitis GB virus B
cttgacatttaaatgcttga

SEQ ID NO: 56493 - DNA, 20 bp, Hepatitis GB virus B
acatttaaatgcttgatggg

SEQ ID NO: 56494 - DNA, 20 bp, Hepatitis GB virus B
aaatgcttgatgggtgagtg

SEQ ID NO: 56495 - DNA, 20 bp, Hepatitis GB virus B
aatgcttgatgggtgagtgg

SEQ ID NO: 56496 - DNA, 20 bp, Hepatitis GB virus B
atgggtgagtggcccactat

SEQ ID NO: 56497 - DNA, 20 bp, Hepatitis GB virus B
cagtcaacgctaggctgtgt

SEQ ID NO: 56498 - DNA, 20 bp, Hepatitis GB virus B
gactagtcttgtcgtcaatt

SEQ ID NO: 56499 - DNA, 20 bp, Hepatitis GB virus B
tcgtcaattatggcgttagg

SEQ ID NO: 56500 - DNA, 20 bp, Hepatitis GB virus B
tggcgttagggactactgta

SEQ ID NO: 56501 - DNA, 20 bp, Hepatitis GB virus B
acagtagtccctaacgccat

SEQ ID NO: 56502 - DNA, 20 bp, Hepatitis GB virus B
gaaggtccttcaaacctccc

SEQ ID NO: 56503 - DNA, 20 bp, Hepatitis GB virus B
aaacctccctccttcaccac

SEQ ID NO: 56504 - DNA, 20 bp, Hepatitis GB virus B
accacctgttctacagttgg

SEQ ID NO: 56505 - DNA, 20 bp, Hepatitis GB virus B
tacagttggccatgccgatg

SEQ ID NO: 56506 - DNA, 20 bp, Hepatitis GB virus B
gccatgccgatgcccctgtt

SEQ ID NO: 56507 - DNA, 20 bp, Hepatitis GB virus B
gtgcagcatgagctacacct

SEQ ID NO: 56508 - DNA, 20 bp, Hepatitis GB virus B
gcttcaaaactgcttctaaa

SEQ ID NO: 56509 - DNA, 20 bp, Hepatitis GB virus B
aaaactgcttctaaagttct

SEQ ID NO: 56510 - DNA, 20 bp, Hepatitis GB virus B
taaagttctgtctgcaactc

SEQ ID NO: 56511 - DNA, 20 bp, Hepatitis GB virus B
tgtctgcaactcgggccatc

SEQ ID NO: 56512 - DNA, 20 bp, Hepatitis GB virus B
ggggcactgatgttcgttct

SEQ ID NO: 56513 - DNA, 20 bp, Hepatitis GB virus B
gttctggagcagcccgcaag

SEQ ID NO: 56514 - DNA, 20 bp, Hepatitis GB virus B
tggagcagcccgcaaggctg

SEQ ID NO: 56515 - DNA, 20 bp, Hepatitis GB virus B
tggacttgcagaagtgtgtc

SEQ ID NO: 56516 - DNA, 20 bp, Hepatitis GB virus B
cagaagtgtgtcgaggcagg

SEQ ID NO: 56517 - DNA, 20 bp, Hepatitis GB virus B
tgacagtaccatcacacccg

SEQ ID NO: 56518 - DNA, 20 bp, Hepatitis GB virus B
gacagtaccatcacacccga

SEQ ID NO: 56519 - DNA, 20 bp, Hepatitis GB virus B
acagtaccatcacacccgag

SEQ ID NO: 56520 - DNA, 20 bp, Hepatitis GB virus B
gtcactgagtttagctgctg

SEQ ID NO: 56521 - DNA, 20 bp, Hepatitis GB virus B
agctgctgagtagatgtctg

SEQ ID NO: 56522 - DNA, 20 bp, Hepatitis GB virus B
cttatttgcggcgatgattg

SEQ ID NO: 56523 - DNA, 20 bp, Hepatitis GB virus B
tttgcggcgatgattgcacc

SEQ ID NO: 56524 - DNA, 20 bp, Hepatitis GB virus B
gcggcgatgattgcaccgta

SEQ ID NO: 56525 - DNA, 20 bp, Hepatitis GB virus B
cggcgatgattgcaccgtaa

SEQ ID NO: 56526 - DNA, 20 bp, Hepatitis GB virus B
caccgtaatttggaagagcg

SEQ ID NO: 56527 - DNA, 20 bp, Hepatitis GB virus B
gactggtatgggaaaaatta

SEQ ID NO: 56528 - DNA, 20 bp, Hepatitis GB virus B
actggtatgggaaaaattat

SEQ ID NO: 56529 - DNA, 20 bp, Hepatitis GB virus B
tacggtgcctgtagaagatc

SEQ ID NO: 56530 - DNA, 20 bp, Hepatitis GB virus B
ctggtgtgcacggtattgag

SEQ ID NO: 56531 - DNA, 20 bp, Hepatitis GB virus B
aggctttctcggtggtgcgc

SEQ ID NO: 56532 - DNA, 20 bp, Hepatitis GB virus B
ggataagacgagcgtggctc

SEQ ID NO: 56533 - DNA, 20 bp, Hepatitis GB virus B
gataagacgagcgtggctcg

SEQ ID NO: 56534 - DNA, 20 bp, Hepatitis GB virus B
caattattgtgatgtttact

SEQ ID NO: 56535 - DNA, 20 bp, Hepatitis GB virus B
aattattgtgatgtttactc

SEQ ID NO: 56536 - DNA, 20 bp, Hepatitis GB virus B
ttgtgatgtttactccccgg

SEQ ID NO: 56537 - DNA, 20 bp, Hepatitis GB virus B
acgaccccgccgatgtgagt

SEQ ID NO: 56538 - DNA, 20 bp, Hepatitis GB virus B
ggcgaccatggtggatcaga

SEQ ID NO: 56539 - DNA, 20 bp, Hepatitis GB virus B
gcgaccatggtggatcagaa

SEQ ID NO: 56540 - DNA, 20 bp, Hepatitis GB virus B
cgggtgaagccatggtctga

SEQ ID NO: 56541 - DNA, 20 bp, Hepatitis GB virus B
gggtgaagccatggtctgaa

SEQ ID NO: 56542 - DNA, 20 bp, Influenza A virus
cacaatatgcttcttcatgc

SEQ ID NO: 56543 - DNA, 20 bp, Influenza A virus
ttcatgcaaattgccatcct

SEQ ID NO: 56544 - DNA, 20 bp, Influenza A virus
atgcaaattgccatcctgat

SEQ ID NO: 56545 - DNA, 20 bp, Influenza A virus
ccatcctgataaccactgta

SEQ ID NO: 56546 - DNA, 20 bp, Influenza A virus
catttcaagcaatatgaatt

SEQ ID NO: 56547 - DNA, 20 bp, Influenza A virus
caggatttgcacctttttct

SEQ ID NO: 56548 - DNA, 20 bp, Influenza A virus
gcacctttttctaaggacaa

SEQ ID NO: 56549 - DNA, 20 bp, Influenza A virus
cacctttttctaaggacaat

SEQ ID NO: 56550 - DNA, 20 bp, Influenza A virus
ttctaaggacaattcgatta

SEQ ID NO: 56551 - DNA, 20 bp, Influenza A virus
tctaaggacaattcgattag

SEQ ID NO: 56552 - DNA, 20 bp, Influenza A virus
tcacgatggaaaagcatggc

SEQ ID NO: 56553 - DNA, 20 bp, Influenza A virus
gtgtaacgggggatgataaa

SEQ ID NO: 56554 - DNA, 20 bp, Influenza A virus
tgtaacgggggatgataaaa

SEQ ID NO: 56555 - DNA, 20 bp, Influenza A virus
taaatgaagctagcagttgc

SEQ ID NO: 56556 - DNA, 20 bp, Influenza A virus
catttttatcatcccccgtt

SEQ ID NO: 56557 - DNA, 20 bp, Influenza A virus
tcaggaagtgctcagcatgt

SEQ ID NO: 56558 - DNA, 20 bp, Influenza A virus
gagcctttccagttgtctct

SEQ ID NO: 56559 - DNA, 20 bp, Influenza A virus
ccagttgtctctgcagacac

SEQ ID NO: 56560 - DNA, 20 bp, Influenza A virus
cagttgtctctgcagacaca

SEQ ID NO: 56561 - DNA, 20 bp, Influenza A virus
tctctgcagacacatctgac

SEQ ID NO: 56562 - DNA, 20 bp, Influenza A virus
gatgatggaaatgacgtgtg

SEQ ID NO: 56563 - DNA, 20 bp, Influenza A virus
atgatggaaatgacgtgtgg

SEQ ID NO: 56564 - DNA, 20 bp, Influenza A virus
atatcctgagcgtaacttct

SEQ ID NO: 56565 - DNA, 20 bp, Influenza A virus
tcgctgatcgttcttcccat

SEQ ID NO: 56566 - DNA, 20 bp, Influenza A virus
ttcccatccacacgtcattt

SEQ ID NO: 56567 - DNA, 20 bp, Human papillomavirus
ttacaattgtttaactttat

SEQ ID NO: 56568 - DNA, 20 bp, Human papillomavirus
caattgtttaactttattgg

SEQ ID NO: 56569 - DNA, 20 bp, Human papillomavirus
tttaactttattggatactg

SEQ ID NO: 56570 - DNA, 20 bp, Human papillomavirus
aactttattggatactgctg

SEQ ID NO: 56571 - DNA, 20 bp, Human papillomavirus
actttattggatactgctga

SEQ ID NO: 56572 - DNA, 20 bp, Human papillomavirus
cggtacctgtaaagcaactg

SEQ ID NO: 56573 - DNA, 20 bp, Human papillomavirus
ttgctacttcaactgctgtt

SEQ ID NO: 56574 - DNA, 20 bp, Human papillomavirus
tgctacttcaactgctgttt

SEQ ID NO: 56575 - DNA, 20 bp, Human papillomavirus
gctacttcaactgctgtttg

SEQ ID NO: 56576 - DNA, 20 bp, Human papillomavirus
ctacttcaactgctgtttgc

SEQ ID NO: 56577 - DNA, 20 bp, Human papillomavirus
tgttatttctgaattgattg

SEQ ID NO: 56578 - DNA, 20 bp, Human papillomavirus
tttctgaattgattgatgat

SEQ ID NO: 56579 - DNA, 20 bp, Human papillomavirus
ctgaattgattgatgatgtg

SEQ ID NO: 56580 - DNA, 20 bp, Human papillomavirus
tgaattgattgatgatgtgg

SEQ ID NO: 56581 - DNA, 20 bp, Human papillomavirus
attgatgatgtggataatgc

SEQ ID NO: 56582 - DNA, 20 bp, Human papillomavirus
aggaagatgaaactgcaaat

SEQ ID NO: 56583 - DNA, 20 bp, Human papillomavirus
ctcaggtacaagctgatact

SEQ ID NO: 56584 - DNA, 20 bp, Human papillomavirus
tcaggtacaagctgatactc

SEQ ID NO: 56585 - DNA, 20 bp, Human papillomavirus
acaaatcaactgtttcatca

SEQ ID NO: 56586 - DNA, 20 bp, Human papillomavirus
catcagctcctgcgggtaca

SEQ ID NO: 56587 - DNA, 20 bp, Human papillomavirus
ttggctaatgcctttgatag

SEQ ID NO: 56588 - DNA, 20 bp, Human papillomavirus
tggctaatgcctttgataga

SEQ ID NO: 56589 - DNA, 20 bp, Human papillomavirus
ggctaatgcctttgatagat

SEQ ID NO: 56590 - DNA, 20 bp, Human papillomavirus
gctaatgcctttgatagatg

SEQ ID NO: 56591 - DNA, 20 bp, Human papillomavirus
gatagatggtaaaattggct

SEQ ID NO: 56592 - DNA, 20 bp, Human papillomavirus
acccaaccctctacctccgg

SEQ ID NO: 56593 - DNA, 20 bp, Human papillomavirus
ctcaacatcatcatcatcat

SEQ ID NO: 56594 - DNA, 20 bp, Human papillomavirus
aggaatctgcctcttctgca

SEQ ID NO: 56595 - DNA, 20 bp, Human papillomavirus
tgcagctcgtcgacgcttcg

SEQ ID NO: 56596 - DNA, 20 bp, Human papillomavirus
ggcgatggggtcttggagta

SEQ ID NO: 56597 - DNA, 20 bp, Human papillomavirus
tgaagtgggaacaggacatc

SEQ ID NO: 56598 - DNA, 20 bp, Human papillomavirus
cgcgacaagctcttggaaga

SEQ ID NO: 56599 - DNA, 20 bp, Human papillomavirus
gaagagttcagcgacttcaa

SEQ ID NO: 56600 - DNA, 20 bp, Human papillomavirus
agcgacttcaagctgaggct

SEQ ID NO: 56601 - DNA, 20 bp, Human papillomavirus
aagctgaggcttgggatcca

SEQ ID NO: 56602 - DNA, 20 bp, Human papillomavirus
tggtgttggggcttcaagta

SEQ ID NO: 56603 - DNA, 20 bp, Human papillomavirus
gggcttcaagtataaaacca

SEQ ID NO: 56604 - DNA, 20 bp, Human papillomavirus
aagtataaaaccaattcctg

SEQ ID NO: 56605 - DNA, 20 bp, Human papillomavirus
ctgaagcacttcctataccg

SEQ ID NO: 56606 - DNA, 20 bp, Human papillomavirus
ctataccggaaggtgcacca

SEQ ID NO: 56607 - DNA, 20 bp, Human papillomavirus
gacctttgaaagagatttac

SEQ ID NO: 56608 - DNA, 20 bp, Human papillomavirus
acctttgaaagagatttaca

SEQ ID NO: 56609 - DNA, 20 bp, Human papillomavirus
gaaagagatttacaggaggt

SEQ ID NO: 56610 - DNA, 20 bp, Human papillomavirus
aaagagatttacaggaggta

SEQ ID NO: 56611 - DNA, 20 bp, Human papillomavirus
acaggaggtagcagctgcac

SEQ ID NO: 56612 - DNA, 20 bp, Human papillomavirus
ttaataaagtgcttgacaca

SEQ ID NO: 56613 - DNA, 20 bp, Human papillomavirus
taataaagtgcttgacacag

SEQ ID NO: 56614 - DNA, 20 bp, Human papillomavirus
aataaagtgcttgacacaga

SEQ ID NO: 56615 - DNA, 20 bp, Human papillomavirus
ataaagtgcttgacacagaa

SEQ ID NO: 56616 - DNA, 20 bp, Human papillomavirus
acacagaaaatcctaatgct

SEQ ID NO: 56617 - DNA, 20 bp, Human papillomavirus
ggtgcagccaattttagacg

SEQ ID NO: 56618 - DNA, 20 bp, Human papillomavirus
gtgcagccaattttagacga

SEQ ID NO: 56619 - DNA, 20 bp, Human papillomavirus
tagacgattacaacaggaca

SEQ ID NO: 56620 - DNA, 20 bp, Human papillomavirus
agacgattacaacaggacaa

SEQ ID NO: 56621 - DNA, 20 bp, Human papillomavirus
gacgattacaacaggacaaa

SEQ ID NO: 56622 - DNA, 20 bp, Human papillomavirus
ctggtaagaaacttggcgcc

SEQ ID NO: 56623 - DNA, 20 bp, Human papillomavirus
tggtaagaaacttggcgcca

SEQ ID NO: 56624 - DNA, 20 bp, Human papillomavirus
gcgccaacggctattgcata

SEQ ID NO: 56625 - DNA, 20 bp, Human papillomavirus
cataccggttctggtacagt

SEQ ID NO: 56626 - DNA, 20 bp, Human papillomavirus
tggtacagtaataaagattt

SEQ ID NO: 56627 - DNA, 20 bp, Influenza A virus
ggaggaagagaatggtccta

SEQ ID NO: 56628 - DNA, 20 bp, Influenza A virus
ccctgggaatgtagaaaacc

SEQ ID NO: 56629 - DNA, 20 bp, Influenza A virus
ctctaggttttctacattcc

SEQ ID NO: 56630 - DNA, 20 bp, Influenza A virus
tctacattcccagggtaaca

SEQ ID NO: 56631 - DNA, 20 bp, Influenza A virus
ctacattcccagggtaacac

SEQ ID NO: 56632 - DNA, 20 bp, Influenza A virus
aagacgcccaatacacaaat

SEQ ID NO: 56633 - DNA, 20 bp, Influenza A virus
ttttcgtgtggggcatacat

SEQ ID NO: 56634 - DNA, 20 bp, Influenza A virus
tcgtgtggggcatacatcac

SEQ ID NO: 56635 - DNA, 20 bp, Influenza A virus
cgtgtggggcatacatcacc

SEQ ID NO: 56636 - DNA, 20 bp, Influenza A virus
gtgtggggcatacatcaccc

SEQ ID NO: 56637 - DNA, 20 bp, Influenza A virus
ctccatggtatggacacgtt

SEQ ID NO: 56638 - DNA, 20 bp, Influenza A virus
tttcaggagggagccatgga

SEQ ID NO: 56639 - DNA, 20 bp, Influenza A virus
caggagggagccatggaaga

SEQ ID NO: 56640 - DNA, 20 bp, Influenza A virus
aggagggagccatggaagaa

SEQ ID NO: 56641 - DNA, 20 bp, Influenza A virus
taaatcagtcttcaggattc

SEQ ID NO: 56642 - DNA, 20 bp, Influenza A virus
atagaaggaggttggccagg

SEQ ID NO: 56643 - DNA, 20 bp, Influenza A virus
gccaggactagtcgctggct

SEQ ID NO: 56644 - DNA, 20 bp, Influenza A virus
ccagcattcaaatgatcaag

SEQ ID NO: 56645 - DNA, 20 bp, Influenza A virus
cagcattcaaatgatcaagg

SEQ ID NO: 56646 - DNA, 20 bp, Influenza A virus
aaatgatcaaggggttggta

SEQ ID NO: 56647 - DNA, 20 bp, Influenza A virus
ctagtactacttgaaaatca

SEQ ID NO: 56648 - DNA, 20 bp, Influenza A virus
aaaatcaaaaaacactcgat

SEQ ID NO: 56649 - DNA, 20 bp, Influenza A virus
catagcattggagcccagtg

SEQ ID NO: 56650 - DNA, 20 bp, Influenza A virus
gagcccagtgccctcttcac

SEQ ID NO: 56651 - DNA, 20 bp, Influenza A virus
accttgttatatagattgtt

SEQ ID NO: 56652 - DNA, 20 bp, Hepatitis C virus
ccgggatgaccgggtccttt

SEQ ID NO: 56653 - DNA, 20 bp, Hepatitis C virus
cttggataaacccgctcaat

SEQ ID NO: 56654 - DNA, 20 bp, Hepatitis C virus
ttggataaacccgctcaatg

SEQ ID NO: 56655 - DNA, 20 bp, Hepatitis C virus
gataaacccgctcaatgccc

SEQ ID NO: 56656 - DNA, 20 bp, Hepatitis C virus
agcgggtttatccaagaaag

SEQ ID NO: 56657 - DNA, 20 bp, Hepatitis C virus
ccgggcggtggtcagatcgt

SEQ ID NO: 56658 - DNA, 20 bp, Hepatitis C virus
gtggagtttacttgttgccg

SEQ ID NO: 56659 - DNA, 20 bp, Hepatitis C virus
acttgttgccgcgcaggggc

SEQ ID NO: 56660 - DNA, 20 bp, Hepatitis C virus
cttgttgccgcgcaggggcc

SEQ ID NO: 56661 - DNA, 20 bp, Hepatitis C virus
ttgccgcgcaggggccctaa

SEQ ID NO: 56662 - DNA, 20 bp, Hepatitis C virus
ggagcagtcacggcccttct

SEQ ID NO: 56663 - DNA, 20 bp, Hepatitis C virus
ttcggagagccgttgactac

SEQ ID NO: 56664 - DNA, 20 bp, Hepatitis C virus
ggagagccgttgactactta

SEQ ID NO: 56665 - DNA, 20 bp, Hepatitis C virus
ggacccagcacctactgaca

SEQ ID NO: 56666 - DNA, 20 bp, Hepatitis C virus
gacccagcacctactgacat

SEQ ID NO: 56667 - DNA, 20 bp, Hepatitis C virus
tttctgtttgcaggagttga

SEQ ID NO: 56668 - DNA, 20 bp, Hepatitis C virus
ctgtttgcaggagttgatgg

SEQ ID NO: 56669 - DNA, 20 bp, Hepatitis C virus
tgtttgcaggagttgatggc

SEQ ID NO: 56670 - DNA, 20 bp, Hepatitis C virus
gcaggagttgatggccgcac

SEQ ID NO: 56671 - DNA, 20 bp, Hepatitis C virus
caggagttgatggccgcacc

SEQ ID NO: 56672 - DNA, 20 bp, Hepatitis C virus
ccgcattcgaccaaggctgg

SEQ ID NO: 56673 - DNA, 20 bp, Hepatitis C virus
gaccaaggctggggaactat

SEQ ID NO: 56674 - DNA, 20 bp, Hepatitis C virus
ctggcactatcccccacgac

SEQ ID NO: 56675 - DNA, 20 bp, Hepatitis C virus
tcatcactggggcccgatat

SEQ ID NO: 56676 - DNA, 20 bp, Hepatitis C virus
cccagccttggtcgaatgcg

SEQ ID NO: 56677 - DNA, 20 bp, Hepatitis C virus
ggctgcacctggatgaactc

SEQ ID NO: 56678 - DNA, 20 bp, Hepatitis C virus
gtgaagaattgcggagctcc

SEQ ID NO: 56679 - DNA, 20 bp, Hepatitis C virus
tgaagaattgcggagctccg

SEQ ID NO: 56680 - DNA, 20 bp, Hepatitis C virus
cggagctccgccctgcaact

SEQ ID NO: 56681 - DNA, 20 bp, Hepatitis C virus
gggccaacaggcaacaacag

SEQ ID NO: 56682 - DNA, 20 bp, Hepatitis C virus
aagacagagatagggccgag

SEQ ID NO: 56683 - DNA, 20 bp, Hepatitis C virus
agcccgctcctgcacaccac

SEQ ID NO: 56684 - DNA, 20 bp, Hepatitis C virus
ccgtgctccttcacacctac

SEQ ID NO: 56685 - DNA, 20 bp, Hepatitis C virus
acacctacgcccgctcttag

SEQ ID NO: 56686 - DNA, 20 bp, Hepatitis C virus
gcactggtcttatacaccta

SEQ ID NO: 56687 - DNA, 20 bp, Hepatitis C virus
tcctaaacgcggctgcggcc

SEQ ID NO: 56688 - DNA, 20 bp, Hepatitis C virus
ttctggggcctgctcgttgt

SEQ ID NO: 56689 - DNA, 20 bp, Hepatitis C virus
tggggcctgctcgttgtgtg

SEQ ID NO: 56690 - DNA, 20 bp, Hepatitis C virus
tgtgcttggcttggcatgtc

SEQ ID NO: 56691 - DNA, 20 bp, Hepatitis C virus
gcttggcatgtcaagggcag

SEQ ID NO: 56692 - DNA, 20 bp, Hepatitis C virus
caggttaagggtggtcgtga

SEQ ID NO: 56693 - DNA, 20 bp, Hepatitis C virus
agggtggtcgtgacgctgtc

SEQ ID NO: 56694 - DNA, 20 bp, Hepatitis C virus
caccctgccttggggtttga

SEQ ID NO: 56695 - DNA, 20 bp, Hepatitis C virus
gggtttgagatcacaaaaat

SEQ ID NO: 56696 - DNA, 20 bp, Hepatitis C virus
ttgtgatctcaaaccccaag

SEQ ID NO: 56697 - DNA, 20 bp, Hepatitis C virus
acggtggccacagaacccat

SEQ ID NO: 56698 - DNA, 20 bp, Hepatitis C virus
tccgcgatggagacgaaggt

SEQ ID NO: 56699 - DNA, 20 bp, Hepatitis C virus
ccacacgcggccgtgtcagc

SEQ ID NO: 56700 - DNA, 20 bp, Hepatitis C virus
gtctccatcgcggagaatac

SEQ ID NO: 56701 - DNA, 20 bp, Hepatitis C virus
tgtggccaccgttaattcgc

SEQ ID NO: 56702 - DNA, 20 bp, Hepatitis C virus
cttggcatttgtatcaatgg

SEQ ID NO: 56703 - DNA, 20 bp, Hepatitis C virus
ttggcatttgtatcaatgga

SEQ ID NO: 56704 - DNA, 20 bp, Hepatitis C virus
gcatttgtatcaatggagtg

SEQ ID NO: 56705 - DNA, 20 bp, Hepatitis C virus
gtatcaatggagtgatgtgg

SEQ ID NO: 56706 - DNA, 20 bp, Hepatitis C virus
tatcaatggagtgatgtgga

SEQ ID NO: 56707 - DNA, 20 bp, Hepatitis C virus
cgggcatgtggtaggtgttt

SEQ ID NO: 56708 - DNA, 20 bp, Hepatitis C virus
tcagggccgccgtgtgcacg

SEQ ID NO: 56709 - DNA, 20 bp, Hepatitis C virus
cagggccgccgtgtgcacgc

SEQ ID NO: 56710 - DNA, 20 bp, Hepatitis C virus
agggccgccgtgtgcacgcg

SEQ ID NO: 56711 - DNA, 20 bp, Hepatitis C virus
cgaaggcgctcgagttcgtc

SEQ ID NO: 56712 - DNA, 20 bp, Hepatitis C virus
ggactgtcaccaccggagcc

SEQ ID NO: 56713 - DNA, 20 bp, Hepatitis C virus
ccataagtagagtatgttat

SEQ ID NO: 56714 - DNA, 20 bp, Hepatitis C virus
taccggctccggtggtgaca

SEQ ID NO: 56715 - DNA, 20 bp, Hepatitis C virus
gggtccacgccgtatgctct

SEQ ID NO: 56716 - DNA, 20 bp, Hepatitis C virus
tgccactctaagaaaaaatg

SEQ ID NO: 56717 - DNA, 20 bp, Hepatitis C virus
ccaaacaattgaccagtctg

SEQ ID NO: 56718 - DNA, 20 bp, Hepatitis C virus
accagtctgggcgtgaatgc

SEQ ID NO: 56719 - DNA, 20 bp, Hepatitis C virus
tagaggtctagacgtcgccg

SEQ ID NO: 56720 - DNA, 20 bp, Hepatitis C virus
acgcccagactggtcaattg

SEQ ID NO: 56721 - DNA, 20 bp, Hepatitis C virus
cgtctggggagagaccgtcc

SEQ ID NO: 56722 - DNA, 20 bp, Hepatitis C virus
gtctggggagagaccgtccg

SEQ ID NO: 56723 - DNA, 20 bp, Hepatitis C virus
aactggccccactcccctcc

SEQ ID NO: 56724 - DNA, 20 bp, Hepatitis C virus
actggccccactcccctcct

SEQ ID NO: 56725 - DNA, 20 bp, Hepatitis C virus
agaatgagatcacactgaca

SEQ ID NO: 56726 - DNA, 20 bp, Hepatitis C virus
gtgatggggtgtgtcagtgt

SEQ ID NO: 56727 - DNA, 20 bp, Hepatitis C virus
tgaacggcccccagcctgta

SEQ ID NO: 56728 - DNA, 20 bp, Hepatitis C virus
atgtctttcaccgccgcggt

SEQ ID NO: 56729 - DNA, 20 bp, Hepatitis C virus
caccgccgcggtgacctccc

SEQ ID NO: 56730 - DNA, 20 bp, Hepatitis C virus
accgccgcggtgacctcccc

SEQ ID NO: 56731 - DNA, 20 bp, Hepatitis C virus
caacacatcagaccctcctt

SEQ ID NO: 56732 - DNA, 20 bp, Hepatitis C virus
ttaatattctaggagggtgg

SEQ ID NO: 56733 - DNA, 20 bp, Hepatitis C virus
gtgtcatatgcgccgccgtt

SEQ ID NO: 56734 - DNA, 20 bp, Hepatitis C virus
tgcggcgccacattggccca

SEQ ID NO: 56735 - DNA, 20 bp, Hepatitis C virus
gcccaggcgagggggctgta

SEQ ID NO: 56736 - DNA, 20 bp, Hepatitis C virus
atccactgtacagccccctc

SEQ ID NO: 56737 - DNA, 20 bp, Hepatitis C virus
ttctcatgccagaaggggta

SEQ ID NO: 56738 - DNA, 20 bp, Hepatitis C virus
tcatgccagaaggggtacaa

SEQ ID NO: 56739 - DNA, 20 bp, Hepatitis C virus
gtggagttcactccatcccc

SEQ ID NO: 56740 - DNA, 20 bp, Hepatitis C virus
actccatccccgcgccatac

SEQ ID NO: 56741 - DNA, 20 bp, Hepatitis C virus
taccccttctggcatgagaa

SEQ ID NO: 56742 - DNA, 20 bp, Hepatitis C virus
ttcacggagctggatggcgt

SEQ ID NO: 56743 - DNA, 20 bp, Hepatitis C virus
acggagctggatggcgtgag

SEQ ID NO: 56744 - DNA, 20 bp, Hepatitis C virus
accgcttcgcgccaccctgt

SEQ ID NO: 56745 - DNA, 20 bp, Hepatitis C virus
gcgccaccctgtaaccccct

SEQ ID NO: 56746 - DNA, 20 bp, Hepatitis C virus
ggagggggttacagggtggc

SEQ ID NO: 56747 - DNA, 20 bp, Hepatitis C virus
gcctttatgaggtctgcatc

SEQ ID NO: 56748 - DNA, 20 bp, Hepatitis C virus
atgaggtctgcatctgggtg

SEQ ID NO: 56749 - DNA, 20 bp, Hepatitis C virus
tgaggtctgcatctgggtgg

SEQ ID NO: 56750 - DNA, 20 bp, Hepatitis C virus
tatagtgcaggtggccttga

SEQ ID NO: 56751 - DNA, 20 bp, Hepatitis C virus
agagagggggctgagagctg

SEQ ID NO: 56752 - DNA, 20 bp, Hepatitis C virus
tgacccccctcaggtgtggg

SEQ ID NO: 56753 - DNA, 20 bp, Hepatitis C virus
cgcggaggaaaaggaagcca

SEQ ID NO: 56754 - DNA, 20 bp, Hepatitis C virus
cattggcttccttttcctcc

SEQ ID NO: 56755 - DNA, 20 bp, Hepatitis C virus
gcttccttttcctccgcgga

SEQ ID NO: 56756 - DNA, 20 bp, Hepatitis C virus
cttttcctccgcggaagcgg

SEQ ID NO: 56757 - DNA, 20 bp, Hepatitis C virus
ctccatgtcatacacctgga

SEQ ID NO: 56758 - DNA, 20 bp, Hepatitis C virus
ctctgctgaagaggaaaaat

SEQ ID NO: 56759 - DNA, 20 bp, Hepatitis C virus
agggattgatgggtaatttt

SEQ ID NO: 56760 - DNA, 20 bp, Hepatitis C virus
atgggtaatttttcctcttc

SEQ ID NO: 56761 - DNA, 20 bp, Hepatitis C virus
ttcctcttcagcagagcaag

SEQ ID NO: 56762 - DNA, 20 bp, Hepatitis C virus
acaccaccccactccgcccg

SEQ ID NO: 56763 - DNA, 20 bp, Hepatitis C virus
caagtacggatacggcgcga

SEQ ID NO: 56764 - DNA, 20 bp, Hepatitis C virus
gctctctcgacaagaaagcc

SEQ ID NO: 56765 - DNA, 20 bp, Hepatitis C virus
agcacatagagggtgtgtgg

SEQ ID NO: 56766 - DNA, 20 bp, Hepatitis C virus
ccacacaccctctatgtgct

SEQ ID NO: 56767 - DNA, 20 bp, Hepatitis C virus
tggccatctgcgagagccag

SEQ ID NO: 56768 - DNA, 20 bp, Hepatitis C virus
atcttcgtgtgtcccctggc

SEQ ID NO: 56769 - DNA, 20 bp, Hepatitis C virus
gtgtgtcccctggctctcgc

SEQ ID NO: 56770 - DNA, 20 bp, Hepatitis C virus
tgggctcggatagtgctgat

SEQ ID NO: 56771 - DNA, 20 bp, Hepatitis C virus
ttcagcgttctacagagcca

SEQ ID NO: 56772 - DNA, 20 bp, Hepatitis C virus
tcagcgttctacagagccag

SEQ ID NO: 56773 - DNA, 20 bp, Hepatitis C virus
cagcgttctacagagccagg

SEQ ID NO: 56774 - DNA, 20 bp, Hepatitis C virus
agcgttctacagagccagga

SEQ ID NO: 56775 - DNA, 20 bp, Hepatitis C virus
aactgggcggtgaagacaaa

SEQ ID NO: 56776 - DNA, 20 bp, Hepatitis C virus
gcgttttgtcttcaccgccc

SEQ ID NO: 56777 - DNA, 20 bp, Hepatitis C virus
cgttttgtcttcaccgccca

SEQ ID NO: 56778 - DNA, 20 bp, Hepatitis C virus
tgtcttcaccgcccagttga

SEQ ID NO: 56779 - DNA, 20 bp, Hepatitis C virus
gtcttcaccgcccagttgaa

SEQ ID NO: 56780 - DNA, 20 bp, Coronavirus
aaaatctgtgtagctgtcgc

SEQ ID NO: 56781 - DNA, 20 bp, Coronavirus
aaatctgtgtagctgtcgct

SEQ ID NO: 56782 - DNA, 20 bp, Coronavirus
tactgtcgttgacaagaaac

SEQ ID NO: 56783 - DNA, 20 bp, Coronavirus
actgtcgttgacaagaaacg

SEQ ID NO: 56784 - DNA, 20 bp, Coronavirus
ctgtcgttgacaagaaacga

SEQ ID NO: 56785 - DNA, 20 bp, Coronavirus
ggggactctgtggaagaggc

SEQ ID NO: 56786 - DNA, 20 bp, Coronavirus
tggtctagtagagctggaaa

SEQ ID NO: 56787 - DNA, 20 bp, Coronavirus
aacagccctatgtgttcatt

SEQ ID NO: 56788 - DNA, 20 bp, Coronavirus
attaaacgttctgatgcctt

SEQ ID NO: 56789 - DNA, 20 bp, Coronavirus
aggcatcagaacgtttaatg

SEQ ID NO: 56790 - DNA, 20 bp, Coronavirus
caaaggggaatgcccaaagt

SEQ ID NO: 56791 - DNA, 20 bp, Coronavirus
aaaggggaatgcccaaagtt

SEQ ID NO: 56792 - DNA, 20 bp, Coronavirus
gtgtttcctcttaactcaaa

SEQ ID NO: 56793 - DNA, 20 bp, Coronavirus
tgtttcctcttaactcaaaa

SEQ ID NO: 56794 - DNA, 20 bp, Coronavirus
cctcttaactcaaaagtcaa

SEQ ID NO: 56795 - DNA, 20 bp, Coronavirus
tggaggctgtgtgtttgcct

SEQ ID NO: 56796 - DNA, 20 bp, Coronavirus
ggaggctgtgtgtttgccta

SEQ ID NO: 56797 - DNA, 20 bp, Coronavirus
gaggctgtgtgtttgcctat

SEQ ID NO: 56798 - DNA, 20 bp, Coronavirus
gcctatgttggctgctataa

SEQ ID NO: 56799 - DNA, 20 bp, Coronavirus
cctatgttggctgctataat

SEQ ID NO: 56800 - DNA, 20 bp, Coronavirus
ccaagggaaagcccgtaaaa

SEQ ID NO: 56801 - DNA, 20 bp, Coronavirus
gaacattggacaacagagat

SEQ ID NO: 56802 - DNA, 20 bp, Coronavirus
gacaacagagatcagtttta

SEQ ID NO: 56803 - DNA, 20 bp, Coronavirus
taacaccactgtgtggtttt

SEQ ID NO: 56804 - DNA, 20 bp, Coronavirus
aacaccactgtgtggttttc

SEQ ID NO: 56805 - DNA, 20 bp, Coronavirus
agacctgctcaccaacagtg

SEQ ID NO: 56806 - DNA, 20 bp, Coronavirus
ttatggcatatgtaactggt

SEQ ID NO: 56807 - DNA, 20 bp, Coronavirus
tggcatatgtaactggtggt

SEQ ID NO: 56808 - DNA, 20 bp, Coronavirus
tacaacagacttctcagtgg

SEQ ID NO: 56809 - DNA, 20 bp, Coronavirus
tcagtggttgtctaatcttt

SEQ ID NO: 56810 - DNA, 20 bp, Coronavirus
atcaagtcactatcgctggc

SEQ ID NO: 56811 - DNA, 20 bp, Coronavirus
cgatcactcaacttaggtga

SEQ ID NO: 56812 - DNA, 20 bp, Coronavirus
ggtgaagtcttcatcgctca

SEQ ID NO: 56813 - DNA, 20 bp, Coronavirus
atcgctcaaagcaagggact

SEQ ID NO: 56814 - DNA, 20 bp, Coronavirus
accgtcagtgtatacgtggc

SEQ ID NO: 56815 - DNA, 20 bp, Coronavirus
gagattaaggacaaagaaca

SEQ ID NO: 56816 - DNA, 20 bp, Coronavirus
aggacaaagaacaatactgc

SEQ ID NO: 56817 - DNA, 20 bp, Coronavirus
tctcctggtttactggctac

SEQ ID NO: 56818 - DNA, 20 bp, Coronavirus
actggctacaaacaatgtct

SEQ ID NO: 56819 - DNA, 20 bp, Coronavirus
ctggctacaaacaatgtctt

SEQ ID NO: 56820 - DNA, 20 bp, Coronavirus
cttttaccctccagatgagg

SEQ ID NO: 56821 - DNA, 20 bp, Coronavirus
taccctccagatgaggaaga

SEQ ID NO: 56822 - DNA, 20 bp, Coronavirus
accctccagatgaggaagaa

SEQ ID NO: 56823 - DNA, 20 bp, Coronavirus
ccctccagatgaggaagaag

SEQ ID NO: 56824 - DNA, 20 bp, Coronavirus
atgaaacctgtgaacatgag

SEQ ID NO: 56825 - DNA, 20 bp, Coronavirus
taaatgctgctaacatacac

SEQ ID NO: 56826 - DNA, 20 bp, Coronavirus
gttgccttgttgagtgcacc

SEQ ID NO: 56827 - DNA, 20 bp, Coronavirus
ccttgttgagtgcacctgct

SEQ ID NO: 56828 - DNA, 20 bp, Coronavirus
ttgagtgcacctgctacacc

SEQ ID NO: 56829 - DNA, 20 bp, Coronavirus
agtgcacctgctacaccacc

SEQ ID NO: 56830 - DNA, 20 bp, Coronavirus
caccattgttgtcagcaggc

SEQ ID NO: 56831 - DNA, 20 bp, Coronavirus
ttgtcagcaggcatatttgg

SEQ ID NO: 56832 - DNA, 20 bp, Coronavirus
tcagcaggcatatttggtgc

SEQ ID NO: 56833 - DNA, 20 bp, Coronavirus
ggtgctaaaccacttcagtc

SEQ ID NO: 56834 - DNA, 20 bp, Coronavirus
gtgctaaaccacttcagtct

SEQ ID NO: 56835 - DNA, 20 bp, Coronavirus
ccttgagaaggatgcacctt

SEQ ID NO: 56836 - DNA, 20 bp, Coronavirus
cttgagaaggatgcacctta

SEQ ID NO: 56837 - DNA, 20 bp, Coronavirus
agaaggatgcaccttacatg

SEQ ID NO: 56838 - DNA, 20 bp, Coronavirus
catggtaggtgatgttatca

SEQ ID NO: 56839 - DNA, 20 bp, Coronavirus
tcactagtggtgatatcact

SEQ ID NO: 56840 - DNA, 20 bp, Coronavirus
ctcatgctgaagagacaaga

SEQ ID NO: 56841 - DNA, 20 bp, Coronavirus
atgcctatatgcatggatgt

SEQ ID NO: 56842 - DNA, 20 bp, Coronavirus
gagccataatggcaaccatc

SEQ ID NO: 56843 - DNA, 20 bp, Coronavirus
aattttaattcctttatact

SEQ ID NO: 56844 - DNA, 20 bp, Coronavirus
taattcctttatacttacgt

SEQ ID NO: 56845 - DNA, 20 bp, Coronavirus
ctacatataatggatacctc

SEQ ID NO: 56846 - DNA, 20 bp, Coronavirus
gtcatcaaagacatctgagg

SEQ ID NO: 56847 - DNA, 20 bp, Coronavirus
gtagaaacagtttctttggc

SEQ ID NO: 56848 - DNA, 20 bp, Coronavirus
tagaaacagtttctttggct

SEQ ID NO: 56849 - DNA, 20 bp, Coronavirus
ctacaaagtgctcctcagat

SEQ ID NO: 56850 - DNA, 20 bp, Coronavirus
ctttgtactacctagtgatg

SEQ ID NO: 56851 - DNA, 20 bp, Coronavirus
tttgtactacctagtgatga

SEQ ID NO: 56852 - DNA, 20 bp, Coronavirus
gtactacctagtgatgacac

SEQ ID NO: 56853 - DNA, 20 bp, Coronavirus
tactacctagtgatgacaca

SEQ ID NO: 56854 - DNA, 20 bp, Coronavirus
cgagtactaccatactcttg

SEQ ID NO: 56855 - DNA, 20 bp, Coronavirus
ttaatgtggtgtgtaaacat

SEQ ID NO: 56856 - DNA, 20 bp, Coronavirus
atgtggtgtgtaaacattgt

SEQ ID NO: 56857 - DNA, 20 bp, Coronavirus
tggtcagaaaactactacct

SEQ ID NO: 56858 - DNA, 20 bp, Coronavirus
acgggtgtagaagctgtgat

SEQ ID NO: 56859 - DNA, 20 bp, Coronavirus
tgataatcttaagacaggtg

SEQ ID NO: 56860 - DNA, 20 bp, Coronavirus
acggagctcaccttacaaag

SEQ ID NO: 56861 - DNA, 20 bp, Coronavirus
caaagatgtcagagtacaaa

SEQ ID NO: 56862 - DNA, 20 bp, Coronavirus
tctacaaggaaacatcttac

SEQ ID NO: 56863 - DNA, 20 bp, Coronavirus
ctacaaggaaacatcttaca

SEQ ID NO: 56864 - DNA, 20 bp, Coronavirus
tacaaggaaacatcttacac

SEQ ID NO: 56865 - DNA, 20 bp, Coronavirus
ttcccagacttgaatggcga

SEQ ID NO: 56866 - DNA, 20 bp, Coronavirus
ccagacttgaatggcgatgt

SEQ ID NO: 56867 - DNA, 20 bp, Coronavirus
aatggcgatgtagtggctat

SEQ ID NO: 56868 - DNA, 20 bp, Coronavirus
actatagacactattcagcg

SEQ ID NO: 56869 - DNA, 20 bp, Coronavirus
agcgagtttcaagaaaggtg

SEQ ID NO: 56870 - DNA, 20 bp, Coronavirus
taggcaatgtcatacttaaa

SEQ ID NO: 56871 - DNA, 20 bp, Coronavirus
aaccatcagatgaaggtgtt

SEQ ID NO: 56872 - DNA, 20 bp, Coronavirus
aagtaacacaagagttaggt

SEQ ID NO: 56873 - DNA, 20 bp, Coronavirus
ggtcatgaggatcttatggc

SEQ ID NO: 56874 - DNA, 20 bp, Coronavirus
tggctgcttatgtggaaaac

SEQ ID NO: 56875 - DNA, 20 bp, Coronavirus
gagaattgtatcttaattcg

SEQ ID NO: 56876 - DNA, 20 bp, Coronavirus
tatcttaattcgtctaacgt

SEQ ID NO: 56877 - DNA, 20 bp, Coronavirus
attcgtctaacgttactact

SEQ ID NO: 56878 - DNA, 20 bp, Coronavirus
gtctaacgttactactatgg

SEQ ID NO: 56879 - DNA, 20 bp, Coronavirus
ctactatggatttctgtgaa

SEQ ID NO: 56880 - DNA, 20 bp, Coronavirus
atcattagtattgtacaaat

SEQ ID NO: 56881 - DNA, 20 bp, Coronavirus
tcattagtattgtacaaatg

SEQ ID NO: 56882 - DNA, 20 bp, Coronavirus
gtattgtacaaatggcaccc

SEQ ID NO: 56883 - DNA, 20 bp, Coronavirus
tacaaatggcacccgtttct

SEQ ID NO: 56884 - DNA, 20 bp, Coronavirus
ctgcaatggttaggatgtac

SEQ ID NO: 56885 - DNA, 20 bp, Coronavirus
gtcactccagtttaaaagac

SEQ ID NO: 56886 - DNA, 20 bp, Coronavirus
tcactccagtttaaaagacc

SEQ ID NO: 56887 - DNA, 20 bp, Coronavirus
aaaagaccaatcaaccctac

SEQ ID NO: 56888 - DNA, 20 bp, Coronavirus
aaagaccaatcaaccctact

SEQ ID NO: 56889 - DNA, 20 bp, Coronavirus
ttgatagtgttgctgtgaaa

SEQ ID NO: 56890 - DNA, 20 bp, Coronavirus
tgtcgacaccttttcagcaa

SEQ ID NO: 56891 - DNA, 20 bp, Coronavirus
tcagcaacttttagtgttcc

SEQ ID NO: 56892 - DNA, 20 bp, Coronavirus
cagcaacttttagtgttcct

SEQ ID NO: 56893 - DNA, 20 bp, Coronavirus
agcaacttttagtgttccta

SEQ ID NO: 56894 - DNA, 20 bp, Coronavirus
tagtgttcctatggaaaaac

SEQ ID NO: 56895 - DNA, 20 bp, Coronavirus
cactcatctggaatgtaaaa

SEQ ID NO: 56896 - DNA, 20 bp, Coronavirus
actcatctggaatgtaaaag

SEQ ID NO: 56897 - DNA, 20 bp, Coronavirus
atctgaacagctgcgtaaac

SEQ ID NO: 56898 - DNA, 20 bp, Coronavirus
tctgaacagctgcgtaaaca

SEQ ID NO: 56899 - DNA, 20 bp, Coronavirus
gtagtgctgccaagaagaac

SEQ ID NO: 56900 - DNA, 20 bp, Coronavirus
aggatggtgtcactcgtgac

SEQ ID NO: 56901 - DNA, 20 bp, Coronavirus
ctactgatgattgttttgca

SEQ ID NO: 56902 - DNA, 20 bp, Coronavirus
tactgatgattgttttgcaa

SEQ ID NO: 56903 - DNA, 20 bp, Coronavirus
ttttgcaaataaacatgctg

SEQ ID NO: 56904 - DNA, 20 bp, Coronavirus
tgcaaataaacatgctggtt

SEQ ID NO: 56905 - DNA, 20 bp, Coronavirus
ttatgacactaatttgctag

SEQ ID NO: 56906 - DNA, 20 bp, Coronavirus
tgacactaatttgctagagg

SEQ ID NO: 56907 - DNA, 20 bp, Coronavirus
gctagagggttctatttctt

SEQ ID NO: 56908 - DNA, 20 bp, Coronavirus
ctagagggttctatttctta

SEQ ID NO: 56909 - DNA, 20 bp, Coronavirus
tatttcttatagtgagcttc

SEQ ID NO: 56910 - DNA, 20 bp, Coronavirus
agatgtgtctgcttcagtag

SEQ ID NO: 56911 - DNA, 20 bp, Coronavirus
gatgtgtctgcttcagtagt

SEQ ID NO: 56912 - DNA, 20 bp, Coronavirus
agtagtggctggtggtatta

SEQ ID NO: 56913 - DNA, 20 bp, Coronavirus
ttgccatattggtgacttgt

SEQ ID NO: 56914 - DNA, 20 bp, Coronavirus
ccatattggtgacttgtgct

SEQ ID NO: 56915 - DNA, 20 bp, Coronavirus
gtgtacctttttgctcaaca

SEQ ID NO: 56916 - DNA, 20 bp, Coronavirus
tgtacctttttgctcaacaa

SEQ ID NO: 56917 - DNA, 20 bp, Coronavirus
ttgctcaacaaggaaatgta

SEQ ID NO: 56918 - DNA, 20 bp, Coronavirus
tgctcaacaaggaaatgtac

SEQ ID NO: 56919 - DNA, 20 bp, Coronavirus
gctcaacaaggaaatgtacc

SEQ ID NO: 56920 - DNA, 20 bp, Coronavirus
tgctgttctgcagagtggtt

SEQ ID NO: 56921 - DNA, 20 bp, Coronavirus
tgcagagtggttttaggaaa

SEQ ID NO: 56922 - DNA, 20 bp, Coronavirus
taggaaaatggcattcccgt

SEQ ID NO: 56923 - DNA, 20 bp, Coronavirus
aggaaaatggcattcccgtc

SEQ ID NO: 56924 - DNA, 20 bp, Coronavirus
ggaaaatggcattcccgtca

SEQ ID NO: 56925 - DNA, 20 bp, Coronavirus
aagttgatacttctaaccct

SEQ ID NO: 56926 - DNA, 20 bp, Coronavirus
atacttctaaccctaagaca

SEQ ID NO: 56927 - DNA, 20 bp, Coronavirus
taaccctaagacacccaagt

SEQ ID NO: 56928 - DNA, 20 bp, Coronavirus
gtccgtatccaacctggtca

SEQ ID NO: 56929 - DNA, 20 bp, Coronavirus
tccgtatccaacctggtcaa

SEQ ID NO: 56930 - DNA, 20 bp, Coronavirus
aaccttgtggcaatgaagta

SEQ ID NO: 56931 - DNA, 20 bp, Coronavirus
accttgtggcaatgaagtac

SEQ ID NO: 56932 - DNA, 20 bp, Coronavirus
tggcaatgaagtacaactat

SEQ ID NO: 56933 - DNA, 20 bp, Coronavirus
gacacaagatcatgttgaca

SEQ ID NO: 56934 - DNA, 20 bp, Coronavirus
acacaagatcatgttgacat

SEQ ID NO: 56935 - DNA, 20 bp, Coronavirus
cttgacatcactattgattc

SEQ ID NO: 56936 - DNA, 20 bp, Coronavirus
ttgacatcactattgattct

SEQ ID NO: 56937 - DNA, 20 bp, Coronavirus
acatcactattgattcttgt

SEQ ID NO: 56938 - DNA, 20 bp, Coronavirus
attcttgttcaaagtacaca

SEQ ID NO: 56939 - DNA, 20 bp, Coronavirus
ttgttcaaagtacacagtgg

SEQ ID NO: 56940 - DNA, 20 bp, Coronavirus
ccatgtgggccttagttatt

SEQ ID NO: 56941 - DNA, 20 bp, Coronavirus
catgtgggccttagttattt

SEQ ID NO: 56942 - DNA, 20 bp, Coronavirus
gttatttctgtaacctctaa

SEQ ID NO: 56943 - DNA, 20 bp, Coronavirus
tttctgtaacctctaactat

SEQ ID NO: 56944 - DNA, 20 bp, Coronavirus
ctgtaacctctaactattct

SEQ ID NO: 56945 - DNA, 20 bp, Coronavirus
tgcctcctaagagtagtatt

SEQ ID NO: 56946 - DNA, 20 bp, Coronavirus
gcctcctaagagtagtattg

SEQ ID NO: 56947 - DNA, 20 bp, Coronavirus
cctcctaagagtagtattga

SEQ ID NO: 56948 - DNA, 20 bp, Coronavirus
atgctttcaagcttaacatt

SEQ ID NO: 56949 - DNA, 20 bp, Coronavirus
caagcttaacattaagttgt

SEQ ID NO: 56950 - DNA, 20 bp, Coronavirus
tgctatccatgcagggtgct

SEQ ID NO: 56951 - DNA, 20 bp, Coronavirus
gctatccatgcagggtgctg

SEQ ID NO: 56952 - DNA, 20 bp, Coronavirus
ctatccatgcagggtgctgt

SEQ ID NO: 56953 - DNA, 20 bp, Coronavirus
ataggttgtgcgaggaaatg

SEQ ID NO: 56954 - DNA, 20 bp, Coronavirus
tgcgaggaaatgctcgataa

SEQ ID NO: 56955 - DNA, 20 bp, Coronavirus
actatgcttaggaagcttga

SEQ ID NO: 56956 - DNA, 20 bp, Coronavirus
ggaagcttgataatgatgca

SEQ ID NO: 56957 - DNA, 20 bp, Coronavirus
agtgcatcattatcaagctt

SEQ ID NO: 56958 - DNA, 20 bp, Coronavirus
tcaagcttcctaagcatagt

SEQ ID NO: 56959 - DNA, 20 bp, Coronavirus
ctaagcatagtgaagagcat

SEQ ID NO: 56960 - DNA, 20 bp, Coronavirus
aactacagaataatgaactg

SEQ ID NO: 56961 - DNA, 20 bp, Coronavirus
tcatcagtacaagctgtttg

SEQ ID NO: 56962 - DNA, 20 bp, Coronavirus
gtgtggtaccagccgcacag

SEQ ID NO: 56963 - DNA, 20 bp, Coronavirus
tgtggtaccagccgcacagg

SEQ ID NO: 56964 - DNA, 20 bp, Coronavirus
attattctgtagtttaacag

SEQ ID NO: 56965 - DNA, 20 bp, Coronavirus
agctgctacagtacgtcttc

SEQ ID NO: 56966 - DNA, 20 bp, Coronavirus
gctgctacagtacgtcttca

SEQ ID NO: 56967 - DNA, 20 bp, Coronavirus
aggctggaaatgctacagaa

SEQ ID NO: 56968 - DNA, 20 bp, Coronavirus
aactgtgctttccttctgtg

SEQ ID NO: 56969 - DNA, 20 bp, Coronavirus
ccttctgtgcttttgcagta

SEQ ID NO: 56970 - DNA, 20 bp, Coronavirus
tgctaatgacccagtgggtt

SEQ ID NO: 56971 - DNA, 20 bp, Coronavirus
tacacttagaaacacagtct

SEQ ID NO: 56972 - DNA, 20 bp, Coronavirus
acacttagaaacacagtctg

SEQ ID NO: 56973 - DNA, 20 bp, Coronavirus
cacttagaaacacagtctgt

SEQ ID NO: 56974 - DNA, 20 bp, Coronavirus
gaaacacagtctgtaccgtc

SEQ ID NO: 56975 - DNA, 20 bp, Coronavirus
ctgtccatgactttttcaag

SEQ ID NO: 56976 - DNA, 20 bp, Coronavirus
ttcaagtttagagtagatgg

SEQ ID NO: 56977 - DNA, 20 bp, Coronavirus
tcaagtttagagtagatggt

SEQ ID NO: 56978 - DNA, 20 bp, Coronavirus
caagtttagagtagatggtg

SEQ ID NO: 56979 - DNA, 20 bp, Coronavirus
aagtttagagtagatggtga

SEQ ID NO: 56980 - DNA, 20 bp, Coronavirus
tgcgatgctatgcgtgatgc

SEQ ID NO: 56981 - DNA, 20 bp, Coronavirus
taggcgtactgacattagat

SEQ ID NO: 56982 - DNA, 20 bp, Coronavirus
gataatcaggatcttaatgg

SEQ ID NO: 56983 - DNA, 20 bp, Coronavirus
atgggaactggtacgatttc

SEQ ID NO: 56984 - DNA, 20 bp, Coronavirus
cggtgatttcgtacaagtag

SEQ ID NO: 56985 - DNA, 20 bp, Coronavirus
ggaccagacataccatccca

SEQ ID NO: 56986 - DNA, 20 bp, Coronavirus
tattaactgtttggatgata

SEQ ID NO: 56987 - DNA, 20 bp, Coronavirus
actgtttggatgataggtgt

SEQ ID NO: 56988 - DNA, 20 bp, Coronavirus
ggatgataggtgtatccttc

SEQ ID NO: 56989 - DNA, 20 bp, Coronavirus
gatgataggtgtatccttca

SEQ ID NO: 56990 - DNA, 20 bp, Coronavirus
tcagtagctgcactaacaaa

SEQ ID NO: 56991 - DNA, 20 bp, Coronavirus
cagtagctgcactaacaaac

SEQ ID NO: 56992 - DNA, 20 bp, Coronavirus
agtagctgcactaacaaaca

SEQ ID NO: 56993 - DNA, 20 bp, Coronavirus
cttttcaaactgtcaaaccc

SEQ ID NO: 56994 - DNA, 20 bp, Coronavirus
tcaaactgtcaaacccggta

SEQ ID NO: 56995 - DNA, 20 bp, Coronavirus
gtgcaaagaatagagctcgc

SEQ ID NO: 56996 - DNA, 20 bp, Coronavirus
catcagaaattattgaagtc

SEQ ID NO: 56997 - DNA, 20 bp, Coronavirus
atcagaaattattgaagtca

SEQ ID NO: 56998 - DNA, 20 bp, Coronavirus
ttgaagtcaatagccgccac

SEQ ID NO: 56999 - DNA, 20 bp, Coronavirus
aagtcaatagccgccactag

SEQ ID NO: 57000 - DNA, 20 bp, Coronavirus
ctgtaacttatcacaccgtt

SEQ ID NO: 57001 - DNA, 20 bp, Coronavirus
tcacaccgtttctacaggtt

SEQ ID NO: 57002 - DNA, 20 bp, Coronavirus
ctacaggttagctaacgagt

SEQ ID NO: 57003 - DNA, 20 bp, Coronavirus
tacaggttagctaacgagtg

SEQ ID NO: 57004 - DNA, 20 bp, Coronavirus
gctaacgagtgtgcgcaagt

SEQ ID NO: 57005 - DNA, 20 bp, Coronavirus
tacgcttacctgcgtaaaca

SEQ ID NO: 57006 - DNA, 20 bp, Coronavirus
acgcttacctgcgtaaacat

SEQ ID NO: 57007 - DNA, 20 bp, Coronavirus
cgcttacctgcgtaaacatt

SEQ ID NO: 57008 - DNA, 20 bp, Coronavirus
cctgcgtaaacatttctcca

SEQ ID NO: 57009 - DNA, 20 bp, Coronavirus
ctccatgatgattctttctg

SEQ ID NO: 57010 - DNA, 20 bp, Coronavirus
atgcttacccacttacaaaa

SEQ ID NO: 57011 - DNA, 20 bp, Coronavirus
cccacttacaaaacatccta

SEQ ID NO: 57012 - DNA, 20 bp, Coronavirus
caaaacatcctaatcaggag

SEQ ID NO: 57013 - DNA, 20 bp, Coronavirus
cacttgtatttacaatacat

SEQ ID NO: 57014 - DNA, 20 bp, Coronavirus
acttgtatttacaatacatt

SEQ ID NO: 57015 - DNA, 20 bp, Coronavirus
caacatcacacaaattagtg

SEQ ID NO: 57016 - DNA, 20 bp, Coronavirus
aacatcacacaaattagtgt

SEQ ID NO: 57017 - DNA, 20 bp, Coronavirus
gtgttgtctgttaatcccta

SEQ ID NO: 57018 - DNA, 20 bp, Coronavirus
tctgttaatccctatgtttg

SEQ ID NO: 57019 - DNA, 20 bp, Coronavirus
atccctatgtttgcaatgcc

SEQ ID NO: 57020 - DNA, 20 bp, Coronavirus
tcgcagcagaaacgctcaaa

SEQ ID NO: 57021 - DNA, 20 bp, Coronavirus
cgcagcagaaacgctcaaag

SEQ ID NO: 57022 - DNA, 20 bp, Coronavirus
gcagcagaaacgctcaaagc

SEQ ID NO: 57023 - DNA, 20 bp, Coronavirus
aagctgtcatatggtattgc

SEQ ID NO: 57024 - DNA, 20 bp, Coronavirus
agctgtcatatggtattgcc

SEQ ID NO: 57025 - DNA, 20 bp, Coronavirus
ctggcttgtacccaacactc

SEQ ID NO: 57026 - DNA, 20 bp, Coronavirus
tacccaacactcaacatctc

SEQ ID NO: 57027 - DNA, 20 bp, Coronavirus
tctagcaatgttgcaaatta

SEQ ID NO: 57028 - DNA, 20 bp, Coronavirus
ctagcaatgttgcaaattat

SEQ ID NO: 57029 - DNA, 20 bp, Coronavirus
tagcaatgttgcaaattatc

SEQ ID NO: 57030 - DNA, 20 bp, Coronavirus
tagtctttgatgaaatctct

SEQ ID NO: 57031 - DNA, 20 bp, Coronavirus
gatgaaatctctatggctac

SEQ ID NO: 57032 - DNA, 20 bp, Coronavirus
atgaaatctctatggctact

SEQ ID NO: 57033 - DNA, 20 bp, Coronavirus
tgacttgagtgttgtcaatg

SEQ ID NO: 57034 - DNA, 20 bp, Coronavirus
agtgttgtcaatgctagact

SEQ ID NO: 57035 - DNA, 20 bp, Coronavirus
aaaatgttctacaaaggtgt

SEQ ID NO: 57036 - DNA, 20 bp, Coronavirus
tacaaaggtgttattacaca

SEQ ID NO: 57037 - DNA, 20 bp, Coronavirus
ttacacatgatgtttcatct

SEQ ID NO: 57038 - DNA, 20 bp, Coronavirus
cacatgatgtttcatctgca

SEQ ID NO: 57039 - DNA, 20 bp, Coronavirus
catctgcaatcaacagacct

SEQ ID NO: 57040 - DNA, 20 bp, Coronavirus
atgacaaactgcaatttaca

SEQ ID NO: 57041 - DNA, 20 bp, Coronavirus
tgacaaactgcaatttacaa

SEQ ID NO: 57042 - DNA, 20 bp, Coronavirus
acaagtctagaaataccacg

SEQ ID NO: 57043 - DNA, 20 bp, Coronavirus
caagtctagaaataccacgt

SEQ ID NO: 57044 - DNA, 20 bp, Coronavirus
caagcagaaaatgtaactgg

SEQ ID NO: 57045 - DNA, 20 bp, Coronavirus
gtcacgttcgtgcgtggatt

SEQ ID NO: 57046 - DNA, 20 bp, Coronavirus
gtgcgtggattggctttgat

SEQ ID NO: 57047 - DNA, 20 bp, Coronavirus
gctttgatgtagagggctgt

SEQ ID NO: 57048 - DNA, 20 bp, Coronavirus
gatgtagagggctgtcatgc

SEQ ID NO: 57049 - DNA, 20 bp, Coronavirus
atgtagagggctgtcatgca

SEQ ID NO: 57050 - DNA, 20 bp, Coronavirus
tcagacagagtcgtgttcgt

SEQ ID NO: 57051 - DNA, 20 bp, Coronavirus
gtcctttgggcgcatggctt

SEQ ID NO: 57052 - DNA, 20 bp, Coronavirus
gggcgcatggctttgagctt

SEQ ID NO: 57053 - DNA, 20 bp, Coronavirus
ggcgcatggctttgagctta

SEQ ID NO: 57054 - DNA, 20 bp, Coronavirus
gagcttacatcaatgaagta

SEQ ID NO: 57055 - DNA, 20 bp, Coronavirus
attctgcttgcagaaaagta

SEQ ID NO: 57056 - DNA, 20 bp, Coronavirus
tgcttgcagaaaagtacaac

SEQ ID NO: 57057 - DNA, 20 bp, Coronavirus
cagaaaagtacaacacatgg

SEQ ID NO: 57058 - DNA, 20 bp, Coronavirus
tgaagtctgcattgcttgct

SEQ ID NO: 57059 - DNA, 20 bp, Coronavirus
cttgctgataagtttccagt

SEQ ID NO: 57060 - DNA, 20 bp, Coronavirus
gacacaagagtcttgtcaaa

SEQ ID NO: 57061 - DNA, 20 bp, Coronavirus
acacaagagtcttgtcaaac

SEQ ID NO: 57062 - DNA, 20 bp, Coronavirus
tcaaacttgaacttaccagg

SEQ ID NO: 57063 - DNA, 20 bp, Coronavirus
aacttaccaggctgtgatgg

SEQ ID NO: 57064 - DNA, 20 bp, Coronavirus
ccaggctgtgatggtggtag

SEQ ID NO: 57065 - DNA, 20 bp, Coronavirus
acaaacaatttgatacttat

SEQ ID NO: 57066 - DNA, 20 bp, Coronavirus
caaacaatttgatacttata

SEQ ID NO: 57067 - DNA, 20 bp, Coronavirus
gatacttataacctgtggaa

SEQ ID NO: 57068 - DNA, 20 bp, Coronavirus
atacttataacctgtggaat

SEQ ID NO: 57069 - DNA, 20 bp, Coronavirus
taacctgtggaatacattta

SEQ ID NO: 57070 - DNA, 20 bp, Coronavirus
ccaagaaacctactgagagt

SEQ ID NO: 57071 - DNA, 20 bp, Coronavirus
ttcttcacttactgtcttgt

SEQ ID NO: 57072 - DNA, 20 bp, Coronavirus
ttcacttactgtcttgtttg

SEQ ID NO: 57073 - DNA, 20 bp, Coronavirus
acttactgtcttgtttgatg

SEQ ID NO: 57074 - DNA, 20 bp, Coronavirus
ctgtcttgtttgatggtaga

SEQ ID NO: 57075 - DNA, 20 bp, Coronavirus
ctcgagctcgctatggatga

SEQ ID NO: 57076 - DNA, 20 bp, Coronavirus
tcgagctcgctatggatgaa

SEQ ID NO: 57077 - DNA, 20 bp, Coronavirus
atacagcgatataagctcga

SEQ ID NO: 57078 - DNA, 20 bp, Coronavirus
gaacacatcgtttatggaga

SEQ ID NO: 57079 - DNA, 20 bp, Coronavirus
atggagatttcagtcatgga

SEQ ID NO: 57080 - DNA, 20 bp, Coronavirus
caaaagtggtcaaggttaca

SEQ ID NO: 57081 - DNA, 20 bp, Coronavirus
aaaagtggtcaaggttacaa

SEQ ID NO: 57082 - DNA, 20 bp, Coronavirus
caattgactatgctgaaatt

SEQ ID NO: 57083 - DNA, 20 bp, Coronavirus
actatgctgaaatttcattc

SEQ ID NO: 57084 - DNA, 20 bp, Coronavirus
cattcatgctttggtgtaag

SEQ ID NO: 57085 - DNA, 20 bp, Coronavirus
tcgattcagatcttaatgac

SEQ ID NO: 57086 - DNA, 20 bp, Coronavirus
agatcttaatgacttcgtct

SEQ ID NO: 57087 - DNA, 20 bp, Coronavirus
atgacttcgtctccgacgca

SEQ ID NO: 57088 - DNA, 20 bp, Coronavirus
gtctccgacgcagattctac

SEQ ID NO: 57089 - DNA, 20 bp, Coronavirus
tactttaattggagactgtg

SEQ ID NO: 57090 - DNA, 20 bp, Coronavirus
ttaattggggctaactatct

SEQ ID NO: 57091 - DNA, 20 bp, Coronavirus
taattggggctaactatctt

SEQ ID NO: 57092 - DNA, 20 bp, Coronavirus
aattggggctaactatcttg

SEQ ID NO: 57093 - DNA, 20 bp, Coronavirus
attggggctaactatcttgg

SEQ ID NO: 57094 - DNA, 20 bp, Coronavirus
gggctaactatcttggcaag

SEQ ID NO: 57095 - DNA, 20 bp, Coronavirus
ctttgctgtttctaaaccca

SEQ ID NO: 57096 - DNA, 20 bp, Coronavirus
tttgctgtttctaaacccat

SEQ ID NO: 57097 - DNA, 20 bp, Coronavirus
gctgtttctaaacccatggg

SEQ ID NO: 57098 - DNA, 20 bp, Coronavirus
ctgtttctaaacccatgggt

SEQ ID NO: 57099 - DNA, 20 bp, Coronavirus
ctaaacccatgggtacacag

SEQ ID NO: 57100 - DNA, 20 bp, Coronavirus
ggggcacgtcagctgcagcc

SEQ ID NO: 57101 - DNA, 20 bp, Coronavirus
gggcacgtcagctgcagcct

SEQ ID NO: 57102 - DNA, 20 bp, Coronavirus
tgttggctatttaaagccaa

SEQ ID NO: 57103 - DNA, 20 bp, Coronavirus
gttggctatttaaagccaac

SEQ ID NO: 57104 - DNA, 20 bp, Coronavirus
ttggctatttaaagccaact

SEQ ID NO: 57105 - DNA, 20 bp, Coronavirus
aagtgctatggcgtttctgc

SEQ ID NO: 57106 - DNA, 20 bp, Coronavirus
agtgctatggcgtttctgcc

SEQ ID NO: 57107 - DNA, 20 bp, Coronavirus
ctgccactaagttgaatgat

SEQ ID NO: 57108 - DNA, 20 bp, Coronavirus
tgccactaagttgaatgatc

SEQ ID NO: 57109 - DNA, 20 bp, Coronavirus
aatgatctttgcttctccaa

SEQ ID NO: 57110 - DNA, 20 bp, Coronavirus
ctcccctgatggcaaacctt

SEQ ID NO: 57111 - DNA, 20 bp, Coronavirus
tcccctgatggcaaaccttg

SEQ ID NO: 57112 - DNA, 20 bp, Coronavirus
caccccacctgctcttaatt

SEQ ID NO: 57113 - DNA, 20 bp, Coronavirus
attgttattggccattaaat

SEQ ID NO: 57114 - DNA, 20 bp, Coronavirus
ttattggccattaaatgatt

SEQ ID NO: 57115 - DNA, 20 bp, Coronavirus
cgcttttgggggtgtaagtg

SEQ ID NO: 57116 - DNA, 20 bp, Coronavirus
tgggggtgtaagtgtaatta

SEQ ID NO: 57117 - DNA, 20 bp, Coronavirus
gggggtgtaagtgtaattac

SEQ ID NO: 57118 - DNA, 20 bp, Coronavirus
ggggtgtaagtgtaattaca

SEQ ID NO: 57119 - DNA, 20 bp, Coronavirus
cacctggaacaaatgcttca

SEQ ID NO: 57120 - DNA, 20 bp, Coronavirus
tactatgtctttaggtgctg

SEQ ID NO: 57121 - DNA, 20 bp, Coronavirus
aggtgctgatagttcaattg

SEQ ID NO: 57122 - DNA, 20 bp, Coronavirus
ggtgctgatagttcaattgc

SEQ ID NO: 57123 - DNA, 20 bp, Coronavirus
aattgcttactctaataaca

SEQ ID NO: 57124 - DNA, 20 bp, Coronavirus
cttactctaataacaccatt

SEQ ID NO: 57125 - DNA, 20 bp, Coronavirus
ctctttaataaggtgacact

SEQ ID NO: 57126 - DNA, 20 bp, Coronavirus
aataaggtgacactcgctga

SEQ ID NO: 57127 - DNA, 20 bp, Coronavirus
ataaggtgacactcgctgat

SEQ ID NO: 57128 - DNA, 20 bp, Coronavirus
atgaagcaatatggcgaatg

SEQ ID NO: 57129 - DNA, 20 bp, Coronavirus
atgctagagatctcatttgt

SEQ ID NO: 57130 - DNA, 20 bp, Coronavirus
aacaaggcgattagtcaaat

SEQ ID NO: 57131 - DNA, 20 bp, Coronavirus
acaaggcgattagtcaaatt

SEQ ID NO: 57132 - DNA, 20 bp, Coronavirus
gtcaaattcaagaatcactt

SEQ ID NO: 57133 - DNA, 20 bp, Coronavirus
aagaatcacttacaacaaca

SEQ ID NO: 57134 - DNA, 20 bp, Coronavirus
caacaacatcaactgcattg

SEQ ID NO: 57135 - DNA, 20 bp, Coronavirus
acttttgtggaaagggctac

SEQ ID NO: 57136 - DNA, 20 bp, Coronavirus
tgtggaaagggctaccacct

SEQ ID NO: 57137 - DNA, 20 bp, Coronavirus
gtggaaagggctaccacctt

SEQ ID NO: 57138 - DNA, 20 bp, Coronavirus
tggaaagggctaccacctta

SEQ ID NO: 57139 - DNA, 20 bp, Coronavirus
tgtccttcccacaagcagcc

SEQ ID NO: 57140 - DNA, 20 bp, Coronavirus
atgatcctctgcaacctgag

SEQ ID NO: 57141 - DNA, 20 bp, Coronavirus
tgatcctctgcaacctgagc

SEQ ID NO: 57142 - DNA, 20 bp, Coronavirus
actcattcaaagaagagctg

SEQ ID NO: 57143 - DNA, 20 bp, Coronavirus
aaagaagagctggacaagta

SEQ ID NO: 57144 - DNA, 20 bp, Coronavirus
aaaaatcatacatcaccaga

SEQ ID NO: 57145 - DNA, 20 bp, Coronavirus
ctttgttgcatgactagttg

SEQ ID NO: 57146 - DNA, 20 bp, Coronavirus
gttgcatgactagttgttgc

SEQ ID NO: 57147 - DNA, 20 bp, Coronavirus
ttgcatgactagttgttgca

SEQ ID NO: 57148 - DNA, 20 bp, Coronavirus
catgactagttgttgcagtt

SEQ ID NO: 57149 - DNA, 20 bp, Coronavirus
ttgcagttgcctcaagggtg

SEQ ID NO: 57150 - DNA, 20 bp, Coronavirus
cgctcaataaaagatggcag

SEQ ID NO: 57151 - DNA, 20 bp, Coronavirus
ataagggcttccagttcatt

SEQ ID NO: 57152 - DNA, 20 bp, Coronavirus
taagggcttccagttcattt

SEQ ID NO: 57153 - DNA, 20 bp, Coronavirus
cagttcatttgcaatttact

SEQ ID NO: 57154 - DNA, 20 bp, Coronavirus
atttgcaatttactgctgct

SEQ ID NO: 57155 - DNA, 20 bp, Coronavirus
aagactatgtcgttgtacat

SEQ ID NO: 57156 - DNA, 20 bp, Coronavirus
tacatggctatttcaccgaa

SEQ ID NO: 57157 - DNA, 20 bp, Coronavirus
caccgaagtttactaccagc

SEQ ID NO: 57158 - DNA, 20 bp, Coronavirus
accgaagtttactaccagct

SEQ ID NO: 57159 - DNA, 20 bp, Coronavirus
actaccagcttgagtctaca

SEQ ID NO: 57160 - DNA, 20 bp, Coronavirus
atagttaatagcgtacttct

SEQ ID NO: 57161 - DNA, 20 bp, Coronavirus
atagcgtacttctttttctt

SEQ ID NO: 57162 - DNA, 20 bp, Coronavirus
tttttcttgctttcgtggta

SEQ ID NO: 57163 - DNA, 20 bp, Coronavirus
ttcttgctttcgtggtattc

SEQ ID NO: 57164 - DNA, 20 bp, Coronavirus
tcttgctttcgtggtattct

SEQ ID NO: 57165 - DNA, 20 bp, Coronavirus
cctattcctagcctggatta

SEQ ID NO: 57166 - DNA, 20 bp, Coronavirus
ctattcctagcctggattat

SEQ ID NO: 57167 - DNA, 20 bp, Coronavirus
ctagcctggattatgttact

SEQ ID NO: 57168 - DNA, 20 bp, Coronavirus
tgttactacaatttgcctat

SEQ ID NO: 57169 - DNA, 20 bp, Coronavirus
ctacaatttgcctattctaa

SEQ ID NO: 57170 - DNA, 20 bp, Coronavirus
gtggtcacttgcgaatggcc

SEQ ID NO: 57171 - DNA, 20 bp, Coronavirus
cgaatggccggacactccct

SEQ ID NO: 57172 - DNA, 20 bp, Coronavirus
aggacctgccaaaagagatc

SEQ ID NO: 57173 - DNA, 20 bp, Coronavirus
cttattacaaattaggagcg

SEQ ID NO: 57174 - DNA, 20 bp, Coronavirus
ttattacaaattaggagcgt

SEQ ID NO: 57175 - DNA, 20 bp, Coronavirus
attgtatttacatcttgcga

SEQ ID NO: 57176 - DNA, 20 bp, Coronavirus
tatttacatcttgcgagcta

SEQ ID NO: 57177 - DNA, 20 bp, Coronavirus
acatcttgcgagctatatca

SEQ ID NO: 57178 - DNA, 20 bp, Coronavirus
catcttgcgagctatatcac

SEQ ID NO: 57179 - DNA, 20 bp, Coronavirus
cgagctatatcactatcagg

SEQ ID NO: 57180 - DNA, 20 bp, Coronavirus
catatgcactgtagtacagc

SEQ ID NO: 57181 - DNA, 20 bp, Coronavirus
aagatccttgtaaggtacaa

SEQ ID NO: 57182 - DNA, 20 bp, Coronavirus
taaggtacaacactaggggt

SEQ ID NO: 57183 - DNA, 20 bp, Coronavirus
cccctagtgttgtaccttac

SEQ ID NO: 57184 - DNA, 20 bp, Coronavirus
taccttacaaggatcttcaa

SEQ ID NO: 57185 - DNA, 20 bp, Coronavirus
gtggacccacagattcaact

SEQ ID NO: 57186 - DNA, 20 bp, Coronavirus
aactgacaataaccagaatg

SEQ ID NO: 57187 - DNA, 20 bp, Coronavirus
acccaataatactgcgtctt

SEQ ID NO: 57188 - DNA, 20 bp, Coronavirus
cccaataatactgcgtcttg

SEQ ID NO: 57189 - DNA, 20 bp, Coronavirus
ttgggtaaaccttggggtcg

SEQ ID NO: 57190 - DNA, 20 bp, Coronavirus
caactgagggagccttgaat

SEQ ID NO: 57191 - DNA, 20 bp, Coronavirus
aatacacccaaagaccacat

SEQ ID NO: 57192 - DNA, 20 bp, Coronavirus
gcacccgcaatcctaataac

SEQ ID NO: 57193 - DNA, 20 bp, Coronavirus
ctcaaggaacaacattgcca

SEQ ID NO: 57194 - DNA, 20 bp, Coronavirus
gcaatgttgttccttgagga

SEQ ID NO: 57195 - DNA, 20 bp, Coronavirus
tgtggcagtacgtttttggc

SEQ ID NO: 57196 - DNA, 20 bp, Coronavirus
gtggcagtacgtttttggcg

SEQ ID NO: 57197 - DNA, 20 bp, Coronavirus
tggcagtacgtttttggcga

SEQ ID NO: 57198 - DNA, 20 bp, Coronavirus
ttggcgaggctttttagatg

SEQ ID NO: 57199 - DNA, 20 bp, Coronavirus
tggcgaggctttttagatgc

SEQ ID NO: 57200 - DNA, 20 bp, Coronavirus
gatgacaaagatccacaatt

SEQ ID NO: 57201 - DNA, 20 bp, Coronavirus
aaagacaacgtcatactgct

SEQ ID NO: 57202 - DNA, 20 bp, Coronavirus
acgcatacaaaacattccca

SEQ ID NO: 57203 - DNA, 20 bp, Coronavirus
ccaccaacagagcctaaaaa

SEQ ID NO: 57204 - DNA, 20 bp, Coronavirus
ttaggctctgttggtgggaa

SEQ ID NO: 57205 - DNA, 20 bp, Coronavirus
tgcagaatgaattctcgtaa

SEQ ID NO: 57206 - DNA, 20 bp, Coronavirus
tcgtaactaaacagcacaag

SEQ ID NO: 57207 - DNA, 20 bp, Coronavirus
agttaactttaatctcacat

SEQ ID NO: 57208 - DNA, 20 bp, Coronavirus
gttaactttaatctcacata

SEQ ID NO: 57209 - DNA, 20 bp, Coronavirus
actttaatctcacatagcaa

SEQ ID NO: 57210 - DNA, 20 bp, Human rhinovirus 89
ttacggtaactttgtacgcc

SEQ ID NO: 57211 - DNA, 20 bp, Human rhinovirus 89
cggtaactttgtacgccagt

SEQ ID NO: 57212 - DNA, 20 bp, Human rhinovirus 89
gtacgccagtttttcccacc

SEQ ID NO: 57213 - DNA, 20 bp, Human rhinovirus 89
tacgccagtttttcccaccc

SEQ ID NO: 57214 - DNA, 20 bp, Human rhinovirus 89
ttcccacccttccccataat

SEQ ID NO: 57215 - DNA, 20 bp, Human rhinovirus 89
cccactggcgacagtggtcc

SEQ ID NO: 57216 - DNA, 20 bp, Human rhinovirus 89
ttgggtgagaagcctaatta

SEQ ID NO: 57217 - DNA, 20 bp, Human rhinovirus 89
ggtgagaagcctaattattg

SEQ ID NO: 57218 - DNA, 20 bp, Human rhinovirus 89
ttgacaaggtgtgaagagcc

SEQ ID NO: 57219 - DNA, 20 bp, Human rhinovirus 89
acaaggtgtgaagagccgcg

SEQ ID NO: 57220 - DNA, 20 bp, Human rhinovirus 89
ttcttttgattgcattttat

SEQ ID NO: 57221 - DNA, 20 bp, Human rhinovirus 89
tcttttgattgcattttatg

SEQ ID NO: 57222 - DNA, 20 bp, Human rhinovirus 89
cttttgattgcattttatgg

SEQ ID NO: 57223 - DNA, 20 bp, Human rhinovirus 89
ttttgattgcattttatggt

SEQ ID NO: 57224 - DNA, 20 bp, Human rhinovirus 89
tgattgcattttatggtgac

SEQ ID NO: 57225 - DNA, 20 bp, Human rhinovirus 89
caacacttcaatcaccaaca

SEQ ID NO: 57226 - DNA, 20 bp, Human rhinovirus 89
aatcaccaacagttgaagct

SEQ ID NO: 57227 - DNA, 20 bp, Human rhinovirus 89
aagcttgtggttattcagac

SEQ ID NO: 57228 - DNA, 20 bp, Human rhinovirus 89
tggttattcagacagactaa

SEQ ID NO: 57229 - DNA, 20 bp, Human rhinovirus 89
ttcagacagactaatacaga

SEQ ID NO: 57230 - DNA, 20 bp, Human rhinovirus 89
cctgatgcccttaaaaacat

SEQ ID NO: 57231 - DNA, 20 bp, Human rhinovirus 89
aaaacatgggtatatttggt

SEQ ID NO: 57232 - DNA, 20 bp, Human rhinovirus 89
ggtgaaaatatgttttacca

SEQ ID NO: 57233 - DNA, 20 bp, Human rhinovirus 89
gtgaaaatatgttttaccat

SEQ ID NO: 57234 - DNA, 20 bp, Human rhinovirus 89
taccattttctagggagatc

SEQ ID NO: 57235 - DNA, 20 bp, Human rhinovirus 89
gttaaattttgatggaacat

SEQ ID NO: 57236 - DNA, 20 bp, Human rhinovirus 89
aattttgatggaacattact

SEQ ID NO: 57237 - DNA, 20 bp, Human rhinovirus 89
tgatggaacattacttggta

SEQ ID NO: 57238 - DNA, 20 bp, Human rhinovirus 89
gatggaacattacttggtaa

SEQ ID NO: 57239 - DNA, 20 bp, Human rhinovirus 89
atggaacattacttggtaac

SEQ ID NO: 57240 - DNA, 20 bp, Human rhinovirus 89
tcagggccaagaagtaaggt

SEQ ID NO: 57241 - DNA, 20 bp, Human rhinovirus 89
cagggccaagaagtaaggtt

SEQ ID NO: 57242 - DNA, 20 bp, Human rhinovirus 89
agggccaagaagtaaggttg

SEQ ID NO: 57243 - DNA, 20 bp, Human rhinovirus 89
tgtttagtaccactcagggt

SEQ ID NO: 57244 - DNA, 20 bp, Human rhinovirus 89
agtaccactcagggtttacc

SEQ ID NO: 57245 - DNA, 20 bp, Human rhinovirus 89
atttagctaaagaagtcttt

SEQ ID NO: 57246 - DNA, 20 bp, Human rhinovirus 89
agctaaagaagtcttttcta

SEQ ID NO: 57247 - DNA, 20 bp, Human rhinovirus 89
gctaaagaagtcttttctat

SEQ ID NO: 57248 - DNA, 20 bp, Human rhinovirus 89
tctataccagtagatattgc

SEQ ID NO: 57249 - DNA, 20 bp, Human rhinovirus 89
ctataccagtagatattgcc

SEQ ID NO: 57250 - DNA, 20 bp, Human rhinovirus 89
gtacacatttagtgtgggat

SEQ ID NO: 57251 - DNA, 20 bp, Human rhinovirus 89
agtgtgggatgtggggttgc

SEQ ID NO: 57252 - DNA, 20 bp, Human rhinovirus 89
gtgtgggatgtggggttgca

SEQ ID NO: 57253 - DNA, 20 bp, Human rhinovirus 89
cagtccaccgcctcactagt

SEQ ID NO: 57254 - DNA, 20 bp, Human rhinovirus 89
taccatgggttagtgctagc

SEQ ID NO: 57255 - DNA, 20 bp, Human rhinovirus 89
aaaattatatagatagtgta

SEQ ID NO: 57256 - DNA, 20 bp, Human rhinovirus 89
tatagatagtgtattaaatg

SEQ ID NO: 57257 - DNA, 20 bp, Human rhinovirus 89
aatgaagttcttgtggtgcc

SEQ ID NO: 57258 - DNA, 20 bp, Human rhinovirus 89
ttgtggtgccaaatatccaa

SEQ ID NO: 57259 - DNA, 20 bp, Human rhinovirus 89
tggtgccaaatatccaacct

SEQ ID NO: 57260 - DNA, 20 bp, Human rhinovirus 89
cacatggcaatcaggaacaa

SEQ ID NO: 57261 - DNA, 20 bp, Human rhinovirus 89
tggcaagaaggacaaccata

SEQ ID NO: 57262 - DNA, 20 bp, Human rhinovirus 89
tccttcttgccagaacacag

SEQ ID NO: 57263 - DNA, 20 bp, Human rhinovirus 89
ttgccagaacacagatgcat

SEQ ID NO: 57264 - DNA, 20 bp, Human rhinovirus 89
ccagaacacagatgcatttg

SEQ ID NO: 57265 - DNA, 20 bp, Human rhinovirus 89
accacaaggccaaacatata

SEQ ID NO: 57266 - DNA, 20 bp, Human rhinovirus 89
ccacaaggccaaacatataa

SEQ ID NO: 57267 - DNA, 20 bp, Human rhinovirus 89
cctatcaacacacacactca

SEQ ID NO: 57268 - DNA, 20 bp, Human rhinovirus 89
gatggtatgtaattggttga

SEQ ID NO: 57269 - DNA, 20 bp, Human rhinovirus 89
gttgagtgtgtgtgttgata

SEQ ID NO: 57270 - DNA, 20 bp, Human rhinovirus 89
tgattgcactgaatgtacat

SEQ ID NO: 57271 - DNA, 20 bp, Human rhinovirus 89
cactgaatgtacatattact

SEQ ID NO: 57272 - DNA, 20 bp, Human rhinovirus 89
ctgccaccacaaagataggt

SEQ ID NO: 57273 - DNA, 20 bp, Human rhinovirus 89
gtggtggcagtaatatgtac

SEQ ID NO: 57274 - DNA, 20 bp, Human rhinovirus 89
tggtggcagtaatatgtaca

SEQ ID NO: 57275 - DNA, 20 bp, Human rhinovirus 89
cttttattgacctgagaaaa

SEQ ID NO: 57276 - DNA, 20 bp, Human rhinovirus 89
tattgacctgagaaaattcc

SEQ ID NO: 57277 - DNA, 20 bp, Human rhinovirus 89
attgacctgagaaaattcca

SEQ ID NO: 57278 - DNA, 20 bp, Human rhinovirus 89
ttgacctgagaaaattccag

SEQ ID NO: 57279 - DNA, 20 bp, Human rhinovirus 89
acctgagaaaattccagtgt

SEQ ID NO: 57280 - DNA, 20 bp, Human rhinovirus 89
taggttgttcaggctcacca

SEQ ID NO: 57281 - DNA, 20 bp, Human rhinovirus 89
ttcaggctcaccatggaggt

SEQ ID NO: 57282 - DNA, 20 bp, Human rhinovirus 89
aggctcaccatggaggtttc

SEQ ID NO: 57283 - DNA, 20 bp, Human rhinovirus 89
cttaaagagaaactctgtgc

SEQ ID NO: 57284 - DNA, 20 bp, Human rhinovirus 89
ttaaagagaaactctgtgcg

SEQ ID NO: 57285 - DNA, 20 bp, Human rhinovirus 89
tgttcttgctcgaatgctaa

SEQ ID NO: 57286 - DNA, 20 bp, Human rhinovirus 89
ttgctcgaatgctaactgtt

SEQ ID NO: 57287 - DNA, 20 bp, Human rhinovirus 89
ctcgaatgctaactgttgag

SEQ ID NO: 57288 - DNA, 20 bp, Human rhinovirus 89
agactgatatatattctttg

SEQ ID NO: 57289 - DNA, 20 bp, Human rhinovirus 89
tttgcccccagatcctaaat

SEQ ID NO: 57290 - DNA, 20 bp, Human rhinovirus 89
tacttgcaagcactaatcac

SEQ ID NO: 57291 - DNA, 20 bp, Human rhinovirus 89
caagcactaatcacactcta

SEQ ID NO: 57292 - DNA, 20 bp, Human rhinovirus 89
attaccagcaatggcaagaa

SEQ ID NO: 57293 - DNA, 20 bp, Human rhinovirus 89
ccagcaatggcaagaaggtt

SEQ ID NO: 57294 - DNA, 20 bp, Human rhinovirus 89
tactttgatctagacattca

SEQ ID NO: 57295 - DNA, 20 bp, Human rhinovirus 89
tctatataatttataaattg

SEQ ID NO: 57296 - DNA, 20 bp, Human rhinovirus 89
ataaattgttctgtacactt

SEQ ID NO: 57297 - DNA, 20 bp, Human rhinovirus 89
taaattgttctgtacacttc

SEQ ID NO: 57298 - DNA, 20 bp, Human rhinovirus 89
ttctgtacacttcagggtcc

SEQ ID NO: 57299 - DNA, 20 bp, Human rhinovirus 89
tgtacacttcagggtccata

SEQ ID NO: 57300 - DNA, 20 bp, Human rhinovirus 89
tgacccaggctctgagatct

SEQ ID NO: 57301 - DNA, 20 bp, Human rhinovirus 89
gtagatggagtaaaagttaa

SEQ ID NO: 57302 - DNA, 20 bp, Human rhinovirus 89
aggtctctgattcctatgat

SEQ ID NO: 57303 - DNA, 20 bp, Human rhinovirus 89
ctatgatttgcataaccatg

SEQ ID NO: 57304 - DNA, 20 bp, Human rhinovirus 89
gcataaccatgagggtgtta

SEQ ID NO: 57305 - DNA, 20 bp, Human rhinovirus 89
cccgacaaaagctggatatt

SEQ ID NO: 57306 - DNA, 20 bp, Human rhinovirus 89
tgggggtgttttgtacaagg

SEQ ID NO: 57307 - DNA, 20 bp, Human rhinovirus 89
tgtacaaggttggctctatt

SEQ ID NO: 57308 - DNA, 20 bp, Human rhinovirus 89
gtacaaggttggctctattc

SEQ ID NO: 57309 - DNA, 20 bp, Human rhinovirus 89
tacaaggttggctctattct

SEQ ID NO: 57310 - DNA, 20 bp, Human rhinovirus 89
gaaatcttttctctgctttc

SEQ ID NO: 57311 - DNA, 20 bp, Human rhinovirus 89
tctctgctttccacaaaaac

SEQ ID NO: 57312 - DNA, 20 bp, Human rhinovirus 89
ctctgctttccacaaaaacc

SEQ ID NO: 57313 - DNA, 20 bp, Human rhinovirus 89
tctgctttccacaaaaaccc

SEQ ID NO: 57314 - DNA, 20 bp, Human rhinovirus 89
ccacaaaaacccaggtatag

SEQ ID NO: 57315 - DNA, 20 bp, Human rhinovirus 89
tccaagaattgacctataaa

SEQ ID NO: 57316 - DNA, 20 bp, Human rhinovirus 89
ccaagaattgacctataaaa

SEQ ID NO: 57317 - DNA, 20 bp, Human rhinovirus 89
caagaattgacctataaaaa

SEQ ID NO: 57318 - DNA, 20 bp, Human rhinovirus 89
acctataaaaatgtaacttt

SEQ ID NO: 57319 - DNA, 20 bp, Human rhinovirus 89
tcttaaaagaggattcagag

SEQ ID NO: 57320 - DNA, 20 bp, Human papillomavirus type 131
taggattgacagcaattgtt

SEQ ID NO: 57321 - DNA, 20 bp, Human papillomavirus type 131
acagcaattgttctaattgt

SEQ ID NO: 57322 - DNA, 20 bp, Human papillomavirus type 131
ttctaattgtcacacaaata

SEQ ID NO: 57323 - DNA, 20 bp, Human papillomavirus type 131
taattgtcacacaaatatta

SEQ ID NO: 57324 - DNA, 20 bp, Human papillomavirus type 131
tcacacaaatattagactgt

SEQ ID NO: 57325 - DNA, 20 bp, Human papillomavirus type 131
taatgtacaggtagcttgtg

SEQ ID NO: 57326 - DNA, 20 bp, Human papillomavirus type 131
tgaagattctgtagactctc

SEQ ID NO: 57327 - DNA, 20 bp, Human papillomavirus type 131
tgtagactctctaaattcaa

SEQ ID NO: 57328 - DNA, 20 bp, Human papillomavirus type 131
aaatgtggcgggaaatgaaa

SEQ ID NO: 57329 - DNA, 20 bp, Human papillomavirus type 131
ccgccattttcatttcccgc

SEQ ID NO: 57330 - DNA, 20 bp, Human papillomavirus type 131
ttggtcatatttagatgtgc

SEQ ID NO: 57331 - DNA, 20 bp, Human papillomavirus type 131
gtcatatttagatgtgcata

SEQ ID NO: 57332 - DNA, 20 bp, Human papillomavirus type 131
agatgtgcatatgagaaatg

SEQ ID NO: 57333 - DNA, 20 bp, Human papillomavirus type 131
gatgtgcatatgagaaatgc

SEQ ID NO: 57334 - DNA, 20 bp, Human papillomavirus type 131
gatggtaatatggtatgttt

SEQ ID NO: 57335 - DNA, 20 bp, Human papillomavirus type 131
agttgagtctaattgagaaa

SEQ ID NO: 57336 - DNA, 20 bp, Human papillomavirus type 131
agtctaattgagaaagaatc

SEQ ID NO: 57337 - DNA, 20 bp, Human papillomavirus type 131
agaaagaatctacagacctt

SEQ ID NO: 57338 - DNA, 20 bp, Human papillomavirus type 131
gagatcacatcacatactgg

SEQ ID NO: 57339 - DNA, 20 bp, Human papillomavirus type 131
gaaaagaaaatgttattgta

SEQ ID NO: 57340 - DNA, 20 bp, Human papillomavirus type 131
agtttaaaaacaaaactatt

SEQ ID NO: 57341 - DNA, 20 bp, Human papillomavirus type 131
aaaaacaaaactattcttgc

SEQ ID NO: 57342 - DNA, 20 bp, Human papillomavirus type 131
aaaacaaaactattcttgct

SEQ ID NO: 57343 - DNA, 20 bp, Human papillomavirus type 131
ttgctcctgtcactagctcc

SEQ ID NO: 57344 - DNA, 20 bp, Human papillomavirus type 131
ctcctgtcactagctcctca

SEQ ID NO: 57345 - DNA, 20 bp, Human papillomavirus type 131
cggtggttggggcatgactg

SEQ ID NO: 57346 - DNA, 20 bp, Human papillomavirus type 131
ggtggttggggcatgactgt

SEQ ID NO: 57347 - DNA, 20 bp, Human papillomavirus type 131
gggcatgactgtgaaaaaac

SEQ ID NO: 57348 - DNA, 20 bp, Human papillomavirus type 131
aaagaccttacacaaagaca

SEQ ID NO: 57349 - DNA, 20 bp, Human papillomavirus type 131
aagaccttacacaaagacaa

SEQ ID NO: 57350 - DNA, 20 bp, Human papillomavirus type 131
ttattgagcctattggacct

SEQ ID NO: 57351 - DNA, 20 bp, Human papillomavirus type 131
ttgagcctattggacctaca

SEQ ID NO: 57352 - DNA, 20 bp, Human papillomavirus type 131
agcctattggacctacacct

SEQ ID NO: 57353 - DNA, 20 bp, Human papillomavirus type 131
gacctacacctataattcca

SEQ ID NO: 57354 - DNA, 20 bp, Human papillomavirus type 131
cagtagaacctggagcatct

SEQ ID NO: 57355 - DNA, 20 bp, Human papillomavirus type 131
gggcgggcctttaacagagc

SEQ ID NO: 57356 - DNA, 20 bp, Human papillomavirus type 131
ggcgggcctttaacagagct

SEQ ID NO: 57357 - DNA, 20 bp, Human papillomavirus type 131
aacagagctagagatcttta

SEQ ID NO: 57358 - DNA, 20 bp, Human papillomavirus type 131
acagagctagagatctttat

SEQ ID NO: 57359 - DNA, 20 bp, Human papillomavirus type 131
atagtagatttatagagcag

SEQ ID NO: 57360 - DNA, 20 bp, Human papillomavirus type 131
taaaggtatttgtccccgat

SEQ ID NO: 57361 - DNA, 20 bp, Human papillomavirus type 131
aaaggtatttgtccccgatg

SEQ ID NO: 57362 - DNA, 20 bp, Human papillomavirus type 131
aaggtatttgtccccgatgt

SEQ ID NO: 57363 - DNA, 20 bp, Human papillomavirus type 131
gtccccgatgtaggtgatgg

SEQ ID NO: 57364 - DNA, 20 bp, Human papillomavirus type 131
tccccgatgtaggtgatgga

SEQ ID NO: 57365 - DNA, 20 bp, Human papillomavirus type 131
gctttaatagaaaagaattt

SEQ ID NO: 57366 - DNA, 20 bp, Human papillomavirus type 131
ctttaatagaaaagaattta

SEQ ID NO: 57367 - DNA, 20 bp, Human papillomavirus type 131
aatagaaaagaatttataca

SEQ ID NO: 57368 - DNA, 20 bp, Human papillomavirus type 131
atagaaaagaatttatacaa

SEQ ID NO: 57369 - DNA, 20 bp, Human papillomavirus type 131
atacaattcagacagggaac

SEQ ID NO: 57370 - DNA, 20 bp, Human papillomavirus type 131
tttgaaatgacaaaggatac

SEQ ID NO: 57371 - DNA, 20 bp, Human papillomavirus type 131
ttgaaatgacaaaggataca

SEQ ID NO: 57372 - DNA, 20 bp, Human papillomavirus type 131
tgaaatgacaaaggatacat

SEQ ID NO: 57373 - DNA, 20 bp, Human papillomavirus type 131
gaaatgacaaaggatacata

SEQ ID NO: 57374 - DNA, 20 bp, Human papillomavirus type 131
aaatgacaaaggatacatat

SEQ ID NO: 57375 - DNA, 20 bp, Human papillomavirus type 131
tagcacatctgcaagttatg

SEQ ID NO: 57376 - DNA, 20 bp, Human papillomavirus type 131
agcacatctgcaagttatga

SEQ ID NO: 57377 - DNA, 20 bp, Human papillomavirus type 131
gcacatctgcaagttatgaa

SEQ ID NO: 57378 - DNA, 20 bp, Human papillomavirus type 131
tgaatcccagaatattggaa

SEQ ID NO: 57379 - DNA, 20 bp, Human papillomavirus type 131
gaagaatggcagttggcttt

SEQ ID NO: 57380 - DNA, 20 bp, Human papillomavirus type 131
gttgcatgtgtgttttatct

SEQ ID NO: 57381 - DNA, 20 bp, Human papillomavirus type 131
ttgcatgtgtgttttatctg

SEQ ID NO: 57382 - DNA, 20 bp, Human papillomavirus type 131
catgtgtgttttatctgact

SEQ ID NO: 57383 - DNA, 20 bp, Human papillomavirus type 131
tatctgactcatggggtcac

SEQ ID NO: 57384 - DNA, 20 bp, Human papillomavirus type 131
atctgactcatggggtcact

SEQ ID NO: 57385 - DNA, 20 bp, Human papillomavirus type 135
ccacaattccagatgtttgt

SEQ ID NO: 57386 - DNA, 20 bp, Human papillomavirus type 135
cagatgtttgtttggaagag

SEQ ID NO: 57387 - DNA, 20 bp, Human papillomavirus type 135
gtttggaagagttggtgtta

SEQ ID NO: 57388 - DNA, 20 bp, Human papillomavirus type 135
tttggaagagttggtgttac

SEQ ID NO: 57389 - DNA, 20 bp, Human papillomavirus type 135
ggaagagttggtgttacctt

SEQ ID NO: 57390 - DNA, 20 bp, Human papillomavirus type 135
aattacaaactgcagattgg

SEQ ID NO: 57391 - DNA, 20 bp, Human papillomavirus type 135
caaactgcagattggtttat

SEQ ID NO: 57392 - DNA, 20 bp, Human papillomavirus type 135
gtttattgtggaagaagcag

SEQ ID NO: 57393 - DNA, 20 bp, Human papillomavirus type 135
attgtggaagaagcagattg

SEQ ID NO: 57394 - DNA, 20 bp, Human papillomavirus type 135
ttgtggaagaagcagattgt

SEQ ID NO: 57395 - DNA, 20 bp, Human papillomavirus type 135
tagatttgagtccgagactg

SEQ ID NO: 57396 - DNA, 20 bp, Human papillomavirus type 135
gagtccgagactggcagcag

SEQ ID NO: 57397 - DNA, 20 bp, Human papillomavirus type 135
agtccgagactggcagcagt

SEQ ID NO: 57398 - DNA, 20 bp, Human papillomavirus type 135
ctcctcagagacaaagcaag

SEQ ID NO: 57399 - DNA, 20 bp, Human papillomavirus type 135
tcctcagagacaaagcaaga

SEQ ID NO: 57400 - DNA, 20 bp, Human papillomavirus type 135
accgaccgtttcgatgtact

SEQ ID NO: 57401 - DNA, 20 bp, Human papillomavirus type 135
cgatgtactgcaggatcaac

SEQ ID NO: 57402 - DNA, 20 bp, Human papillomavirus type 135
gatgtactgcaggatcaact

SEQ ID NO: 57403 - DNA, 20 bp, Human papillomavirus type 135
atgaaaaaggagcaactgac

SEQ ID NO: 57404 - DNA, 20 bp, Human papillomavirus type 135
tgaaaaaggagcaactgacc

SEQ ID NO: 57405 - DNA, 20 bp, Human papillomavirus type 135
aattcaaatcaactactatt

SEQ ID NO: 57406 - DNA, 20 bp, Human papillomavirus type 135
aaatcaactactatttcctc

SEQ ID NO: 57407 - DNA, 20 bp, Human papillomavirus type 135
cctctgtcgttactagttcc

SEQ ID NO: 57408 - DNA, 20 bp, Human papillomavirus type 135
ctctgtcgttactagttcca

SEQ ID NO: 57409 - DNA, 20 bp, Human papillomavirus type 135
ctagttccaagaagtccttc

SEQ ID NO: 57410 - DNA, 20 bp, Human papillomavirus type 135
gtcaggagttggtgcagtgg

SEQ ID NO: 57411 - DNA, 20 bp, Human papillomavirus type 135
gtgcagtgggccccctggtc

SEQ ID NO: 57412 - DNA, 20 bp, Human papillomavirus type 135
gctcttggttctctggtggt

SEQ ID NO: 57413 - DNA, 20 bp, Human papillomavirus type 135
gttctctggtggttgattct

SEQ ID NO: 57414 - DNA, 20 bp, Human papillomavirus type 135
tctggtggttgattctcctt

SEQ ID NO: 57415 - DNA, 20 bp, Human papillomavirus type 135
gtggcgctgaagtaatacct

SEQ ID NO: 57416 - DNA, 20 bp, Human papillomavirus type 135
ggatgtgataaatccagagg

SEQ ID NO: 57417 - DNA, 20 bp, Human papillomavirus type 135
gatgtgataaatccagaggc

SEQ ID NO: 57418 - DNA, 20 bp, Human papillomavirus type 135
tgcctttgcaagaaggtgct

SEQ ID NO: 57419 - DNA, 20 bp, Human papillomavirus type 135
gcaagaaggtgctatcccca

SEQ ID NO: 57420 - DNA, 20 bp, Human papillomavirus type 135
tacaatcgttttgtacaaca

SEQ ID NO: 57421 - DNA, 20 bp, Human papillomavirus type 135
tgtacaacaggttcaaacca

SEQ ID NO: 57422 - DNA, 20 bp, Human papillomavirus type 135
gtacaacaggttcaaaccag

SEQ ID NO: 57423 - DNA, 20 bp, Human papillomavirus type 135
tacaacaggttcaaaccaga

SEQ ID NO: 57424 - DNA, 20 bp, Human papillomavirus type 135
aaaccagaaacccagacttc

SEQ ID NO: 57425 - DNA, 20 bp, Human papillomavirus type 135
gaacatatccttcaagggga

SEQ ID NO: 57426 - DNA, 20 bp, Human papillomavirus type 135
aaggggatagccaactggac

SEQ ID NO: 57427 - DNA, 20 bp, Human papillomavirus type 135
ttcaaccagttttggtacaa

SEQ ID NO: 57428 - DNA, 20 bp, Human papillomavirus type 135
tcaaccagttttggtacaat

SEQ ID NO: 57429 - DNA, 20 bp, Human papillomavirus type 135
caaccagttttggtacaatt

SEQ ID NO: 57430 - DNA, 20 bp, Influenza B virus
cctacctgctttcactaata

SEQ ID NO: 57431 - DNA, 20 bp, Influenza B virus
cactaatagaagatggagaa

SEQ ID NO: 57432 - DNA, 20 bp, Influenza B virus
actaatagaagatggagaag

SEQ ID NO: 57433 - DNA, 20 bp, Influenza B virus
cactgttggttcggtgggaa

SEQ ID NO: 57434 - DNA, 20 bp, Influenza B virus
gttcggtgggaaagaatttg

SEQ ID NO: 57435 - DNA, 20 bp, Influenza B virus
tagctgagagaaaaatgaga

SEQ ID NO: 57436 - DNA, 20 bp, Influenza B virus
catgaagcatttgaaatagc

SEQ ID NO: 57437 - DNA, 20 bp, Influenza B virus
atgaagcatttgaaatagca

SEQ ID NO: 57438 - DNA, 20 bp, Influenza B virus
gaaatagcagaaggccacga

SEQ ID NO: 57439 - DNA, 20 bp, Influenza B virus
aaatagcagaaggccacgaa

SEQ ID NO: 57440 - DNA, 20 bp, Influenza B virus
cagctatgaacacagcaaag

SEQ ID NO: 57441 - DNA, 20 bp, Influenza B virus
agctatgaacacagcaaaga

SEQ ID NO: 57442 - DNA, 20 bp, Influenza B virus
tgctagtttttggacgtctt

SEQ ID NO: 57443 - DNA, 20 bp, Influenza B virus
ttggacgtcttctccctttc

SEQ ID NO: 57444 - DNA, 20 bp, Influenza B virus
tggacgtcttctccctttcc

SEQ ID NO: 57445 - DNA, 20 bp, Influenza A virus
tgaacagatggaaactggtg

SEQ ID NO: 57446 - DNA, 20 bp, Influenza A virus
ttccaacagatgctctgatc

SEQ ID NO: 57447 - DNA, 20 bp, Influenza A virus
caacagatgctctgatctca

SEQ ID NO: 57448 - DNA, 20 bp, Influenza A virus
tggcgttctccaccagtttc

SEQ ID NO: 57449 - DNA, 20 bp, Influenza A virus
tccaccagtttccatctgtt

SEQ ID NO: 57450 - DNA, 20 bp, Influenza A virus
tgtatgacaaagaggagatc

SEQ ID NO: 57451 - DNA, 20 bp, Influenza A virus
ggcgtcaagcgaacaatgga

SEQ ID NO: 57452 - DNA, 20 bp, Influenza A virus
gcgtcaagcgaacaatggag

SEQ ID NO: 57453 - DNA, 20 bp, Influenza A virus
catcttctccattgttcgct

SEQ ID NO: 57454 - DNA, 20 bp, Influenza A virus
tccattgttcgcttgacgcc

SEQ ID NO: 57455 - DNA, 20 bp, Influenza A virus
aagatctcatatttctggca

SEQ ID NO: 57456 - DNA, 20 bp, Influenza A virus
ctggcacggtctgcactcat

SEQ ID NO: 57457 - DNA, 20 bp, Influenza A virus
tggcacggtctgcactcatc

SEQ ID NO: 57458 - DNA, 20 bp, Influenza A virus
cctgcttgtgtgtacgggct

SEQ ID NO: 57459 - DNA, 20 bp, Influenza A virus
tgggccactgatcctctcag

SEQ ID NO: 57460 - DNA, 20 bp, Influenza A virus
tgcagcatttgaagatctga

SEQ ID NO: 57461 - DNA, 20 bp, Influenza A virus
gaagatctgagagtctcaag

SEQ ID NO: 57462 - DNA, 20 bp, Influenza A virus
aagatctgagagtctcaagc

SEQ ID NO: 57463 - DNA, 20 bp, Influenza A virus
atcagagggacaagagtggc

SEQ ID NO: 57464 - DNA, 20 bp, Influenza A virus
gaagcaatttgaactcctct

SEQ ID NO: 57465 - DNA, 20 bp, Streptococcus pyogenes
aaggtcgataagcatattgc

SEQ ID NO: 57466 - DNA, 20 bp, Streptococcus pyogenes
caactatttacttagatcaa

SEQ ID NO: 57467 - DNA, 20 bp, Streptococcus pyogenes
acttagatcaaatgaaagag

SEQ ID NO: 57468 - DNA, 20 bp, Streptococcus pyogenes
cttagatcaaatgaaagagc

SEQ ID NO: 57469 - DNA, 20 bp, Streptococcus pyogenes
gatcaaatgaaagagctctt

SEQ ID NO: 57470 - DNA, 20 bp, Streptococcus pyogenes
gtttatttggggtggccctg

SEQ ID NO: 57471 - DNA, 20 bp, Streptococcus pyogenes
tttatttggggtggccctgg

SEQ ID NO: 57472 - DNA, 20 bp, Streptococcus pyogenes
atttggggtggccctgggct

SEQ ID NO: 57473 - DNA, 20 bp, Streptococcus pyogenes
tttggggtggccctgggctt

SEQ ID NO: 57474 - DNA, 20 bp, Streptococcus pyogenes
ggggtggccctgggcttgga

SEQ ID NO: 57475 - DNA, 20 bp, Streptococcus pyogenes
acattgctgccgaagctatt

SEQ ID NO: 57476 - DNA, 20 bp, Streptococcus pyogenes
ctgccgaagctattcgcgcc

SEQ ID NO: 57477 - DNA, 20 bp, Streptococcus pyogenes
gcgccagaaagcaagatgga

SEQ ID NO: 57478 - DNA, 20 bp, Streptococcus pyogenes
ttcccatcgaagaaattcaa

SEQ ID NO: 57479 - DNA, 20 bp, Streptococcus pyogenes
ccatcgaagaaattcaagcg

SEQ ID NO: 57480 - DNA, 20 bp, Streptococcus pyogenes
ttcagaagtgaacacatttc

SEQ ID NO: 57481 - DNA, 20 bp, Streptococcus pyogenes
agaagtgaacacatttcttt

SEQ ID NO: 57482 - DNA, 20 bp, Streptococcus pyogenes
ctttttatacacgcctctta

SEQ ID NO: 57483 - DNA, 20 bp, Streptococcus pyogenes
tttttatacacgcctcttag

SEQ ID NO: 57484 - DNA, 20 bp, Streptococcus pyogenes
ttatacacgcctcttagaag

SEQ ID NO: 57485 - DNA, 20 bp, Streptococcus pyogenes
tgtaattaaagaaactggta

SEQ ID NO: 57486 - DNA, 20 bp, Streptococcus pyogenes
aagaaactggtaaaaaggct

SEQ ID NO: 57487 - DNA, 20 bp, Streptococcus pyogenes
aaattcagtgtactaactgt

SEQ ID NO: 57488 - DNA, 20 bp, Streptococcus pyogenes
agtgtactaactgtcagcat

SEQ ID NO: 57489 - DNA, 20 bp, Streptococcus pyogenes
tgatgagtcgttatgatttt

SEQ ID NO: 57490 - DNA, 20 bp, Streptococcus pyogenes
caaaagcaggagcagaagct

SEQ ID NO: 57491 - DNA, 20 bp, Streptococcus pyogenes
tccttttgcgactattgatc

SEQ ID NO: 57492 - DNA, 20 bp, Streptococcus pyogenes
tgcgactattgatcccaatg

SEQ ID NO: 57493 - DNA, 20 bp, Streptococcus pyogenes
gcgactattgatcccaatgt

SEQ ID NO: 57494 - DNA, 20 bp, Streptococcus pyogenes
cgactattgatcccaatgtt

SEQ ID NO: 57495 - DNA, 20 bp, Streptococcus pyogenes
aaaaaatggcacgaactcaa

SEQ ID NO: 57496 - DNA, 20 bp, Streptococcus pyogenes
aatgttttgcaaaagattaa

SEQ ID NO: 57497 - DNA, 20 bp, Streptococcus pyogenes
atgttttgcaaaagattaaa

SEQ ID NO: 57498 - DNA, 20 bp, Streptococcus pyogenes
tgcaaaagattaaacctgtt

SEQ ID NO: 57499 - DNA, 20 bp, Streptococcus pyogenes
gcaaaagattaaacctgttt

SEQ ID NO: 57500 - DNA, 20 bp, Streptococcus pyogenes
acgatgaggataaagaagaa

SEQ ID NO: 57501 - DNA, 20 bp, Streptococcus pyogenes
ttggaagctatcggtcttac

SEQ ID NO: 57502 - DNA, 20 bp, Streptococcus pyogenes
tggaagctatcggtcttact

SEQ ID NO: 57503 - DNA, 20 bp, Streptococcus pyogenes
ggaagctatcggtcttactg

SEQ ID NO: 57504 - DNA, 20 bp, Streptococcus pyogenes
gaagctatcggtcttactga

SEQ ID NO: 57505 - DNA, 20 bp, Streptococcus pyogenes
gttttatggctattgacaat

SEQ ID NO: 57506 - DNA, 20 bp, Streptococcus pyogenes
tatggctattgacaatattg

SEQ ID NO: 57507 - DNA, 20 bp, Streptococcus pyogenes
atggctattgacaatattgt

SEQ ID NO: 57508 - DNA, 20 bp, Streptococcus pyogenes
tggctattgacaatattgtc

SEQ ID NO: 57509 - DNA, 20 bp, Streptococcus pyogenes
acaatattgtcaagaacctt

SEQ ID NO: 57510 - DNA, 20 bp, Streptococcus pyogenes
agtcaatcattgcccacatt

SEQ ID NO: 57511 - DNA, 20 bp, Streptococcus pyogenes
cccacattggaactcaggaa

SEQ ID NO: 57512 - DNA, 20 bp, Streptococcus pyogenes
gaactcaggaatttaaccga

SEQ ID NO: 57513 - DNA, 20 bp, Streptococcus pyogenes
aaccgaatcaaagttggtat

SEQ ID NO: 57514 - DNA, 20 bp, Streptococcus pyogenes
accgaatcaaagttggtatt

SEQ ID NO: 57515 - DNA, 20 bp, Streptococcus pyogenes
ttttaactttttatttttag

SEQ ID NO: 57516 - DNA, 20 bp, Streptococcus pyogenes
taactttttatttttaggct

SEQ ID NO: 57517 - DNA, 20 bp, Streptococcus pyogenes
aactttttatttttaggctt

SEQ ID NO: 57518 - DNA, 20 bp, Streptococcus pyogenes
actttttatttttaggctta

SEQ ID NO: 57519 - DNA, 20 bp, Streptococcus pyogenes
ttatttttaggcttaggctt

SEQ ID NO: 57520 - DNA, 20 bp, Streptococcus pyogenes
aagctccctatatcgtccct

SEQ ID NO: 57521 - DNA, 20 bp, Streptococcus pyogenes
gtaatgacttaggtaagatt

SEQ ID NO: 57522 - DNA, 20 bp, Streptococcus pyogenes
ggtaagattttgcaggctta

SEQ ID NO: 57523 - DNA, 20 bp, Streptococcus pyogenes
tgcaggcttatcaattagga

SEQ ID NO: 57524 - DNA, 20 bp, Streptococcus pyogenes
gcaggcttatcaattaggag

SEQ ID NO: 57525 - DNA, 20 bp, Streptococcus pyogenes
atgaaataatctaagatggt

SEQ ID NO: 57526 - DNA, 20 bp, Streptococcus pyogenes
atataatgttttaaatggct

SEQ ID NO: 57527 - DNA, 20 bp, Streptococcus pyogenes
taaatggcttgttttgttgt

SEQ ID NO: 57528 - DNA, 20 bp, Streptococcus pyogenes
aaatggcttgttttgttgtg

SEQ ID NO: 57529 - DNA, 20 bp, Streptococcus pyogenes
aatggcttgttttgttgtgc

SEQ ID NO: 57530 - DNA, 20 bp, Streptococcus pyogenes
gatagagatgttaggattac

SEQ ID NO: 57531 - DNA, 20 bp, Streptococcus pyogenes
atagagatgttaggattact

SEQ ID NO: 57532 - DNA, 20 bp, Streptococcus pyogenes
ggattactatcaaacgtctc

SEQ ID NO: 57533 - DNA, 20 bp, Streptococcus pyogenes
ctatcaaacgtctcttgaaa

SEQ ID NO: 57534 - DNA, 20 bp, Streptococcus pyogenes
aaaggttttgtgactcatat

SEQ ID NO: 57535 - DNA, 20 bp, Streptococcus pyogenes
gtattttttggattcactcc

SEQ ID NO: 57536 - DNA, 20 bp, Streptococcus pyogenes
tattttttggattcactccg

SEQ ID NO: 57537 - DNA, 20 bp, Streptococcus pyogenes
tttggattcactccgcaaat

SEQ ID NO: 57538 - DNA, 20 bp, Streptococcus pyogenes
ttggattcactccgcaaatc

SEQ ID NO: 57539 - DNA, 20 bp, Streptococcus pyogenes
tggattcactccgcaaatca

SEQ ID NO: 57540 - DNA, 20 bp, Streptococcus pyogenes
tcgtaccccgataggaaatt

SEQ ID NO: 57541 - DNA, 20 bp, Streptococcus pyogenes
tggaggagtctttaaatctt

SEQ ID NO: 57542 - DNA, 20 bp, Streptococcus pyogenes
ggaggagtctttaaatcttt

SEQ ID NO: 57543 - DNA, 20 bp, Streptococcus pyogenes
gaggagtctttaaatcttta

SEQ ID NO: 57544 - DNA, 20 bp, Streptococcus pyogenes
aaatctttatcagccgtaga

SEQ ID NO: 57545 - DNA, 20 bp, Streptococcus pyogenes
cgttttacaaggccaacgtt

SEQ ID NO: 57546 - DNA, 20 bp, Streptococcus pyogenes
tacaaggccaacgttgggga

SEQ ID NO: 57547 - DNA, 20 bp, Streptococcus pyogenes
acaaggccaacgttggggat

SEQ ID NO: 57548 - DNA, 20 bp, Streptococcus pyogenes
caaggccaacgttggggatc

SEQ ID NO: 57549 - DNA, 20 bp, Streptococcus pyogenes
gggatctcgtatgggagata

SEQ ID NO: 57550 - DNA, 20 bp, Streptococcus pyogenes
gaacgacagtggataagtta

SEQ ID NO: 57551 - DNA, 20 bp, Streptococcus pyogenes
gcaaagttacgccctgcttt

SEQ ID NO: 57552 - DNA, 20 bp, Streptococcus pyogenes
cgccctgcttttatcaaaga

SEQ ID NO: 57553 - DNA, 20 bp, Streptococcus pyogenes
tatcaaagatgaggggacag

SEQ ID NO: 57554 - DNA, 20 bp, Streptococcus pyogenes
atcaaagatgaggggacagt

SEQ ID NO: 57555 - DNA, 20 bp, Streptococcus pyogenes
agcggtttcacgagaccttg

SEQ ID NO: 57556 - DNA, 20 bp, Streptococcus pyogenes
gcggtttcacgagaccttgg

SEQ ID NO: 57557 - DNA, 20 bp, Streptococcus pyogenes
cacgagaccttggttttgac

SEQ ID NO: 57558 - DNA, 20 bp, Streptococcus pyogenes
acgagaccttggttttgaca

SEQ ID NO: 57559 - DNA, 20 bp, Streptococcus pyogenes
gttttgacaatgaaaaagtt

SEQ ID NO: 57560 - DNA, 20 bp, Streptococcus pyogenes
tatggctaatggaacaccag

SEQ ID NO: 57561 - DNA, 20 bp, Streptococcus pyogenes
atggctaatggaacaccaga

SEQ ID NO: 57562 - DNA, 20 bp, Streptococcus pyogenes
tggctaatggaacaccagaa

SEQ ID NO: 57563 - DNA, 20 bp, Streptococcus pyogenes
attgatgcactggttgacaa

SEQ ID NO: 57564 - DNA, 20 bp, Streptococcus pyogenes
atgcactggttgacaaaggc

SEQ ID NO: 57565 - DNA, 20 bp, Streptococcus pyogenes
gcatcaacgacaatagaaga

SEQ ID NO: 57566 - DNA, 20 bp, Streptococcus pyogenes
catcaacgacaatagaagat

SEQ ID NO: 57567 - DNA, 20 bp, Streptococcus pyogenes
tggtcgattaacctcactaa

SEQ ID NO: 57568 - DNA, 20 bp, Streptococcus pyogenes
ggtcgattaacctcactaac

SEQ ID NO: 57569 - DNA, 20 bp, Streptococcus pyogenes
gtcgattaacctcactaact

SEQ ID NO: 57570 - DNA, 20 bp, Streptococcus pyogenes
tccaataagatgtttatctt

SEQ ID NO: 57571 - DNA, 20 bp, Streptococcus pyogenes
atcttgaagggttgctctac

SEQ ID NO: 57572 - DNA, 20 bp, Streptococcus pyogenes
tcttgaagggttgctctacc

SEQ ID NO: 57573 - DNA, 20 bp, Streptococcus pyogenes
aagggttgctctacctaaga

SEQ ID NO: 57574 - DNA, 20 bp, Streptococcus pyogenes
ctctacctaagacttgtccc

SEQ ID NO: 57575 - DNA, 20 bp, Streptococcus pyogenes
gattttcgacactagtagct

SEQ ID NO: 57576 - DNA, 20 bp, Streptococcus pyogenes
attttcgacactagtagcta

SEQ ID NO: 57577 - DNA, 20 bp, Streptococcus pyogenes
tcgacactagtagctacaaa

SEQ ID NO: 57578 - DNA, 20 bp, Streptococcus pyogenes
cgacactagtagctacaaaa

SEQ ID NO: 57579 - DNA, 20 bp, Streptococcus pyogenes
gacactagtagctacaaaag

SEQ ID NO: 57580 - DNA, 20 bp, Streptococcus pyogenes
aattgacgacctttgcatcg

SEQ ID NO: 57581 - DNA, 20 bp, Streptococcus pyogenes
acgacctttgcatcggaaat

SEQ ID NO: 57582 - DNA, 20 bp, Streptococcus pyogenes
gcatcggaaatgccccattg

SEQ ID NO: 57583 - DNA, 20 bp, Streptococcus pyogenes
catcggaaatgccccattgt

SEQ ID NO: 57584 - DNA, 20 bp, Streptococcus pyogenes
tcttaattgttttttcattt

SEQ ID NO: 57585 - DNA, 20 bp, Streptococcus pyogenes
tttagcatctttttcgtata

SEQ ID NO: 57586 - DNA, 20 bp, Streptococcus pyogenes
agcatctttttcgtataaaa

SEQ ID NO: 57587 - DNA, 20 bp, Streptococcus pyogenes
gcatctttttcgtataaaac

SEQ ID NO: 57588 - DNA, 20 bp, Streptococcus pyogenes
ttcgtataaaactttgccac

SEQ ID NO: 57589 - DNA, 20 bp, Streptococcus pyogenes
tcgtataaaactttgccact

SEQ ID NO: 57590 - DNA, 20 bp, Streptococcus pyogenes
cgatcttgtcagtatccgct

SEQ ID NO: 57591 - DNA, 20 bp, Streptococcus pyogenes
tcagtatccgctttggcagc

SEQ ID NO: 57592 - DNA, 20 bp, Streptococcus pyogenes
ggcagcttgtggtaataaaa

SEQ ID NO: 57593 - DNA, 20 bp, Streptococcus pyogenes
gcagcttgtggtaataaaaa

SEQ ID NO: 57594 - DNA, 20 bp, Streptococcus pyogenes
tggtaataaaaatgcttcag

SEQ ID NO: 57595 - DNA, 20 bp, Streptococcus pyogenes
tgtgactggtttgaagcacg

SEQ ID NO: 57596 - DNA, 20 bp, Streptococcus pyogenes
gtgactggtttgaagcacgc

SEQ ID NO: 57597 - DNA, 20 bp, Streptococcus pyogenes
tgactggtttgaagcacgcg

SEQ ID NO: 57598 - DNA, 20 bp, Streptococcus pyogenes
gaagcacgcggttgacgata

SEQ ID NO: 57599 - DNA, 20 bp, Streptococcus pyogenes
aagcacgcggttgacgataa

SEQ ID NO: 57600 - DNA, 20 bp, Streptococcus pyogenes
acctcaaaatcatctatgga

SEQ ID NO: 57601 - DNA, 20 bp, Streptococcus pyogenes
cataaaaatgaaaactactg

SEQ ID NO: 57602 - DNA, 20 bp, Streptococcus pyogenes
ggatagaatctgttaaattg

SEQ ID NO: 57603 - DNA, 20 bp, Streptococcus pyogenes
aattgacttactcagatggt

SEQ ID NO: 57604 - DNA, 20 bp, Streptococcus pyogenes
acttactcagatggttcaga

SEQ ID NO: 57605 - DNA, 20 bp, Streptococcus pyogenes
acaacaaggattttcgtcaa

SEQ ID NO: 57606 - DNA, 20 bp, Streptococcus pyogenes
tcgtcaagctattcagtttg

SEQ ID NO: 57607 - DNA, 20 bp, Streptococcus pyogenes
cgtcaagctattcagtttgc

SEQ ID NO: 57608 - DNA, 20 bp, Streptococcus pyogenes
gtcaagctattcagtttgct

SEQ ID NO: 57609 - DNA, 20 bp, Streptococcus pyogenes
agtttgcttttgaccgagcg

SEQ ID NO: 57610 - DNA, 20 bp, Streptococcus pyogenes
aacagctgaaggtgtaacct

SEQ ID NO: 57611 - DNA, 20 bp, Streptococcus pyogenes
acagctgaaggtgtaacctt

SEQ ID NO: 57612 - DNA, 20 bp, Streptococcus pyogenes
ccagttcaattagattaccc

SEQ ID NO: 57613 - DNA, 20 bp, Streptococcus pyogenes
aattagattaccctgttgac

SEQ ID NO: 57614 - DNA, 20 bp, Streptococcus pyogenes
gattaccctgttgaccaagc

SEQ ID NO: 57615 - DNA, 20 bp, Streptococcus pyogenes
gtcatgagaaaatcatttta

SEQ ID NO: 57616 - DNA, 20 bp, Streptococcus pyogenes
tacagctggctgatgacaca

SEQ ID NO: 57617 - DNA, 20 bp, Streptococcus pyogenes
acagctggctgatgacacaa

SEQ ID NO: 57618 - DNA, 20 bp, Streptococcus pyogenes
cagctggctgatgacacaac

SEQ ID NO: 57619 - DNA, 20 bp, Streptococcus pyogenes
atttgatttagggttacgtt

SEQ ID NO: 57620 - DNA, 20 bp, Streptococcus pyogenes
gtcgttagtacctttggcga

SEQ ID NO: 57621 - DNA, 20 bp, Streptococcus pyogenes
tcgttagtacctttggcgac

SEQ ID NO: 57622 - DNA, 20 bp, Streptococcus pyogenes
gtacctttggcgacagcgca

SEQ ID NO: 57623 - DNA, 20 bp, Streptococcus pyogenes
ggcgacagcgcaggcacaag

SEQ ID NO: 57624 - DNA, 20 bp, Streptococcus pyogenes
gcgacagcgcaggcacaaga

SEQ ID NO: 57625 - DNA, 20 bp, Streptococcus pyogenes
gtcatgtacctagcagtgag

SEQ ID NO: 57626 - DNA, 20 bp, Streptococcus pyogenes
ccccaagcatctgccacctc

SEQ ID NO: 57627 - DNA, 20 bp, Streptococcus pyogenes
ctatggcaccacctgcgaca

SEQ ID NO: 57628 - DNA, 20 bp, Streptococcus pyogenes
agaggtggcagatgcttggg

SEQ ID NO: 57629 - DNA, 20 bp, Streptococcus pyogenes
gggtaatggctcactgctag

SEQ ID NO: 57630 - DNA, 20 bp, Streptococcus pyogenes
cttacgctccaaaccatgcc

SEQ ID NO: 57631 - DNA, 20 bp, Streptococcus pyogenes
ttacgctccaaaccatgcct

SEQ ID NO: 57632 - DNA, 20 bp, Streptococcus pyogenes
cgctccaaaccatgcctaca

SEQ ID NO: 57633 - DNA, 20 bp, Streptococcus pyogenes
aaccacaaacagcagccttc

SEQ ID NO: 57634 - DNA, 20 bp, Streptococcus pyogenes
aaagaagaagtggcttctgc

SEQ ID NO: 57635 - DNA, 20 bp, Streptococcus pyogenes
cagaaaaccattatgatcat

SEQ ID NO: 57636 - DNA, 20 bp, Streptococcus pyogenes
tgatcatgttcatgtctcct

SEQ ID NO: 57637 - DNA, 20 bp, Streptococcus pyogenes
atgtctcctttaatgcttaa

SEQ ID NO: 57638 - DNA, 20 bp, Streptococcus pyogenes
aatgcttaattcatgctatt

SEQ ID NO: 57639 - DNA, 20 bp, Streptococcus pyogenes
atgcttaattcatgctatta

SEQ ID NO: 57640 - DNA, 20 bp, Streptococcus pyogenes
cgaagcttttgcaacacctc

SEQ ID NO: 57641 - DNA, 20 bp, Streptococcus pyogenes
tgcaacacctcgaaaacctg

SEQ ID NO: 57642 - DNA, 20 bp, Streptococcus pyogenes
gcaacacctcgaaaacctga

SEQ ID NO: 57643 - DNA, 20 bp, Streptococcus pyogenes
caacacctcgaaaacctgaa

SEQ ID NO: 57644 - DNA, 20 bp, Streptococcus pyogenes
tattgttggtactggtttag

SEQ ID NO: 57645 - DNA, 20 bp, Streptococcus pyogenes
ccggtgcgtcttatttagat

SEQ ID NO: 57646 - DNA, 20 bp, Streptococcus pyogenes
tttagatgaattttattggt

SEQ ID NO: 57647 - DNA, 20 bp, Streptococcus pyogenes
agatgaattttattggttgg

SEQ ID NO: 57648 - DNA, 20 bp, Streptococcus pyogenes
gatgaattttattggttgga

SEQ ID NO: 57649 - DNA, 20 bp, Streptococcus pyogenes
tattggttggataaggatga

SEQ ID NO: 57650 - DNA, 20 bp, Streptococcus pyogenes
gccagatttcacctccctca

SEQ ID NO: 57651 - DNA, 20 bp, Streptococcus pyogenes
ccagatttcacctccctcaa

SEQ ID NO: 57652 - DNA, 20 bp, Streptococcus pyogenes
cacctccctcaagttcaaca

SEQ ID NO: 57653 - DNA, 20 bp, Streptococcus pyogenes
acctccctcaagttcaacaa

SEQ ID NO: 57654 - DNA, 20 bp, Streptococcus pyogenes
aacaaatataaccaatatga

SEQ ID NO: 57655 - DNA, 20 bp, Streptococcus pyogenes
ggtggttcttggaatttatg

SEQ ID NO: 57656 - DNA, 20 bp, Streptococcus pyogenes
ttggaatttatgggaaaatc

SEQ ID NO: 57657 - DNA, 20 bp, Streptococcus pyogenes
gaatttatgggaaaatctag

SEQ ID NO: 57658 - DNA, 20 bp, Streptococcus pyogenes
atgggaaaatctagctgctc

SEQ ID NO: 57659 - DNA, 20 bp, Streptococcus pyogenes
tgggaaaatctagctgctca

SEQ ID NO: 57660 - DNA, 20 bp, Streptococcus pyogenes
acggtctttattccaatagt

SEQ ID NO: 57661 - DNA, 20 bp, Streptococcus pyogenes
cggtctttattccaatagtg

SEQ ID NO: 57662 - DNA, 20 bp, Streptococcus pyogenes
attccaatagtgagggcaat

SEQ ID NO: 57663 - DNA, 20 bp, Streptococcus pyogenes
ttccaatagtgagggcaatt

SEQ ID NO: 57664 - DNA, 20 bp, Streptococcus pyogenes
caatagtgagggcaattacg

SEQ ID NO: 57665 - DNA, 20 bp, Streptococcus pyogenes
tgatcaatttatcattgcta

SEQ ID NO: 57666 - DNA, 20 bp, Streptococcus pyogenes
gatcaatttatcattgctaa

SEQ ID NO: 57667 - DNA, 20 bp, Streptococcus pyogenes
atcaatttatcattgctaaa

SEQ ID NO: 57668 - DNA, 20 bp, Streptococcus pyogenes
atcattgctaaaacaccagc

SEQ ID NO: 57669 - DNA, 20 bp, Streptococcus pyogenes
tcattgctaaaacaccagca

SEQ ID NO: 57670 - DNA, 20 bp, Streptococcus pyogenes
aactatggtatgtatggcac

SEQ ID NO: 57671 - DNA, 20 bp, Streptococcus pyogenes
actatggtatgtatggcaca

SEQ ID NO: 57672 - DNA, 20 bp, Streptococcus pyogenes
acctatgttcaaaatggact

SEQ ID NO: 57673 - DNA, 20 bp, Streptococcus pyogenes
aaaatggactcttagcttct

SEQ ID NO: 57674 - DNA, 20 bp, Streptococcus pyogenes
gcttctattttattgaccac

SEQ ID NO: 57675 - DNA, 20 bp, Streptococcus pyogenes
atatttgaacgcctctttgc

SEQ ID NO: 57676 - DNA, 20 bp, Streptococcus pyogenes
gaacgcctctttgcagaacc

SEQ ID NO: 57677 - DNA, 20 bp, Streptococcus pyogenes
aacgcctctttgcagaacca

SEQ ID NO: 57678 - DNA, 20 bp, Streptococcus pyogenes
gcagaaccaatgggtggtgg

SEQ ID NO: 57679 - DNA, 20 bp, Streptococcus pyogenes
cagaaccaatgggtggtggt

SEQ ID NO: 57680 - DNA, 20 bp, Streptococcus pyogenes
gtgaaccgctgattcgcgtt

SEQ ID NO: 57681 - DNA, 20 bp, Streptococcus pyogenes
gcgttagccccaatcagttt

SEQ ID NO: 57682 - DNA, 20 bp, Streptococcus pyogenes
gccccaatcagtttcagcct

SEQ ID NO: 57683 - DNA, 20 bp, Streptococcus pyogenes
cagcctttgaccaatgcctg

SEQ ID NO: 57684 - DNA, 20 bp, Streptococcus pyogenes
agcctttgaccaatgcctgc

SEQ ID NO: 57685 - DNA, 20 bp, Streptococcus pyogenes
ggccttagataaggatagtc

SEQ ID NO: 57686 - DNA, 20 bp, Streptococcus pyogenes
gataaggatagtcttgattt

SEQ ID NO: 57687 - DNA, 20 bp, Streptococcus pyogenes
atttagctgccatttttgaa

SEQ ID NO: 57688 - DNA, 20 bp, Streptococcus pyogenes
agctgccatttttgaaggca

SEQ ID NO: 57689 - DNA, 20 bp, Streptococcus pyogenes
gctgccatttttgaaggcat

SEQ ID NO: 57690 - DNA, 20 bp, Streptococcus pyogenes
atcagcgctatcagttacaa

SEQ ID NO: 57691 - DNA, 20 bp, Streptococcus pyogenes
tcagcgctatcagttacaag

SEQ ID NO: 57692 - DNA, 20 bp, Streptococcus pyogenes
caagctatttaccatacgga

SEQ ID NO: 57693 - DNA, 20 bp, Streptococcus pyogenes
accatacggagcgttcaaat

SEQ ID NO: 57694 - DNA, 20 bp, Streptococcus pyogenes
ccatacggagcgttcaaatg

SEQ ID NO: 57695 - DNA, 20 bp, Streptococcus pyogenes
accaaacttaaggctaatcg

SEQ ID NO: 57696 - DNA, 20 bp, Streptococcus pyogenes
aggctaatcggcttgtccta

SEQ ID NO: 57697 - DNA, 20 bp, Streptococcus pyogenes
tcctagttgtacgaggagag

SEQ ID NO: 57698 - DNA, 20 bp, Streptococcus pyogenes
tacgaggagagtctagtgag

SEQ ID NO: 57699 - DNA, 20 bp, Streptococcus pyogenes
ctcactagactctcctcgta

SEQ ID NO: 57700 - DNA, 20 bp, Streptococcus pyogenes
gatttgtcatcgttatagca

SEQ ID NO: 57701 - DNA, 20 bp, Streptococcus pyogenes
atttgtcatcgttatagcat

SEQ ID NO: 57702 - DNA, 20 bp, Streptococcus pyogenes
gtcatcgttatagcatacct

SEQ ID NO: 57703 - DNA, 20 bp, Streptococcus pyogenes
tcatcgttatagcatacctt

SEQ ID NO: 57704 - DNA, 20 bp, Streptococcus pyogenes
tagcataccttatttaccag

SEQ ID NO: 57705 - DNA, 20 bp, Streptococcus pyogenes
aggcaattacaactgactat

SEQ ID NO: 57706 - DNA, 20 bp, Streptococcus pyogenes
caactgactatgacgcttac

SEQ ID NO: 57707 - DNA, 20 bp, Streptococcus pyogenes
caaacaagcgcataagcctc

SEQ ID NO: 57708 - DNA, 20 bp, Streptococcus pyogenes
tcaaaaactgttgattacag

SEQ ID NO: 57709 - DNA, 20 bp, Streptococcus pyogenes
attacagaagtgaactcttg

SEQ ID NO: 57710 - DNA, 20 bp, Streptococcus pyogenes
atcagagtcaagctgatcac

SEQ ID NO: 57711 - DNA, 20 bp, Streptococcus pyogenes
aggacaactgtgtgtaaaaa

SEQ ID NO: 57712 - DNA, 20 bp, Streptococcus pyogenes
ggacaactgtgtgtaaaaat

SEQ ID NO: 57713 - DNA, 20 bp, Streptococcus pyogenes
ttttggatcgtgaagtaacg

SEQ ID NO: 57714 - DNA, 20 bp, Streptococcus pyogenes
tggatcgtgaagtaacgcaa

SEQ ID NO: 57715 - DNA, 20 bp, Streptococcus pyogenes
tgaatttaaagctttagtta

SEQ ID NO: 57716 - DNA, 20 bp, Streptococcus pyogenes
gaatttaaagctttagttaa

SEQ ID NO: 57717 - DNA, 20 bp, Streptococcus pyogenes
aatttaaagctttagttaat

SEQ ID NO: 57718 - DNA, 20 bp, Streptococcus pyogenes
aaagctttagttaatggaaa

SEQ ID NO: 57719 - DNA, 20 bp, Streptococcus pyogenes
aagctttagttaatggaaaa

SEQ ID NO: 57720 - DNA, 20 bp, Streptococcus pyogenes
agttaaaatacaattaccaa

SEQ ID NO: 57721 - DNA, 20 bp, Streptococcus pyogenes
gttaaaatacaattaccaaa

SEQ ID NO: 57722 - DNA, 20 bp, Streptococcus pyogenes
aaatacaattaccaaaggcc

SEQ ID NO: 57723 - DNA, 20 bp, Streptococcus pyogenes
ccaaaggccaatctgatttc

SEQ ID NO: 57724 - DNA, 20 bp, Streptococcus pyogenes
ctttgactgctatgggagaa

SEQ ID NO: 57725 - DNA, 20 bp, Streptococcus pyogenes
gtcgcttcaaacgttctgtt

SEQ ID NO: 57726 - DNA, 20 bp, Streptococcus pyogenes
aaacgttctgttactaaagc

SEQ ID NO: 57727 - DNA, 20 bp, Streptococcus pyogenes
tgttactaaagctggtactc

SEQ ID NO: 57728 - DNA, 20 bp, Streptococcus pyogenes
ctaaagctggtactcttcaa

SEQ ID NO: 57729 - DNA, 20 bp, Streptococcus pyogenes
aagaatcacgtaaacgtgaa

SEQ ID NO: 57730 - DNA, 20 bp, Streptococcus pyogenes
ctttttaggcatagcttttt

SEQ ID NO: 57731 - DNA, 20 bp, Streptococcus pyogenes
ttaggcatagctttttcagc

SEQ ID NO: 57732 - DNA, 20 bp, Streptococcus pyogenes
taggcatagctttttcagcg

SEQ ID NO: 57733 - DNA, 20 bp, Streptococcus pyogenes
aggcatagctttttcagcgg

SEQ ID NO: 57734 - DNA, 20 bp, Streptococcus pyogenes
ggcatagctttttcagcggc

SEQ ID NO: 57735 - DNA, 20 bp, Streptococcus pyogenes
ttatggggaggtgacgattt

SEQ ID NO: 57736 - DNA, 20 bp, Streptococcus pyogenes
tatggggaggtgacgatttg

SEQ ID NO: 57737 - DNA, 20 bp, Streptococcus pyogenes
atggggaggtgacgatttgg

SEQ ID NO: 57738 - DNA, 20 bp, Streptococcus pyogenes
tggggaggtgacgatttggc

SEQ ID NO: 57739 - DNA, 20 bp, Streptococcus pyogenes
ggcaattgacaaagaaatga

SEQ ID NO: 57740 - DNA, 20 bp, Streptococcus pyogenes
agattattgccgataagact

SEQ ID NO: 57741 - DNA, 20 bp, Streptococcus pyogenes
ttgccgataagactggtatg

SEQ ID NO: 57742 - DNA, 20 bp, Streptococcus pyogenes
ccgataagactggtatgtcg

SEQ ID NO: 57743 - DNA, 20 bp, Streptococcus pyogenes
atataccgccaagtcaggca

SEQ ID NO: 57744 - DNA, 20 bp, Streptococcus pyogenes
ctagccaacacaagcaccct

SEQ ID NO: 57745 - DNA, 20 bp, Streptococcus pyogenes
cttcaggattgtttcacttg

SEQ ID NO: 57746 - DNA, 20 bp, Streptococcus pyogenes
aggattgtttcacttgtccg

SEQ ID NO: 57747 - DNA, 20 bp, Streptococcus pyogenes
tttcacttgtccgatcaatc

SEQ ID NO: 57748 - DNA, 20 bp, Streptococcus pyogenes
cacttgtccgatcaatccaa

SEQ ID NO: 57749 - DNA, 20 bp, Streptococcus pyogenes
acttgtccgatcaatccaat

SEQ ID NO: 57750 - DNA, 20 bp, Streptococcus pyogenes
cttcaatggggacggcattg

SEQ ID NO: 57751 - DNA, 20 bp, Streptococcus pyogenes
aatggggacggcattgactc

SEQ ID NO: 57752 - DNA, 20 bp, Streptococcus pyogenes
actcaagaacatgtcaatca

SEQ ID NO: 57753 - DNA, 20 bp, Streptococcus pyogenes
agcaagtcactaaaaaagtt

SEQ ID NO: 57754 - DNA, 20 bp, Streptococcus pyogenes
ttttgatttatgatggtgac

SEQ ID NO: 57755 - DNA, 20 bp, Streptococcus pyogenes
ctcaatcaccatccatcaca

SEQ ID NO: 57756 - DNA, 20 bp, Streptococcus pyogenes
gtatattaacaagattgctg

SEQ ID NO: 57757 - DNA, 20 bp, Streptococcus pyogenes
acaagattgctgatttgttg

SEQ ID NO: 57758 - DNA, 20 bp, Streptococcus pyogenes
ctgatttgttgccaaacttt

SEQ ID NO: 57759 - DNA, 20 bp, Streptococcus pyogenes
gttgccaaactttgactatt

SEQ ID NO: 57760 - DNA, 20 bp, Streptococcus pyogenes
tagcagagcgcgatcttcac

SEQ ID NO: 57761 - DNA, 20 bp, Streptococcus pyogenes
agcagagcgcgatcttcaca

SEQ ID NO: 57762 - DNA, 20 bp, Streptococcus pyogenes
gcagagcgcgatcttcacaa

SEQ ID NO: 57763 - DNA, 20 bp, Streptococcus pyogenes
acaaacaagggaaaaaagtt

SEQ ID NO: 57764 - DNA, 20 bp, Streptococcus pyogenes
gagaatctagtaacaaaggc

SEQ ID NO: 57765 - DNA, 20 bp, Streptococcus pyogenes
gtggctgcttttaaatcaac

SEQ ID NO: 57766 - DNA, 20 bp, Streptococcus pyogenes
taaatcaaccctagaagaaa

SEQ ID NO: 57767 - DNA, 20 bp, Streptococcus pyogenes
aaatcaaccctagaagaaag

SEQ ID NO: 57768 - DNA, 20 bp, Streptococcus pyogenes
aatcaaccctagaagaaagc

SEQ ID NO: 57769 - DNA, 20 bp, Streptococcus pyogenes
gctgttacatgtgattgatg

SEQ ID NO: 57770 - DNA, 20 bp, Streptococcus pyogenes
gaatcgagttgctcttttag

SEQ ID NO: 57771 - DNA, 20 bp, Streptococcus pyogenes
aatcgagttgctcttttaga

SEQ ID NO: 57772 - DNA, 20 bp, Streptococcus pyogenes
ctcttttagaccactacacg

SEQ ID NO: 57773 - DNA, 20 bp, Streptococcus pyogenes
tagaccactacacgtttgac

SEQ ID NO: 57774 - DNA, 20 bp, Streptococcus pyogenes
agaccactacacgtttgacc

SEQ ID NO: 57775 - DNA, 20 bp, Streptococcus pyogenes
ttattttaatctttctaagg

SEQ ID NO: 57776 - DNA, 20 bp, Streptococcus pyogenes
ttttaatctttctaaggctt

SEQ ID NO: 57777 - DNA, 20 bp, Streptococcus pyogenes
taatctttctaaggctttgg

SEQ ID NO: 57778 - DNA, 20 bp, Streptococcus pyogenes
aatctttctaaggctttggg

SEQ ID NO: 57779 - DNA, 20 bp, Streptococcus pyogenes
atctttctaaggctttgggg

SEQ ID NO: 57780 - DNA, 20 bp, Streptococcus pyogenes
tcgaagatttaccgtctggc

SEQ ID NO: 57781 - DNA, 20 bp, Streptococcus pyogenes
accgtctggcaaacggtatc

SEQ ID NO: 57782 - DNA, 20 bp, Streptococcus pyogenes
ccgtctggcaaacggtatca

SEQ ID NO: 57783 - DNA, 20 bp, Streptococcus pyogenes
aggggtttaatgtagaggag

SEQ ID NO: 57784 - DNA, 20 bp, Streptococcus pyogenes
aatgtagaggagttatgggc

SEQ ID NO: 57785 - DNA, 20 bp, Streptococcus pyogenes
tagaaacgacgattaagcca

SEQ ID NO: 57786 - DNA, 20 bp, Streptococcus pyogenes
agaaacgacgattaagccac

SEQ ID NO: 57787 - DNA, 20 bp, Streptococcus pyogenes
gaaacgacgattaagccacg

SEQ ID NO: 57788 - DNA, 20 bp, Streptococcus pyogenes
agccacgaaaaataagaaag

SEQ ID NO: 57789 - DNA, 20 bp, Streptococcus pyogenes
tcattactcatttgcatgga

SEQ ID NO: 57790 - DNA, 20 bp, Streptococcus pyogenes
tttgcatgggttatcgagta

SEQ ID NO: 57791 - DNA, 20 bp, Streptococcus pyogenes
ttgcatgggttatcgagtag

SEQ ID NO: 57792 - DNA, 20 bp, Streptococcus pyogenes
tgcatgggttatcgagtagt

SEQ ID NO: 57793 - DNA, 20 bp, Streptococcus pyogenes
gcatgggttatcgagtagtt

SEQ ID NO: 57794 - DNA, 20 bp, Streptococcus pyogenes
catgggttatcgagtagttc

SEQ ID NO: 57795 - DNA, 20 bp, Streptococcus pyogenes
taccaacatgcaggcagcac

SEQ ID NO: 57796 - DNA, 20 bp, Streptococcus pyogenes
ctcaatcatgtatcagctcg

SEQ ID NO: 57797 - DNA, 20 bp, Streptococcus pyogenes
ttagggcgtgattgtcgcca

SEQ ID NO: 57798 - DNA, 20 bp, Streptococcus pyogenes
tagggcgtgattgtcgccag

SEQ ID NO: 57799 - DNA, 20 bp, Streptococcus pyogenes
agggcgtgattgtcgccaga

SEQ ID NO: 57800 - DNA, 20 bp, Streptococcus pyogenes
tcagcatattgacaacaaag

SEQ ID NO: 57801 - DNA, 20 bp, Streptococcus pyogenes
acaacaaagaatgcctcgag

SEQ ID NO: 57802 - DNA, 20 bp, Streptococcus pyogenes
gatattaccaatccagtagc

SEQ ID NO: 57803 - DNA, 20 bp, Streptococcus pyogenes
ccaatccagtagccattgag

SEQ ID NO: 57804 - DNA, 20 bp, Streptococcus pyogenes
agaaaatggtcgcccagatt

SEQ ID NO: 57805 - DNA, 20 bp, Streptococcus pyogenes
attcagccaccaagtttgcc

SEQ ID NO: 57806 - DNA, 20 bp, Streptococcus pyogenes
ttcagccaccaagtttgccc

SEQ ID NO: 57807 - DNA, 20 bp, Streptococcus pyogenes
agccaccaagtttgccctta

SEQ ID NO: 57808 - DNA, 20 bp, Streptococcus pyogenes
gcccttatcggattttccaa

SEQ ID NO: 57809 - DNA, 20 bp, Streptococcus pyogenes
cccttatcggattttccaat

SEQ ID NO: 57810 - DNA, 20 bp, Streptococcus pyogenes
gatgagtttttaacagcgga

SEQ ID NO: 57811 - DNA, 20 bp, Streptococcus pyogenes
ttaacagcggacttgtctca

SEQ ID NO: 57812 - DNA, 20 bp, Streptococcus pyogenes
taacagcggacttgtctcaa

SEQ ID NO: 57813 - DNA, 20 bp, Streptococcus pyogenes
aacagcggacttgtctcaac

SEQ ID NO: 57814 - DNA, 20 bp, Streptococcus pyogenes
acagcggacttgtctcaact

SEQ ID NO: 57815 - DNA, 20 bp, Streptococcus pyogenes
ttgacacgcctaaacgggtt

SEQ ID NO: 57816 - DNA, 20 bp, Streptococcus pyogenes
acacgcctaaacgggttgct

SEQ ID NO: 57817 - DNA, 20 bp, Streptococcus pyogenes
ctaaaatgtatgcggagatg

SEQ ID NO: 57818 - DNA, 20 bp, Streptococcus pyogenes
ttgggactgggaaaagatcc

SEQ ID NO: 57819 - DNA, 20 bp, Streptococcus pyogenes
tgggactgggaaaagatcct

SEQ ID NO: 57820 - DNA, 20 bp, Streptococcus pyogenes
gacctctcaaatagcggatg

SEQ ID NO: 57821 - DNA, 20 bp, Streptococcus pyogenes
acctctcaaatagcggatgc

SEQ ID NO: 57822 - DNA, 20 bp, Streptococcus pyogenes
agttgaagccctcaatccta

SEQ ID NO: 57823 - DNA, 20 bp, Streptococcus pyogenes
gttgaagccctcaatcctaa

SEQ ID NO: 57824 - DNA, 20 bp, Streptococcus pyogenes
aagccctcaatcctaaaggg

SEQ ID NO: 57825 - DNA, 20 bp, Streptococcus pyogenes
cactactgtgcaaaaagcat

SEQ ID NO: 57826 - DNA, 20 bp, Streptococcus pyogenes
gatcacgttgagcaaatgat

SEQ ID NO: 57827 - DNA, 20 bp, Streptococcus pyogenes
agcaaatgattgctgatggg

SEQ ID NO: 57828 - DNA, 20 bp, Streptococcus pyogenes
ctgatggggctaaaatcatc

SEQ ID NO: 57829 - DNA, 20 bp, Streptococcus pyogenes
gtggagaatcaacacgtcca

SEQ ID NO: 57830 - DNA, 20 bp, Streptococcus pyogenes
atgcataaccaagacgaaga

SEQ ID NO: 57831 - DNA, 20 bp, Streptococcus pyogenes
atcaagaggtaacacaagac

SEQ ID NO: 57832 - DNA, 20 bp, Streptococcus pyogenes
tcaagaggtaacacaagacg

SEQ ID NO: 57833 - DNA, 20 bp, Streptococcus pyogenes
gtgattttctaggcaataga

SEQ ID NO: 57834 - DNA, 20 bp, Streptococcus pyogenes
tgattttctaggcaatagag

SEQ ID NO: 57835 - DNA, 20 bp, Streptococcus pyogenes
tgcccttggaaaaggctgtc

SEQ ID NO: 57836 - DNA, 20 bp, Streptococcus pyogenes
gaaaaggctgtcagattgta

SEQ ID NO: 57837 - DNA, 20 bp, Streptococcus pyogenes
tacgcgtacacgatgtcaag

SEQ ID NO: 57838 - DNA, 20 bp, Streptococcus pyogenes
tggctgtgttgagccagttg

SEQ ID NO: 57839 - DNA, 20 bp, Streptococcus pyogenes
agccagttgatgtgaggact

SEQ ID NO: 57840 - DNA, 20 bp, Streptococcus pyogenes
attttgattgaacgtttagc

SEQ ID NO: 57841 - DNA, 20 bp, Streptococcus pyogenes
ttttgattgaacgtttagca

SEQ ID NO: 57842 - DNA, 20 bp, Streptococcus pyogenes
tgattgaacgtttagcaggt

SEQ ID NO: 57843 - DNA, 20 bp, Streptococcus pyogenes
gattgaacgtttagcaggtg

SEQ ID NO: 57844 - DNA, 20 bp, Streptococcus pyogenes
attgaacgtttagcaggtgc

SEQ ID NO: 57845 - DNA, 20 bp, Streptococcus pyogenes
accgcggctgatttcttaaa

SEQ ID NO: 57846 - DNA, 20 bp, Streptococcus pyogenes
cttaaaagaaacacaagcta

SEQ ID NO: 57847 - DNA, 20 bp, Streptococcus pyogenes
ttaaaagaaacacaagctat

SEQ ID NO: 57848 - DNA, 20 bp, Streptococcus pyogenes
aaagaaacacaagctattga

SEQ ID NO: 57849 - DNA, 20 bp, Streptococcus pyogenes
agcaatctcttggtcgtgtg

SEQ ID NO: 57850 - DNA, 20 bp, Streptococcus pyogenes
cactaaggtaggtggcccag

SEQ ID NO: 57851 - DNA, 20 bp, Streptococcus pyogenes
cttggcttttcctagaaatc

SEQ ID NO: 57852 - DNA, 20 bp, Streptococcus pyogenes
ttggcttttcctagaaatca

SEQ ID NO: 57853 - DNA, 20 bp, Streptococcus pyogenes
gcttttcctagaaatcacta

SEQ ID NO: 57854 - DNA, 20 bp, Streptococcus pyogenes
tcctagaaatcactacgagc

SEQ ID NO: 57855 - DNA, 20 bp, Streptococcus pyogenes
ctggaagcattgggggtgct

SEQ ID NO: 57856 - DNA, 20 bp, Streptococcus pyogenes
ggggtgctgtttttatgaat

SEQ ID NO: 57857 - DNA, 20 bp, Streptococcus pyogenes
ttatgaatgcgggtgcttat

SEQ ID NO: 57858 - DNA, 20 bp, Streptococcus pyogenes
tatgaatgcgggtgcttatg

SEQ ID NO: 57859 - DNA, 20 bp, Streptococcus pyogenes
atgaatgcgggtgcttatgg

SEQ ID NO: 57860 - DNA, 20 bp, Streptococcus pyogenes
gcaggtcaattaatcatgga

SEQ ID NO: 57861 - DNA, 20 bp, Streptococcus pyogenes
caggtcaattaatcatggaa

SEQ ID NO: 57862 - DNA, 20 bp, Streptococcus pyogenes
atcatggaagcaaatcttaa

SEQ ID NO: 57863 - DNA, 20 bp, Streptococcus pyogenes
aagggcatcggattggtggt

SEQ ID NO: 57864 - DNA, 20 bp, Streptococcus pyogenes
gtggtgtggaagtttccgaa

SEQ ID NO: 57865 - DNA, 20 bp, Streptococcus pyogenes
aaactgcacaacgaaaatca

SEQ ID NO: 57866 - DNA, 20 bp, Streptococcus pyogenes
agattctgtcttccctacca

SEQ ID NO: 57867 - DNA, 20 bp, Streptococcus pyogenes
tgtcttccctaccatctgtg

SEQ ID NO: 57868 - DNA, 20 bp, Streptococcus pyogenes
cctaccatctgtggttgtgg

SEQ ID NO: 57869 - DNA, 20 bp, Streptococcus pyogenes
tggggctctttggttacttg

SEQ ID NO: 57870 - DNA, 20 bp, Streptococcus pyogenes
tttagcgttcataatttctc

SEQ ID NO: 57871 - DNA, 20 bp, Streptococcus pyogenes
ttagcgttcataatttctct

SEQ ID NO: 57872 - DNA, 20 bp, Streptococcus pyogenes
tagcgttcataatttctctt

SEQ ID NO: 57873 - DNA, 20 bp, Streptococcus pyogenes
agcgttcataatttctcttt

SEQ ID NO: 57874 - DNA, 20 bp, Streptococcus pyogenes
gcgttcataatttctctttc

SEQ ID NO: 57875 - DNA, 20 bp, Streptococcus pyogenes
aggacaacacgccaaatggt

SEQ ID NO: 57876 - DNA, 20 bp, Streptococcus pyogenes
gccaacgtgttgctcccata

SEQ ID NO: 57877 - DNA, 20 bp, Streptococcus pyogenes
ccaacgtgttgctcccatag

SEQ ID NO: 57878 - DNA, 20 bp, Streptococcus pyogenes
ctcccatagccatagacgct

SEQ ID NO: 57879 - DNA, 20 bp, Streptococcus pyogenes
gcggtaatgacgaggcaccg

SEQ ID NO: 57880 - DNA, 20 bp, Streptococcus pyogenes
aggtgagatttcagtcataa

SEQ ID NO: 57881 - DNA, 20 bp, Streptococcus pyogenes
ggtgagatttcagtcataaa

SEQ ID NO: 57882 - DNA, 20 bp, Streptococcus pyogenes
cagtcataaaaacggctgcg

SEQ ID NO: 57883 - DNA, 20 bp, Streptococcus pyogenes
agtcataaaaacggctgcgc

SEQ ID NO: 57884 - DNA, 20 bp, Streptococcus pyogenes
gcagagcaccaagataagga

SEQ ID NO: 57885 - DNA, 20 bp, Streptococcus pyogenes
aattctttgatggtgaggct

SEQ ID NO: 57886 - DNA, 20 bp, Streptococcus pyogenes
tttgatggtgaggctaattt

SEQ ID NO: 57887 - DNA, 20 bp, Streptococcus pyogenes
gatggtgaggctaatttttt

SEQ ID NO: 57888 - DNA, 20 bp, Streptococcus pyogenes
atggtgaggctaatttttta

SEQ ID NO: 57889 - DNA, 20 bp, Streptococcus pyogenes
tttagccaattcctgatttt

SEQ ID NO: 57890 - DNA, 20 bp, Streptococcus pyogenes
caaagatttaacagatgaat

SEQ ID NO: 57891 - DNA, 20 bp, Streptococcus pyogenes
aacagatgaatcaacgtagg

SEQ ID NO: 57892 - DNA, 20 bp, Streptococcus pyogenes
acagatgaatcaacgtaggc

SEQ ID NO: 57893 - DNA, 20 bp, Streptococcus pyogenes
gtgaaacaatcgatttaacc

SEQ ID NO: 57894 - DNA, 20 bp, Streptococcus pyogenes
tgaaacaatcgatttaacca

SEQ ID NO: 57895 - DNA, 20 bp, Streptococcus pyogenes
atgatcaactaatttagaag

SEQ ID NO: 57896 - DNA, 20 bp, Streptococcus pyogenes
agaagcatcaataccatctt

SEQ ID NO: 57897 - DNA, 20 bp, Streptococcus pyogenes
gaagcatcaataccatcttt

SEQ ID NO: 57898 - DNA, 20 bp, Streptococcus pyogenes
ttcttccgcaaagacatcac

SEQ ID NO: 57899 - DNA, 20 bp, Streptococcus pyogenes
tcttccgcaaagacatcact

SEQ ID NO: 57900 - DNA, 20 bp, Streptococcus pyogenes
gcaaatcctagaccattgcc

SEQ ID NO: 57901 - DNA, 20 bp, Streptococcus pyogenes
ccattaatgagtaattggta

SEQ ID NO: 57902 - DNA, 20 bp, Streptococcus pyogenes
atgagtaattggtaccagcc

SEQ ID NO: 57903 - DNA, 20 bp, Streptococcus pyogenes
gtaccagcctgttggataag

SEQ ID NO: 57904 - DNA, 20 bp, Streptococcus pyogenes
gataagattggggcaaagta

SEQ ID NO: 57905 - DNA, 20 bp, Streptococcus pyogenes
ctgatagggtaaggtttaga

SEQ ID NO: 57906 - DNA, 20 bp, Streptococcus pyogenes
agatggtctttttcaaacat

SEQ ID NO: 57907 - DNA, 20 bp, Streptococcus pyogenes
gatggtctttttcaaacatt

SEQ ID NO: 57908 - DNA, 20 bp, Streptococcus pyogenes
ttcaaacattttccaaagac

SEQ ID NO: 57909 - DNA, 20 bp, Streptococcus pyogenes
tcaaacattttccaaagacg

SEQ ID NO: 57910 - DNA, 20 bp, Streptococcus pyogenes
taacatggctaaggcgtctt

SEQ ID NO: 57911 - DNA, 20 bp, Streptococcus pyogenes
aacatggctaaggcgtcttc

SEQ ID NO: 57912 - DNA, 20 bp, Streptococcus pyogenes
acatggctaaggcgtcttct

SEQ ID NO: 57913 - DNA, 20 bp, Streptococcus pyogenes
taaaatagatttttgcaact

SEQ ID NO: 57914 - DNA, 20 bp, Streptococcus pyogenes
ttgcaacttggcacattctg

SEQ ID NO: 57915 - DNA, 20 bp, Streptococcus pyogenes
gtcaacacggaaaacttttg

SEQ ID NO: 57916 - DNA, 20 bp, Streptococcus pyogenes
tgggcgtgtagtcactaaga

SEQ ID NO: 57917 - DNA, 20 bp, Streptococcus pyogenes
gggcgtgtagtcactaagac

SEQ ID NO: 57918 - DNA, 20 bp, Streptococcus pyogenes
ggcgtgtagtcactaagacc

SEQ ID NO: 57919 - DNA, 20 bp, Streptococcus pyogenes
ctccagagtaatgacctcgg

SEQ ID NO: 57920 - DNA, 20 bp, Streptococcus pyogenes
tgtcatcccaatcgtgcttt

SEQ ID NO: 57921 - DNA, 20 bp, Streptococcus pyogenes
cgactgtcacgtcactgatt

SEQ ID NO: 57922 - DNA, 20 bp, Streptococcus pyogenes
gactgtcacgtcactgattc

SEQ ID NO: 57923 - DNA, 20 bp, Streptococcus pyogenes
cagcaattttatagaggctg

SEQ ID NO: 57924 - DNA, 20 bp, Streptococcus pyogenes
tatagaggctgtcctgaact

SEQ ID NO: 57925 - DNA, 20 bp, Streptococcus pyogenes
agttactctccattatacca

SEQ ID NO: 57926 - DNA, 20 bp, Streptococcus pyogenes
gttactctccattataccat

SEQ ID NO: 57927 - DNA, 20 bp, Streptococcus pyogenes
ctctccattataccatatct

SEQ ID NO: 57928 - DNA, 20 bp, Streptococcus pyogenes
taccatatcttagcgcagac

SEQ ID NO: 57929 - DNA, 20 bp, Streptococcus pyogenes
gcgcagacctaatttggcta

SEQ ID NO: 57930 - DNA, 20 bp, Streptococcus pyogenes
ctgccggacggttcgtccga

SEQ ID NO: 57931 - DNA, 20 bp, Streptococcus pyogenes
gtccgaaatctccttcgtca

SEQ ID NO: 57932 - DNA, 20 bp, Streptococcus pyogenes
gtcatctttacggaaacgag

SEQ ID NO: 57933 - DNA, 20 bp, Streptococcus pyogenes
acggaaacgagcatagttga

SEQ ID NO: 57934 - DNA, 20 bp, Streptococcus pyogenes
cggaaacgagcatagttgag

SEQ ID NO: 57935 - DNA, 20 bp, Streptococcus pyogenes
ttgctctccaagattaaatg

SEQ ID NO: 57936 - DNA, 20 bp, Streptococcus pyogenes
ctctccaagattaaatgcac

SEQ ID NO: 57937 - DNA, 20 bp, Streptococcus pyogenes
aatgcactatttaatttaag

SEQ ID NO: 57938 - DNA, 20 bp, Streptococcus pyogenes
aatttaagatcatacgaatt

SEQ ID NO: 57939 - DNA, 20 bp, Streptococcus pyogenes
atttaagatcatacgaatta

SEQ ID NO: 57940 - DNA, 20 bp, Streptococcus pyogenes
catacatccttttttcttat

SEQ ID NO: 57941 - DNA, 20 bp, Streptococcus pyogenes
atacatccttttttcttatg

SEQ ID NO: 57942 - DNA, 20 bp, Streptococcus pyogenes
tttcttatgcttcctttttt

SEQ ID NO: 57943 - DNA, 20 bp, Streptococcus pyogenes
ttcttatgcttccttttttg

SEQ ID NO: 57944 - DNA, 20 bp, Streptococcus pyogenes
tcttatgcttccttttttga

SEQ ID NO: 57945 - DNA, 20 bp, Streptococcus pyogenes
tcgattttcttgtaaaacca

SEQ ID NO: 57946 - DNA, 20 bp, Streptococcus pyogenes
tcttgtaaaaccactacacc

SEQ ID NO: 57947 - DNA, 20 bp, Streptococcus pyogenes
cttgtaaaaccactacaccg

SEQ ID NO: 57948 - DNA, 20 bp, Streptococcus pyogenes
ttgtaaaaccactacaccgc

SEQ ID NO: 57949 - DNA, 20 bp, Streptococcus pyogenes
taaaaccactacaccgccac

SEQ ID NO: 57950 - DNA, 20 bp, Streptococcus pyogenes
ttctttatccaaatggacct

SEQ ID NO: 57951 - DNA, 20 bp, Streptococcus pyogenes
tttatccaaatggacctgtc

SEQ ID NO: 57952 - DNA, 20 bp, Streptococcus pyogenes
atccaaatggacctgtcctt

SEQ ID NO: 57953 - DNA, 20 bp, Streptococcus pyogenes
tccaaatggacctgtccttg

SEQ ID NO: 57954 - DNA, 20 bp, Streptococcus pyogenes
tttaacaagcaaggctgcaa

SEQ ID NO: 57955 - DNA, 20 bp, Streptococcus pyogenes
atcaatcaatcgagggataa

SEQ ID NO: 57956 - DNA, 20 bp, Streptococcus pyogenes
ctttcatgttagaatatacc

SEQ ID NO: 57957 - DNA, 20 bp, Streptococcus pyogenes
catgttagaatataccactc

SEQ ID NO: 57958 - DNA, 20 bp, Streptococcus pyogenes
atgttagaatataccactcg

SEQ ID NO: 57959 - DNA, 20 bp, Streptococcus pyogenes
gaatataccactcgaatact

SEQ ID NO: 57960 - DNA, 20 bp, Streptococcus pyogenes
accatcaactatcaatcgtc

SEQ ID NO: 57961 - DNA, 20 bp, Streptococcus pyogenes
ccatcaactatcaatcgtcc

SEQ ID NO: 57962 - DNA, 20 bp, Streptococcus pyogenes
ttgaatcatttcttctgtat

SEQ ID NO: 57963 - DNA, 20 bp, Streptococcus pyogenes
aatcatttcttctgtatggt

SEQ ID NO: 57964 - DNA, 20 bp, Streptococcus pyogenes
cttctgtatggtttcgagta

SEQ ID NO: 57965 - DNA, 20 bp, Streptococcus pyogenes
caatgatttaccgataatct

SEQ ID NO: 57966 - DNA, 20 bp, Streptococcus pyogenes
accgataatcttagcatttc

SEQ ID NO: 57967 - DNA, 20 bp, Streptococcus pyogenes
ccgataatcttagcatttcg

SEQ ID NO: 57968 - DNA, 20 bp, Streptococcus pyogenes
gcatttcgcgcttcttccaa

SEQ ID NO: 57969 - DNA, 20 bp, Streptococcus pyogenes
cgcgcttcttccaaagcttt

SEQ ID NO: 57970 - DNA, 20 bp, Streptococcus pyogenes
gcagcttcaatatagacaac

SEQ ID NO: 57971 - DNA, 20 bp, Streptococcus pyogenes
aatatagacaacgtctttag

SEQ ID NO: 57972 - DNA, 20 bp, Streptococcus pyogenes
agcaaaatcaagatagaagg

SEQ ID NO: 57973 - DNA, 20 bp, Streptococcus pyogenes
gcaaaatcaagatagaaggc

SEQ ID NO: 57974 - DNA, 20 bp, Streptococcus pyogenes
accactgctttgtaaatagc

SEQ ID NO: 57975 - DNA, 20 bp, Streptococcus pyogenes
tcggtatccacagaagctac

SEQ ID NO: 57976 - DNA, 20 bp, Streptococcus pyogenes
tttagccacatcattaggag

SEQ ID NO: 57977 - DNA, 20 bp, Streptococcus pyogenes
agccacatcattaggagaaa

SEQ ID NO: 57978 - DNA, 20 bp, Streptococcus pyogenes
gccacatcattaggagaaat

SEQ ID NO: 57979 - DNA, 20 bp, Streptococcus pyogenes
ggagaaatgatattgccttt

SEQ ID NO: 57980 - DNA, 20 bp, Streptococcus pyogenes
cttttgtaaactcgccattt

SEQ ID NO: 57981 - DNA, 20 bp, Streptococcus pyogenes
ttttgtaaactcgccatttg

SEQ ID NO: 57982 - DNA, 20 bp, Streptococcus pyogenes
tgtaaactcgccatttggtg

SEQ ID NO: 57983 - DNA, 20 bp, Streptococcus pyogenes
gtaaactcgccatttggtga

SEQ ID NO: 57984 - DNA, 20 bp, Streptococcus pyogenes
taaactcgccatttggtgac

SEQ ID NO: 57985 - DNA, 20 bp, Streptococcus pyogenes
ttttttcaatttcatccaaa

SEQ ID NO: 57986 - DNA, 20 bp, Streptococcus pyogenes
tttcaatttcatccaaaata

SEQ ID NO: 57987 - DNA, 20 bp, Streptococcus pyogenes
ttcaatttcatccaaaatat

SEQ ID NO: 57988 - DNA, 20 bp, Streptococcus pyogenes
tcaatttcatccaaaatatc

SEQ ID NO: 57989 - DNA, 20 bp, Streptococcus pyogenes
caatttcatccaaaatatct

SEQ ID NO: 57990 - DNA, 20 bp, Streptococcus pyogenes
ttctacgtcagtatcccatg

SEQ ID NO: 57991 - DNA, 20 bp, Streptococcus pyogenes
tacgtcagtatcccatgggt

SEQ ID NO: 57992 - DNA, 20 bp, Streptococcus pyogenes
gttatccttggtgaccatgt

SEQ ID NO: 57993 - DNA, 20 bp, Streptococcus pyogenes
tccttggtgaccatgttacc

SEQ ID NO: 57994 - DNA, 20 bp, Streptococcus pyogenes
gtgaccatgttacccttgag

SEQ ID NO: 57995 - DNA, 20 bp, Streptococcus pyogenes
accatctttaactttattgg

SEQ ID NO: 57996 - DNA, 20 bp, Streptococcus pyogenes
ccatctttaactttattggc

SEQ ID NO: 57997 - DNA, 20 bp, Streptococcus pyogenes
aactttattggcgtagtata

SEQ ID NO: 57998 - DNA, 20 bp, Streptococcus pyogenes
actttattggcgtagtataa

SEQ ID NO: 57999 - DNA, 20 bp, Streptococcus pyogenes
attggcgtagtataaagagg

SEQ ID NO: 58000 - DNA, 20 bp, Streptococcus pyogenes
acgacacatctcaaggtatt

SEQ ID NO: 58001 - DNA, 20 bp, Streptococcus pyogenes
tgctaaatccatctccttac

SEQ ID NO: 58002 - DNA, 20 bp, Streptococcus pyogenes
cgtttgattccttgcttagc

SEQ ID NO: 58003 - DNA, 20 bp, Streptococcus pyogenes
gattccttgcttagccaaga

SEQ ID NO: 58004 - DNA, 20 bp, Streptococcus pyogenes
attccttgcttagccaagac

SEQ ID NO: 58005 - DNA, 20 bp, Streptococcus pyogenes
ccattgtggctctttattag

SEQ ID NO: 58006 - DNA, 20 bp, Streptococcus pyogenes
tggctctttattaggaagac

SEQ ID NO: 58007 - DNA, 20 bp, Streptococcus pyogenes
attaggaagacctgcgcgca

SEQ ID NO: 58008 - DNA, 20 bp, Streptococcus pyogenes
ttaggaagacctgcgcgcat

SEQ ID NO: 58009 - DNA, 20 bp, Streptococcus pyogenes
ggaagacctgcgcgcattgg

SEQ ID NO: 58010 - DNA, 20 bp, Streptococcus pyogenes
tttttctttatttagatatt

SEQ ID NO: 58011 - DNA, 20 bp, Streptococcus pyogenes
ttctttatttagatatttaa

SEQ ID NO: 58012 - DNA, 20 bp, Streptococcus pyogenes
tctttatttagatatttaat

SEQ ID NO: 58013 - DNA, 20 bp, Streptococcus pyogenes
ctttatttagatatttaatt

SEQ ID NO: 58014 - DNA, 20 bp, Streptococcus pyogenes
tttatttagatatttaattt

SEQ ID NO: 58015 - DNA, 20 bp, Streptococcus pyogenes
aggttttttcgcagataatg

SEQ ID NO: 58016 - DNA, 20 bp, Streptococcus pyogenes
tttcgcagataatggctacg

SEQ ID NO: 58017 - DNA, 20 bp, Streptococcus pyogenes
ttcgcagataatggctacgc

SEQ ID NO: 58018 - DNA, 20 bp, Streptococcus pyogenes
tcgcagataatggctacgct

SEQ ID NO: 58019 - DNA, 20 bp, Streptococcus pyogenes
cgcagataatggctacgctt

SEQ ID NO: 58020 - DNA, 20 bp, Streptococcus pyogenes
gaacccgtgttaccgccgtg

SEQ ID NO: 58021 - DNA, 20 bp, Streptococcus pyogenes
ccgccgtgaaaaggcggtgt

SEQ ID NO: 58022 - DNA, 20 bp, Streptococcus pyogenes
accccttgaccaacggacca

SEQ ID NO: 58023 - DNA, 20 bp, Streptococcus pyogenes
accaacggaccataataata

SEQ ID NO: 58024 - DNA, 20 bp, Streptococcus pyogenes
tagataatgggcacgagtgg

SEQ ID NO: 58025 - DNA, 20 bp, Streptococcus pyogenes
agtgtgtcattaagctaagc

SEQ ID NO: 58026 - DNA, 20 bp, Streptococcus pyogenes
agctaagcgactaccttatc

SEQ ID NO: 58027 - DNA, 20 bp, Streptococcus pyogenes
tctcacagggggcaaccccc

SEQ ID NO: 58028 - DNA, 20 bp, Streptococcus pyogenes
tagggcttaactgctgtgtt

SEQ ID NO: 58029 - DNA, 20 bp, Streptococcus pyogenes
actgctgtgttcggcatggg

SEQ ID NO: 58030 - DNA, 20 bp, Streptococcus pyogenes
cctacatagctacccagcga

SEQ ID NO: 58031 - DNA, 20 bp, Streptococcus pyogenes
ggcaagacaactggtacacc

SEQ ID NO: 58032 - DNA, 20 bp, Streptococcus pyogenes
gcaagacaactggtacacca

SEQ ID NO: 58033 - DNA, 20 bp, Streptococcus pyogenes
cctacgcccgcgacggatag

SEQ ID NO: 58034 - DNA, 20 bp, Streptococcus pyogenes
ctacgcccgcgacggatagg

SEQ ID NO: 58035 - DNA, 20 bp, Streptococcus pyogenes
tatccgttgagcgatggccc

SEQ ID NO: 58036 - DNA, 20 bp, Streptococcus pyogenes
atccgttgagcgatggccct

SEQ ID NO: 58037 - DNA, 20 bp, Streptococcus pyogenes
tccgttgagcgatggccctt

SEQ ID NO: 58038 - DNA, 20 bp, Streptococcus pyogenes
agcgatggcccttccattcg

SEQ ID NO: 58039 - DNA, 20 bp, Streptococcus pyogenes
cattcggtaccaccggatca

SEQ ID NO: 58040 - DNA, 20 bp, Streptococcus pyogenes
cgatttagcagagagctgtg

SEQ ID NO: 58041 - DNA, 20 bp, Streptococcus pyogenes
agcagagagctgtgtttttg

SEQ ID NO: 58042 - DNA, 20 bp, Streptococcus pyogenes
gcagagagctgtgtttttga

SEQ ID NO: 58043 - DNA, 20 bp, Streptococcus pyogenes
ttgataaacagttgcttggg

SEQ ID NO: 58044 - DNA, 20 bp, Streptococcus pyogenes
tgataaacagttgcttgggc

SEQ ID NO: 58045 - DNA, 20 bp, Streptococcus pyogenes
gactcatcttacacctcact

SEQ ID NO: 58046 - DNA, 20 bp, Streptococcus pyogenes
actcatcttacacctcactg

SEQ ID NO: 58047 - DNA, 20 bp, Streptococcus pyogenes
cacctcactgcttagccgga

SEQ ID NO: 58048 - DNA, 20 bp, Streptococcus pyogenes
gccggactcttccaatcgtc

SEQ ID NO: 58049 - DNA, 20 bp, Streptococcus pyogenes
caatcgtccggtttagttag

SEQ ID NO: 58050 - DNA, 20 bp, Streptococcus pyogenes
tgtgtcatccacagcttcgg

SEQ ID NO: 58051 - DNA, 20 bp, Streptococcus pyogenes
gtgtcatccacagcttcggt

SEQ ID NO: 58052 - DNA, 20 bp, Streptococcus pyogenes
tgtcatccacagcttcggta

SEQ ID NO: 58053 - DNA, 20 bp, Streptococcus pyogenes
ggtaaactgttttagccccg

SEQ ID NO: 58054 - DNA, 20 bp, Streptococcus pyogenes
tagccccggtacattttcgg

SEQ ID NO: 58055 - DNA, 20 bp, Streptococcus pyogenes
attctacaaaaggcacgctc

SEQ ID NO: 58056 - DNA, 20 bp, Streptococcus pyogenes
tacaaaaggcacgctctcac

SEQ ID NO: 58057 - DNA, 20 bp, Streptococcus pyogenes
acgggctcgaacttgttgta

SEQ ID NO: 58058 - DNA, 20 bp, Streptococcus pyogenes
ttgtaggcacacggtttcag

SEQ ID NO: 58059 - DNA, 20 bp, Streptococcus pyogenes
taggcacacggtttcaggtt

SEQ ID NO: 58060 - DNA, 20 bp, Streptococcus pyogenes
catttccttagaaaggaggt

SEQ ID NO: 58061 - DNA, 20 bp, Streptococcus pyogenes
ccttagaaaggaggtgatcc

SEQ ID NO: 58062 - DNA, 20 bp, Streptococcus pyogenes
cttagaaaggaggtgatcca

SEQ ID NO: 58063 - DNA, 20 bp, Streptococcus pyogenes
gaaaggaggtgatccagccg

SEQ ID NO: 58064 - DNA, 20 bp, Streptococcus pyogenes
cgatacggctaccttgttac

SEQ ID NO: 58065 - DNA, 20 bp, Streptococcus pyogenes
gtcaacttcgtttttaaggt

SEQ ID NO: 58066 - DNA, 20 bp, Streptococcus pyogenes
gtttttaaggtcaacttctt

SEQ ID NO: 58067 - DNA, 20 bp, Streptococcus pyogenes
ttaaggtcaacttcttcttt

SEQ ID NO: 58068 - DNA, 20 bp, Streptococcus pyogenes
taaggtcaacttcttcttta

SEQ ID NO: 58069 - DNA, 20 bp, Streptococcus pyogenes
aaggtcaacttcttctttac

SEQ ID NO: 58070 - DNA, 20 bp, Streptococcus pyogenes
ggcgttcaccttgaagaaca

SEQ ID NO: 58071 - DNA, 20 bp, Streptococcus pyogenes
accttgaagaacatggatat

SEQ ID NO: 58072 - DNA, 20 bp, Streptococcus pyogenes
aagaacatggatatcaacag

SEQ ID NO: 58073 - DNA, 20 bp, Streptococcus pyogenes
gttgtctgctgctgttgaga

SEQ ID NO: 58074 - DNA, 20 bp, Streptococcus pyogenes
tctgctgctgttgagaagac

SEQ ID NO: 58075 - DNA, 20 bp, Streptococcus pyogenes
atcaatttctgacaatgaca

SEQ ID NO: 58076 - DNA, 20 bp, Streptococcus pyogenes
ctgacaatgacaatcctgca

SEQ ID NO: 58077 - DNA, 20 bp, Streptococcus pyogenes
tgacaatgacaatcctgcat

SEQ ID NO: 58078 - DNA, 20 bp, Streptococcus pyogenes
acgaactggagttttcgtac

SEQ ID NO: 58079 - DNA, 20 bp, Streptococcus pyogenes
tcgtacgttctacaaggtcg

SEQ ID NO: 58080 - DNA, 20 bp, Streptococcus pyogenes
caagaacgtcgaagacacca

SEQ ID NO: 58081 - DNA, 20 bp, Streptococcus pyogenes
aaggattgatacgtcaaatg

SEQ ID NO: 58082 - DNA, 20 bp, Streptococcus pyogenes
atacgtcaaatgtaccacca

SEQ ID NO: 58083 - DNA, 20 bp, Streptococcus pyogenes
gtttttgaccttggtggtgg

SEQ ID NO: 58084 - DNA, 20 bp, Streptococcus pyogenes
ttgaccttggtggtggtaca

SEQ ID NO: 58085 - DNA, 20 bp, Streptococcus pyogenes
cagcatcacccacgataatt

SEQ ID NO: 58086 - DNA, 20 bp, Streptococcus pyogenes
caccatttttgaatgatact

SEQ ID NO: 58087 - DNA, 20 bp, Streptococcus pyogenes
accatttttgaatgatacta

SEQ ID NO: 58088 - DNA, 20 bp, Streptococcus pyogenes
ttgaatgatactactgaagg

SEQ ID NO: 58089 - DNA, 20 bp, Streptococcus pyogenes
tgaatgatactactgaagga

SEQ ID NO: 58090 - DNA, 20 bp, Streptococcus pyogenes
ctgtcattacggacaaaaac

SEQ ID NO: 58091 - DNA, 20 bp, Streptococcus pyogenes
cggacaaaaacgaaaactca

SEQ ID NO: 58092 - DNA, 20 bp, Streptococcus pyogenes
accttagttataaacaacta

SEQ ID NO: 58093 - DNA, 20 bp, Streptococcus pyogenes
ccttagttataaacaactac

SEQ ID NO: 58094 - DNA, 20 bp, Streptococcus pyogenes
gttataaacaactaccatcg

SEQ ID NO: 58095 - DNA, 20 bp, Streptococcus pyogenes
tcaagcgatggtaagattgc

SEQ ID NO: 58096 - DNA, 20 bp, Streptococcus pyogenes
cttttgccagatcctgagaa

SEQ ID NO: 58097 - DNA, 20 bp, Streptococcus pyogenes
tgccagatcctgagaacgat

SEQ ID NO: 58098 - DNA, 20 bp, Streptococcus pyogenes
gccagatcctgagaacgata

SEQ ID NO: 58099 - DNA, 20 bp, Streptococcus pyogenes
ccagatcctgagaacgatag

SEQ ID NO: 58100 - DNA, 20 bp, Streptococcus pyogenes
ccaataatgtttaccaaact

SEQ ID NO: 58101 - DNA, 20 bp, Streptococcus pyogenes
caataatgtttaccaaacta

SEQ ID NO: 58102 - DNA, 20 bp, Streptococcus pyogenes
accaaactaacagacctacg

SEQ ID NO: 58103 - DNA, 20 bp, Streptococcus pyogenes
ccaaactaacagacctacga

SEQ ID NO: 58104 - DNA, 20 bp, Streptococcus pyogenes
ttgattccttaccgtgggtt

SEQ ID NO: 58105 - DNA, 20 bp, Streptococcus pyogenes
aaatgctatcaagtcacgtg

SEQ ID NO: 58106 - DNA, 20 bp, Streptococcus pyogenes
aatgctatcaagtcacgtgt

SEQ ID NO: 58107 - DNA, 20 bp, Streptococcus pyogenes
cttggaatagcaaactgcac

SEQ ID NO: 58108 - DNA, 20 bp, Streptococcus pyogenes
ttggaatagcaaactgcact

SEQ ID NO: 58109 - DNA, 20 bp, Streptococcus pyogenes
gaatagcaaactgcactgtc

SEQ ID NO: 58110 - DNA, 20 bp, Streptococcus pyogenes
ttccaacaatcccaacttct

SEQ ID NO: 58111 - DNA, 20 bp, Streptococcus pyogenes
tccaacaatcccaacttctc

SEQ ID NO: 58112 - DNA, 20 bp, Streptococcus pyogenes
ccaacaatcccaacttctct

SEQ ID NO: 58113 - DNA, 20 bp, Streptococcus pyogenes
caacaatcccaacttctcta

SEQ ID NO: 58114 - DNA, 20 bp, Streptococcus pyogenes
tctagttttgccatatcatt

SEQ ID NO: 58115 - DNA, 20 bp, Streptococcus pyogenes
atgagattgccaatcaagtt

SEQ ID NO: 58116 - DNA, 20 bp, Streptococcus pyogenes
tgagattgccaatcaagttg

SEQ ID NO: 58117 - DNA, 20 bp, Streptococcus pyogenes
ccaatcaagttgctttctct

SEQ ID NO: 58118 - DNA, 20 bp, Streptococcus pyogenes
ctttctctggttctcgtgat

SEQ ID NO: 58119 - DNA, 20 bp, Streptococcus pyogenes
ctctggttctcgtgatagac

SEQ ID NO: 58120 - DNA, 20 bp, Streptococcus pyogenes
gccaaagaagtcctatctat

SEQ ID NO: 58121 - DNA, 20 bp, Streptococcus pyogenes
ccaaagaagtcctatctatc

SEQ ID NO: 58122 - DNA, 20 bp, Streptococcus pyogenes
ctctgtcattgatgatgata

SEQ ID NO: 58123 - DNA, 20 bp, Streptococcus pyogenes
atgatgataaaaaagcacta

SEQ ID NO: 58124 - DNA, 20 bp, Streptococcus pyogenes
tccttcgtccttatcagatt

SEQ ID NO: 58125 - DNA, 20 bp, Streptococcus pyogenes
gatgtcgatgagacagaaga

SEQ ID NO: 58126 - DNA, 20 bp, Streptococcus pyogenes
atgtcgatgagacagaagat

SEQ ID NO: 58127 - DNA, 20 bp, Streptococcus pyogenes
agaatccagcgatcgtcgtg

SEQ ID NO: 58128 - DNA, 20 bp, Streptococcus pyogenes
gaatccagcgatcgtcgtgt

SEQ ID NO: 58129 - DNA, 20 bp, Streptococcus pyogenes
tggtcaccaccattcaaaaa

SEQ ID NO: 58130 - DNA, 20 bp, Streptococcus pyogenes
ggtgatttagcccaaacaac

SEQ ID NO: 58131 - DNA, 20 bp, Streptococcus pyogenes
agcccaaacaacggaacagc

SEQ ID NO: 58132 - DNA, 20 bp, Streptococcus pyogenes
gcccaaacaacggaacagca

SEQ ID NO: 58133 - DNA, 20 bp, Streptococcus pyogenes
aagaagccattcatgataaa

SEQ ID NO: 58134 - DNA, 20 bp, Streptococcus pyogenes
atcatgaatggcttctttaa

SEQ ID NO: 58135 - DNA, 20 bp, Streptococcus pyogenes
aggctggtgaaacggattta

SEQ ID NO: 58136 - DNA, 20 bp, Streptococcus pyogenes
agtcatttctaagaaggtca

SEQ ID NO: 58137 - DNA, 20 bp, Streptococcus pyogenes
gtcatttctaagaaggtcaa

SEQ ID NO: 58138 - DNA, 20 bp, Streptococcus pyogenes
ctaagaaggtcaaagaaaaa

SEQ ID NO: 58139 - DNA, 20 bp, Streptococcus pyogenes
taagaaggtcaaagaaaaac

SEQ ID NO: 58140 - DNA, 20 bp, Streptococcus pyogenes
acaggttttgatgcgccttg

SEQ ID NO: 58141 - DNA, 20 bp, Streptococcus pyogenes
tgatgcgccttgtttatcaa

SEQ ID NO: 58142 - DNA, 20 bp, Streptococcus pyogenes
gatgcgccttgtttatcaac

SEQ ID NO: 58143 - DNA, 20 bp, Streptococcus pyogenes
atgcgccttgtttatcaacg

SEQ ID NO: 58144 - DNA, 20 bp, Streptococcus pyogenes
tttatcaacgatctttattg

SEQ ID NO: 58145 - DNA, 20 bp, Streptococcus pyogenes
tctcaaacaatacgccaaag

SEQ ID NO: 58146 - DNA, 20 bp, Streptococcus pyogenes
ctcaaacaatacgccaaagc

SEQ ID NO: 58147 - DNA, 20 bp, Streptococcus pyogenes
tcaaacaatacgccaaagcc

SEQ ID NO: 58148 - DNA, 20 bp, Streptococcus pyogenes
caagcgtttgataaactctt

SEQ ID NO: 58149 - DNA, 20 bp, Streptococcus pyogenes
aagcgtttgataaactcttt

SEQ ID NO: 58150 - DNA, 20 bp, Streptococcus pyogenes
aagaaaggctcaatgacaat

SEQ ID NO: 58151 - DNA, 20 bp, Streptococcus pyogenes
ggcaaaatcaaaccctgcta

SEQ ID NO: 58152 - DNA, 20 bp, Streptococcus pyogenes
gcaaaatcaaaccctgctat

SEQ ID NO: 58153 - DNA, 20 bp, Streptococcus pyogenes
tggcaagatatccaaaaaga

SEQ ID NO: 58154 - DNA, 20 bp, Streptococcus pyogenes
ttggatatcttgccataact

SEQ ID NO: 58155 - DNA, 20 bp, Streptococcus pyogenes
tgccatgaataaactcaaat

SEQ ID NO: 58156 - DNA, 20 bp, Streptococcus pyogenes
gaacgggagttagttcaatt

SEQ ID NO: 58157 - DNA, 20 bp, Streptococcus pyogenes
aacgggagttagttcaattc

SEQ ID NO: 58158 - DNA, 20 bp, Streptococcus pyogenes
gttcaattcattagagatca

SEQ ID NO: 58159 - DNA, 20 bp, Streptococcus pyogenes
aattcattagagatcaaatc

SEQ ID NO: 58160 - DNA, 20 bp, Streptococcus pyogenes
aaattccctccctccctgaa

SEQ ID NO: 58161 - DNA, 20 bp, Streptococcus pyogenes
cctccctccctgaacaagaa

SEQ ID NO: 58162 - DNA, 20 bp, Streptococcus pyogenes
gcgaacttttccaaatggtt

SEQ ID NO: 58163 - DNA, 20 bp, Streptococcus pyogenes
tccaaatggttgatcaattg

SEQ ID NO: 58164 - DNA, 20 bp, Streptococcus pyogenes
ccaaatggttgatcaattga

SEQ ID NO: 58165 - DNA, 20 bp, Streptococcus pyogenes
ctcagcagcatctgccatgt

SEQ ID NO: 58166 - DNA, 20 bp, Streptococcus pyogenes
tgagcgcatcatgtccttgc

SEQ ID NO: 58167 - DNA, 20 bp, Streptococcus pyogenes
cccataaagccaagatcttt

SEQ ID NO: 58168 - DNA, 20 bp, Streptococcus pyogenes
gttgaaaccgtctgttccaa

SEQ ID NO: 58169 - DNA, 20 bp, Streptococcus pyogenes
ttgaaaccgtctgttccaac

SEQ ID NO: 58170 - DNA, 20 bp, Streptococcus pyogenes
agccagattcaatcataatg

SEQ ID NO: 58171 - DNA, 20 bp, Streptococcus pyogenes
aatcataatggtatcgttgt

SEQ ID NO: 58172 - DNA, 20 bp, Streptococcus pyogenes
tcttgtaccaattcagctgc

SEQ ID NO: 58173 - DNA, 20 bp, Streptococcus pyogenes
taccaattcagctgcttttt

SEQ ID NO: 58174 - DNA, 20 bp, Streptococcus pyogenes
agctgctttttctgcaatcc

SEQ ID NO: 58175 - DNA, 20 bp, Streptococcus pyogenes
ttttcaacatccaacatttt

SEQ ID NO: 58176 - DNA, 20 bp, Streptococcus pyogenes
tcaacatccaacattttagt

SEQ ID NO: 58177 - DNA, 20 bp, Streptococcus pyogenes
caacatccaacattttagta

SEQ ID NO: 58178 - DNA, 20 bp, Streptococcus pyogenes
aacatccaacattttagtat

SEQ ID NO: 58179 - DNA, 20 bp, Streptococcus pyogenes
tagtattcatgacggtcctg

SEQ ID NO: 58180 - DNA, 20 bp, Streptococcus pyogenes
gccctgttaaaagcagccaa

SEQ ID NO: 58181 - DNA, 20 bp, Streptococcus pyogenes
aaagcagccaaagcagcagg

SEQ ID NO: 58182 - DNA, 20 bp, Streptococcus pyogenes
acaccgcaattgaaaccacc

SEQ ID NO: 58183 - DNA, 20 bp, Streptococcus pyogenes
aaaccaccgcctttgccaaa

SEQ ID NO: 58184 - DNA, 20 bp, Streptococcus pyogenes
gccaaacacgagcaatttgt

SEQ ID NO: 58185 - DNA, 20 bp, Streptococcus pyogenes
cctttccatcaatttggaga

SEQ ID NO: 58186 - DNA, 20 bp, Streptococcus pyogenes
ccatcaatttggagaaaaca

SEQ ID NO: 58187 - DNA, 20 bp, Streptococcus pyogenes
catcaatttggagaaaacaa

SEQ ID NO: 58188 - DNA, 20 bp, Streptococcus pyogenes
ggagaaaacaagtacaaact

SEQ ID NO: 58189 - DNA, 20 bp, Streptococcus pyogenes
gagaaaacaagtacaaactt

SEQ ID NO: 58190 - DNA, 20 bp, Streptococcus pyogenes
ccaacgttgtttacgatttg

SEQ ID NO: 58191 - DNA, 20 bp, Streptococcus pyogenes
caacgttgtttacgatttgg

SEQ ID NO: 58192 - DNA, 20 bp, Streptococcus pyogenes
tttacgatttggccatgttg

SEQ ID NO: 58193 - DNA, 20 bp, Streptococcus pyogenes
acgatttggccatgttgtgt

SEQ ID NO: 58194 - DNA, 20 bp, Streptococcus pyogenes
cgatttggccatgttgtgtc

SEQ ID NO: 58195 - DNA, 20 bp, Streptococcus pyogenes
tgatagtgattgcgaagctt

SEQ ID NO: 58196 - DNA, 20 bp, Streptococcus pyogenes
gatagtgattgcgaagcttc

SEQ ID NO: 58197 - DNA, 20 bp, Streptococcus pyogenes
atagtgattgcgaagcttct

SEQ ID NO: 58198 - DNA, 20 bp, Streptococcus pyogenes
cgaagcttcttgtgctgatt

SEQ ID NO: 58199 - DNA, 20 bp, Streptococcus pyogenes
ttgtgctgattttcttaaac

SEQ ID NO: 58200 - DNA, 20 bp, Streptococcus pyogenes
actaataacaacatctggcg

SEQ ID NO: 58201 - DNA, 20 bp, Streptococcus pyogenes
aagttggtttctgtcgtccc

SEQ ID NO: 58202 - DNA, 20 bp, Streptococcus pyogenes
gtttctgtcgtccctgtttt

SEQ ID NO: 58203 - DNA, 20 bp, Streptococcus pyogenes
ctgtcgtccctgttttacca

SEQ ID NO: 58204 - DNA, 20 bp, Streptococcus pyogenes
tgtcgtccctgttttaccag

SEQ ID NO: 58205 - DNA, 20 bp, Streptococcus pyogenes
gttgtcacgctgccacctaa

SEQ ID NO: 58206 - DNA, 20 bp, Streptococcus pyogenes
tcacgctgccacctaaagct

SEQ ID NO: 58207 - DNA, 20 bp, Streptococcus pyogenes
tttggcagagctcatatcta

SEQ ID NO: 58208 - DNA, 20 bp, Streptococcus pyogenes
ttggcagagctcatatctaa

SEQ ID NO: 58209 - DNA, 20 bp, Streptococcus pyogenes
gatatgagctctgccaaaaa

SEQ ID NO: 58210 - DNA, 20 bp, Streptococcus pyogenes
ttgatgcgggactacgtttt

SEQ ID NO: 58211 - DNA, 20 bp, Streptococcus pyogenes
atgcgggactacgttttgct

SEQ ID NO: 58212 - DNA, 20 bp, Streptococcus pyogenes
tgcttgagtcgcatagttaa

SEQ ID NO: 58213 - DNA, 20 bp, Streptococcus pyogenes
gcttgagtcgcatagttaaa

SEQ ID NO: 58214 - DNA, 20 bp, Streptococcus pyogenes
cttgagtcgcatagttaaaa

SEQ ID NO: 58215 - DNA, 20 bp, Hepatitis E virus
atactgctagagaggcccag

SEQ ID NO: 58216 - DNA, 20 bp, Hepatitis E virus
gctaatgctcaggtggtacg

SEQ ID NO: 58217 - DNA, 20 bp, Hepatitis E virus
ctaatgctcaggtggtacgc

SEQ ID NO: 58218 - DNA, 20 bp, Hepatitis E virus
agagtgcgacaggtaggggc

SEQ ID NO: 58219 - DNA, 20 bp, Hepatitis E virus
gcaaaggcggtagccgccgc

SEQ ID NO: 58220 - DNA, 20 bp, Hepatitis E virus
cccgcggcgcgggccggcca

SEQ ID NO: 58221 - DNA, 20 bp, Hepatitis E virus
cattcttgcagggcgccctg

SEQ ID NO: 58222 - DNA, 20 bp, Hepatitis E virus
ttgcagggcgccctgctact

SEQ ID NO: 58223 - DNA, 20 bp, Hepatitis E virus
cagggcgccctgctactgat

SEQ ID NO: 58224 - DNA, 20 bp, Hepatitis E virus
ccttttgcacgcgtgggttc

SEQ ID NO: 58225 - DNA, 20 bp, Hepatitis E virus
gctgtgatgcatctgcccgc

SEQ ID NO: 58226 - DNA, 20 bp, Hepatitis E virus
ctgtgatgcatctgcccgct

SEQ ID NO: 58227 - DNA, 20 bp, Hepatitis E virus
ttgccggacggggtttatac

SEQ ID NO: 58228 - DNA, 20 bp, Hepatitis E virus
ccggacggggtttataccac

SEQ ID NO: 58229 - DNA, 20 bp, Hepatitis E virus
ataccacccgcgcttataca

SEQ ID NO: 58230 - DNA, 20 bp, Hepatitis E virus
tgtgctgcggttgaccaccg

SEQ ID NO: 58231 - DNA, 20 bp, Hepatitis E virus
gtgctgcggttgaccaccgt

SEQ ID NO: 58232 - DNA, 20 bp, Hepatitis E virus
tgctgcggttgaccaccgtg

SEQ ID NO: 58233 - DNA, 20 bp, Hepatitis E virus
accaccgtggcaaatccttg

SEQ ID NO: 58234 - DNA, 20 bp, Hepatitis E virus
ccccatgccctacacccctt

SEQ ID NO: 58235 - DNA, 20 bp, Hepatitis E virus
ccaatgagggttggaccacc

SEQ ID NO: 58236 - DNA, 20 bp, Hepatitis E virus
gaccaccgatgagtacgccc

SEQ ID NO: 58237 - DNA, 20 bp, Hepatitis E virus
tggcctcctatttgacaata

SEQ ID NO: 58238 - DNA, 20 bp, Hepatitis E virus
gacaatatgccaccaacgct

SEQ ID NO: 58239 - DNA, 20 bp, Hepatitis E virus
acaatatgccaccaacgctg

SEQ ID NO: 58240 - DNA, 20 bp, Hepatitis E virus
tatagacagtgtcgggattg

SEQ ID NO: 58241 - DNA, 20 bp, Hepatitis E virus
ggtgtcagcaggtttttatg

SEQ ID NO: 58242 - DNA, 20 bp, Hepatitis E virus
ttatgtggatcttagagagc

SEQ ID NO: 58243 - DNA, 20 bp, Hepatitis E virus
tatgtggatcttagagagct

SEQ ID NO: 58244 - DNA, 20 bp, Hepatitis E virus
atgtggatcttagagagctt

SEQ ID NO: 58245 - DNA, 20 bp, Hepatitis E virus
acgagcccaccggcttggat

SEQ ID NO: 58246 - DNA, 20 bp, Hepatitis E virus
cgagcccaccggcttggata

SEQ ID NO: 58247 - DNA, 20 bp, Hepatitis E virus
gataattggaccatccgcgc

SEQ ID NO: 58248 - DNA, 20 bp, Hepatitis E virus
gaccatccgcgctctcacgg

SEQ ID NO: 58249 - DNA, 20 bp, Hepatitis E virus
catcaggcctctctgcgcgc

SEQ ID NO: 58250 - DNA, 20 bp, Hepatitis E virus
gacaccggggccgatttccc

SEQ ID NO: 58251 - DNA, 20 bp, Hepatitis E virus
ccccgaggtacgttctccct

SEQ ID NO: 58252 - DNA, 20 bp, Hepatitis E virus
cccgaggtacgttctcccta

SEQ ID NO: 58253 - DNA, 20 bp, Hepatitis E virus
tccctacacctgttacgtac

SEQ ID NO: 58254 - DNA, 20 bp, Hepatitis E virus
cgtaccgcgggcaccccccc

SEQ ID NO: 58255 - DNA, 20 bp, Hepatitis E virus
ctggaattgctcccggatgg

SEQ ID NO: 58256 - DNA, 20 bp, Hepatitis E virus
ctcccggatggggcggcagt

SEQ ID NO: 58257 - DNA, 20 bp, Hepatitis E virus
atgagggggatctttttaat

SEQ ID NO: 58258 - DNA, 20 bp, Hepatitis E virus
tgagggggatctttttaatt

SEQ ID NO: 58259 - DNA, 20 bp, Hepatitis E virus
ttaattcggattgcttctgg

SEQ ID NO: 58260 - DNA, 20 bp, Hepatitis E virus
caggtggcctatcaggagtg

SEQ ID NO: 58261 - DNA, 20 bp, Hepatitis E virus
ttgcctactcggcagtggaa

SEQ ID NO: 58262 - DNA, 20 bp, Hepatitis E virus
cctactcggcagtggaatat

SEQ ID NO: 58263 - DNA, 20 bp, Hepatitis E virus
cactgccgagtaggcaataa

SEQ ID NO: 58264 - DNA, 20 bp, Hepatitis E virus
ttccaacaaaccaacttaag

SEQ ID NO: 58265 - DNA, 20 bp, Hepatitis E virus
caacaaaccaacttaaggcg

SEQ ID NO: 58266 - DNA, 20 bp, Hepatitis E virus
aggcgcaatggagggctcga

SEQ ID NO: 58267 - DNA, 20 bp, Hepatitis E virus
ccctgttatgaccccgcatg

SEQ ID NO: 58268 - DNA, 20 bp, Hepatitis E virus
cctgttatgaccccgcatgt

SEQ ID NO: 58269 - DNA, 20 bp, Hepatitis E virus
atctggagccaacagaatgg

SEQ ID NO: 58270 - DNA, 20 bp, Hepatitis E virus
gttggcggccgattaccccg

SEQ ID NO: 58271 - DNA, 20 bp, Hepatitis E virus
ttggcggccgattaccccgg

SEQ ID NO: 58272 - DNA, 20 bp, Hepatitis E virus
tgttggctccagattaagct

SEQ ID NO: 58273 - DNA, 20 bp, Hepatitis E virus
gctccagattaagctgcata

SEQ ID NO: 58274 - DNA, 20 bp, Hepatitis E virus
acatcagatggccgaagcat

SEQ ID NO: 58275 - DNA, 20 bp, Hepatitis E virus
catcagatggccgaagcatt

SEQ ID NO: 58276 - DNA, 20 bp, Hepatitis E virus
ggccacaggccactcgaggt

SEQ ID NO: 58277 - DNA, 20 bp, Hepatitis E virus
ggccatctgatgtaaagcca

SEQ ID NO: 58278 - DNA, 20 bp, Hepatitis E virus
tggcatgatgacgtggaagt

SEQ ID NO: 58279 - DNA, 20 bp, Hepatitis E virus
attccttcgttgcaaggtgt

SEQ ID NO: 58280 - DNA, 20 bp, Hepatitis E virus
cttcgttgcaaggtgtcaga

SEQ ID NO: 58281 - DNA, 20 bp, Hepatitis E virus
gttgcaaggtgtcagagttt

SEQ ID NO: 58282 - DNA, 20 bp, Hepatitis E virus
caaggtgtcagagtttcatc

SEQ ID NO: 58283 - DNA, 20 bp, Hepatitis E virus
taccacctgctccgttcggg

SEQ ID NO: 58284 - DNA, 20 bp, Hepatitis E virus
ggggtgggtgttgcaggctc

SEQ ID NO: 58285 - DNA, 20 bp, Hepatitis E virus
caggctccccaagagagctt

SEQ ID NO: 58286 - DNA, 20 bp, Hepatitis E virus
cggggtcgatggaagaagca

SEQ ID NO: 58287 - DNA, 20 bp, Hepatitis E virus
ttccatcgaccccgcaagct

SEQ ID NO: 58288 - DNA, 20 bp, Hepatitis E virus
aaggttaactttagtgatgt

SEQ ID NO: 58289 - DNA, 20 bp, Hepatitis E virus
actttagtgatgttggctcg

SEQ ID NO: 58290 - DNA, 20 bp, Hepatitis E virus
agtgatgttggctcgtacgc

SEQ ID NO: 58291 - DNA, 20 bp, Hepatitis E virus
gtgatgttggctcgtacgca

SEQ ID NO: 58292 - DNA, 20 bp, Hepatitis E virus
gctcgtacgcaggcttgcta

SEQ ID NO: 58293 - DNA, 20 bp, Hepatitis E virus
tacaagctggagcctggtct

SEQ ID NO: 58294 - DNA, 20 bp, Hepatitis E virus
gaaagcgatcgctgagggcc

SEQ ID NO: 58295 - DNA, 20 bp, Hepatitis E virus
aaagcgatcgctgagggccg

SEQ ID NO: 58296 - DNA, 20 bp, Hepatitis E virus
caaacctgcgaccgcattga

SEQ ID NO: 58297 - DNA, 20 bp, Hepatitis E virus
aaacctgcgaccgcattgag

SEQ ID NO: 58298 - DNA, 20 bp, Hepatitis E virus
gctatccccaaccaatccct

SEQ ID NO: 58299 - DNA, 20 bp, Hepatitis E virus
gctgccgaactctccaccat

SEQ ID NO: 58300 - DNA, 20 bp, Hepatitis E virus
ctgccgaactctccaccatg

SEQ ID NO: 58301 - DNA, 20 bp, Hepatitis E virus
gcaccgcctgggtcgatcgg

SEQ ID NO: 58302 - DNA, 20 bp, Hepatitis E virus
cggggcctgccgcggcgccg

SEQ ID NO: 58303 - DNA, 20 bp, Hepatitis E virus
tggccccaatccacaacagt

SEQ ID NO: 58304 - DNA, 20 bp, Hepatitis E virus
catcacttccaccgacgtgc

SEQ ID NO: 58305 - DNA, 20 bp, Hepatitis E virus
caccgacgtgcgcattgtgg

SEQ ID NO: 58306 - DNA, 20 bp, Hepatitis E virus
tggcgcagcctggcctggcc

SEQ ID NO: 58307 - DNA, 20 bp, Hepatitis E virus
atatccaccgacgtggggac

SEQ ID NO: 58308 - DNA, 20 bp, Hepatitis E virus
ggtttacttgacatcgccct

SEQ ID NO: 58309 - DNA, 20 bp, Hepatitis E virus
acttgacatcgccctccagg

SEQ ID NO: 58310 - DNA, 20 bp, Hepatitis E virus
cttgacatcgccctccaggt

SEQ ID NO: 58311 - DNA, 20 bp, Hepatitis E virus
acatcgccctccaggttgaa

SEQ ID NO: 58312 - DNA, 20 bp, Hepatitis E virus
aatatcgcaatttgacccct

SEQ ID NO: 58313 - DNA, 20 bp, Hepatitis E virus
tgtgggtgaccttgccctct

SEQ ID NO: 58314 - DNA, 20 bp, Hepatitis E virus
ccctctgcagagtatgccca

SEQ ID NO: 58315 - DNA, 20 bp, Hepatitis E virus
ccacccggcatactggtctg

SEQ ID NO: 58316 - DNA, 20 bp, Hepatitis E virus
gcagcagggcacaaccaagg

SEQ ID NO: 58317 - DNA, 20 bp, Hepatitis E virus
caacaccactgactctgata

SEQ ID NO: 58318 - DNA, 20 bp, Hepatitis E virus
agaggtcccatcccaccaga

SEQ ID NO: 58319 - DNA, 20 bp, Hepatitis E virus
gaggtcccatcccaccagac

SEQ ID NO: 58320 - DNA, 20 bp, Hepatitis E virus
taattatatgtgtagccggc

SEQ ID NO: 58321 - DNA, 20 bp, Human coronavirus
gttatggcagtcctagtgta

SEQ ID NO: 58322 - DNA, 20 bp, Human coronavirus
ttatggcagtcctagtgtaa

SEQ ID NO: 58323 - DNA, 20 bp, Human coronavirus
tggcagtcctagtgtaattg

SEQ ID NO: 58324 - DNA, 20 bp, Human coronavirus
aaatttcgtcaagtttgtaa

SEQ ID NO: 58325 - DNA, 20 bp, Human coronavirus
cgtcaagtttgtaaactggt

SEQ ID NO: 58326 - DNA, 20 bp, Human coronavirus
tcaggcatgccgttttgttg

SEQ ID NO: 58327 - DNA, 20 bp, Human coronavirus
caggcatgccgttttgttgc

SEQ ID NO: 58328 - DNA, 20 bp, Human coronavirus
aggcatgccgttttgttgct

SEQ ID NO: 58329 - DNA, 20 bp, Human coronavirus
tgttgcttttggcttacagg

SEQ ID NO: 58330 - DNA, 20 bp, Human coronavirus
gttgcttttggcttacagga

SEQ ID NO: 58331 - DNA, 20 bp, Human coronavirus
ttaaaccagttttctttaat

SEQ ID NO: 58332 - DNA, 20 bp, Human coronavirus
aaccagttttctttaatgct

SEQ ID NO: 58333 - DNA, 20 bp, Human coronavirus
tctttaatgcttttgttaaa

SEQ ID NO: 58334 - DNA, 20 bp, Human coronavirus
ctttaatgcttttgttaaat

SEQ ID NO: 58335 - DNA, 20 bp, Human coronavirus
tttaatgcttttgttaaatg

SEQ ID NO: 58336 - DNA, 20 bp, Human coronavirus
tcttggtgcttctgttacag

SEQ ID NO: 58337 - DNA, 20 bp, Human coronavirus
cttggtgcttctgttacaga

SEQ ID NO: 58338 - DNA, 20 bp, Human coronavirus
ttggtgcttctgttacagaa

SEQ ID NO: 58339 - DNA, 20 bp, Human coronavirus
gtgcttctgttacagaagat

SEQ ID NO: 58340 - DNA, 20 bp, Human coronavirus
tgttacagaagatgttaaat

SEQ ID NO: 58341 - DNA, 20 bp, Human coronavirus
gcgtcttgttgattgtgcac

SEQ ID NO: 58342 - DNA, 20 bp, Human coronavirus
cgtcttgttgattgtgcacc

SEQ ID NO: 58343 - DNA, 20 bp, Human coronavirus
ttgattgtgcacctgtagtt

SEQ ID NO: 58344 - DNA, 20 bp, Human coronavirus
attgtgcacctgtagtttgc

SEQ ID NO: 58345 - DNA, 20 bp, Human coronavirus
tgcacctgtagtttgcccta

SEQ ID NO: 58346 - DNA, 20 bp, Human coronavirus
ttagacgtgatgctacattc

SEQ ID NO: 58347 - DNA, 20 bp, Human coronavirus
gacgtgatgctacattcgct

SEQ ID NO: 58348 - DNA, 20 bp, Human coronavirus
gctacacatgtgtgttttaa

SEQ ID NO: 58349 - DNA, 20 bp, Human coronavirus
taaggactgttataatgttt

SEQ ID NO: 58350 - DNA, 20 bp, Human coronavirus
aaggactgttataatgtttg

SEQ ID NO: 58351 - DNA, 20 bp, Human coronavirus
tgccaaacgttttagacgtg

SEQ ID NO: 58352 - DNA, 20 bp, Human coronavirus
tagacgtgttttggtaaaat

SEQ ID NO: 58353 - DNA, 20 bp, Human coronavirus
agacgtgttttggtaaaatt

SEQ ID NO: 58354 - DNA, 20 bp, Human coronavirus
gacgtgttttggtaaaattg

SEQ ID NO: 58355 - DNA, 20 bp, Human coronavirus
tggtaaaattgcttgatgtc

SEQ ID NO: 58356 - DNA, 20 bp, Human coronavirus
ggaaggtctacatgaagttc

SEQ ID NO: 58357 - DNA, 20 bp, Human coronavirus
ttacatctgcaatgaatgtc

SEQ ID NO: 58358 - DNA, 20 bp, Human coronavirus
catctgcaatgaatgtcatt

SEQ ID NO: 58359 - DNA, 20 bp, Human coronavirus
ggcaacatattaagttgcca

SEQ ID NO: 58360 - DNA, 20 bp, Human coronavirus
agttgccacaattttatatt

SEQ ID NO: 58361 - DNA, 20 bp, Human coronavirus
gttgtttgttttggattatg

SEQ ID NO: 58362 - DNA, 20 bp, Human coronavirus
tttgttttggattatgcctt

SEQ ID NO: 58363 - DNA, 20 bp, Human coronavirus
gttttggattatgccttaca

SEQ ID NO: 58364 - DNA, 20 bp, Human coronavirus
ttttggattatgccttacac

SEQ ID NO: 58365 - DNA, 20 bp, Human coronavirus
tggattatgccttacacaaa

SEQ ID NO: 58366 - DNA, 20 bp, Human coronavirus
tgctgtatataaaaatgtta

SEQ ID NO: 58367 - DNA, 20 bp, Human coronavirus
gctgtatataaaaatgttaa

SEQ ID NO: 58368 - DNA, 20 bp, Human coronavirus
ctgtatataaaaatgttaaa

SEQ ID NO: 58369 - DNA, 20 bp, Human coronavirus
aattttatttaggtgatatt

SEQ ID NO: 58370 - DNA, 20 bp, Human coronavirus
tatttaggtgatatttcaca

SEQ ID NO: 58371 - DNA, 20 bp, Human coronavirus
atatgtgtgttgtaccatcg

SEQ ID NO: 58372 - DNA, 20 bp, Human coronavirus
tatgtgtgttgtaccatcga

SEQ ID NO: 58373 - DNA, 20 bp, Human coronavirus
taccatcgataaatgatctt

SEQ ID NO: 58374 - DNA, 20 bp, Human coronavirus
cttttgataaaaatcttggt

SEQ ID NO: 58375 - DNA, 20 bp, Human coronavirus
ttttgataaaaatcttggtc

SEQ ID NO: 58376 - DNA, 20 bp, Human coronavirus
actcttttgaaggtgtttta

SEQ ID NO: 58377 - DNA, 20 bp, Human coronavirus
tgaaggtgttttacctatta

SEQ ID NO: 58378 - DNA, 20 bp, Human coronavirus
gaaggtgttttacctattaa

SEQ ID NO: 58379 - DNA, 20 bp, Human coronavirus
aaggtgttttacctattaat

SEQ ID NO: 58380 - DNA, 20 bp, Human coronavirus
tacctattaatactgatact

SEQ ID NO: 58381 - DNA, 20 bp, Human coronavirus
aaagtgctattgtctgtgct

SEQ ID NO: 58382 - DNA, 20 bp, Human coronavirus
tctgtgctagtgtgcttaaa

SEQ ID NO: 58383 - DNA, 20 bp, Human coronavirus
aagatggttgtgatgttggt

SEQ ID NO: 58384 - DNA, 20 bp, Human coronavirus
tgatgttggtttttgtccac

SEQ ID NO: 58385 - DNA, 20 bp, Human coronavirus
gtttttgtccacacagacat

SEQ ID NO: 58386 - DNA, 20 bp, Human coronavirus
gtaatgtttttgataatttt

SEQ ID NO: 58387 - DNA, 20 bp, Human coronavirus
ttgataattttaatcaatgg

SEQ ID NO: 58388 - DNA, 20 bp, Human coronavirus
tgataattttaatcaatggc

SEQ ID NO: 58389 - DNA, 20 bp, Human coronavirus
gataattttaatcaatggca

SEQ ID NO: 58390 - DNA, 20 bp, Human coronavirus
ataattttaatcaatggcat

SEQ ID NO: 58391 - DNA, 20 bp, Human coronavirus
gttttggttttgataaatgg

SEQ ID NO: 58392 - DNA, 20 bp, Human coronavirus
ttttggttttgataaatggt

SEQ ID NO: 58393 - DNA, 20 bp, Human coronavirus
tggttttgataaatggtatg

SEQ ID NO: 58394 - DNA, 20 bp, Human coronavirus
ggttttgataaatggtatgt

SEQ ID NO: 58395 - DNA, 20 bp, Human coronavirus
gttttgataaatggtatgtt

SEQ ID NO: 58396 - DNA, 20 bp, Human coronavirus
tcgttgtgcttgttatgctc

SEQ ID NO: 58397 - DNA, 20 bp, Human coronavirus
tgcttgttatgctcatttag

SEQ ID NO: 58398 - DNA, 20 bp, Human coronavirus
ttatgctcatttagccaagg

SEQ ID NO: 58399 - DNA, 20 bp, Human coronavirus
tgctcatttagccaaggcta

SEQ ID NO: 58400 - DNA, 20 bp, Human coronavirus
agccaaggctatgttagatt

SEQ ID NO: 58401 - DNA, 20 bp, Human coronavirus
gcataatttttcagtgtctc

SEQ ID NO: 58402 - DNA, 20 bp, Human coronavirus
cataatttttcagtgtctca

SEQ ID NO: 58403 - DNA, 20 bp, Human coronavirus
ttcagtgtctcataatggtg

SEQ ID NO: 58404 - DNA, 20 bp, Human coronavirus
tcagtgtctcataatggtgt

SEQ ID NO: 58405 - DNA, 20 bp, Human coronavirus
cagtgtctcataatggtgtc

SEQ ID NO: 58406 - DNA, 20 bp, Human coronavirus
gttctgattttactggtagt

SEQ ID NO: 58407 - DNA, 20 bp, Human coronavirus
tgattttactggtagtgttt

SEQ ID NO: 58408 - DNA, 20 bp, Human coronavirus
tactggtagtgtttatggta

SEQ ID NO: 58409 - DNA, 20 bp, Human coronavirus
actggtagtgtttatggtaa

SEQ ID NO: 58410 - DNA, 20 bp, Human coronavirus
ctggtagtgtttatggtaat

SEQ ID NO: 58411 - DNA, 20 bp, Human coronavirus
atgattttaaggtgagtgct

SEQ ID NO: 58412 - DNA, 20 bp, Human coronavirus
tgattttaaggtgagtgctg

SEQ ID NO: 58413 - DNA, 20 bp, Human coronavirus
taaggtgagtgctgctgaat

SEQ ID NO: 58414 - DNA, 20 bp, Human coronavirus
aaggtgagtgctgctgaatt

SEQ ID NO: 58415 - DNA, 20 bp, Human coronavirus
aggtgagtgctgctgaattt

SEQ ID NO: 58416 - DNA, 20 bp, Human coronavirus
tgaggatgctattgctaatg

SEQ ID NO: 58417 - DNA, 20 bp, Human coronavirus
ctaatggatcttcttctcaa

SEQ ID NO: 58418 - DNA, 20 bp, Human coronavirus
ttctcaacttattaaacaat

SEQ ID NO: 58419 - DNA, 20 bp, Human coronavirus
tcaacttattaaacaattga

SEQ ID NO: 58420 - DNA, 20 bp, Human coronavirus
ttaaacaattgaagcgtgcc

SEQ ID NO: 58421 - DNA, 20 bp, Human coronavirus
tttggacacttaatgatgtt

SEQ ID NO: 58422 - DNA, 20 bp, Human coronavirus
ggacacttaatgatgttaaa

SEQ ID NO: 58423 - DNA, 20 bp, Human coronavirus
gacacttaatgatgttaaag

SEQ ID NO: 58424 - DNA, 20 bp, Human coronavirus
atgatgttaaagacaatgat

SEQ ID NO: 58425 - DNA, 20 bp, Human coronavirus
aagacaatgatggtagacct

SEQ ID NO: 58426 - DNA, 20 bp, Human coronavirus
gtctacaagctggtaaacaa

SEQ ID NO: 58427 - DNA, 20 bp, Human coronavirus
gctgttaattctggactttt

SEQ ID NO: 58428 - DNA, 20 bp, Human coronavirus
attctggacttttaactgct

SEQ ID NO: 58429 - DNA, 20 bp, Human coronavirus
tggacttttaactgcttgtg

SEQ ID NO: 58430 - DNA, 20 bp, Human coronavirus
taactgcttgtgctttttct

SEQ ID NO: 58431 - DNA, 20 bp, Human coronavirus
ctattggttgtttggatcct

SEQ ID NO: 58432 - DNA, 20 bp, Human coronavirus
gttgtttggatcctattagg

SEQ ID NO: 58433 - DNA, 20 bp, Human coronavirus
tttggatcctattaggtttt

SEQ ID NO: 58434 - DNA, 20 bp, Human coronavirus
ggatcctattaggttttgtt

SEQ ID NO: 58435 - DNA, 20 bp, Human coronavirus
gatcctattaggttttgttt

SEQ ID NO: 58436 - DNA, 20 bp, Human coronavirus
tggaacacgagcaatccatg

SEQ ID NO: 58437 - DNA, 20 bp, Human coronavirus
acttttctggtgctttggct

SEQ ID NO: 58438 - DNA, 20 bp, Human coronavirus
tctggtgctttggctgagca

SEQ ID NO: 58439 - DNA, 20 bp, Human coronavirus
ctggtgctttggctgagcat

SEQ ID NO: 58440 - DNA, 20 bp, Human coronavirus
tggtgctttggctgagcatg

SEQ ID NO: 58441 - DNA, 20 bp, Human coronavirus
atgcatctcttggcaaaatt

SEQ ID NO: 58442 - DNA, 20 bp, Human coronavirus
tgcatctcttggcaaaattg

SEQ ID NO: 58443 - DNA, 20 bp, Human coronavirus
gcaaaattgtagctagagct

SEQ ID NO: 58444 - DNA, 20 bp, Human coronavirus
tagctagagctatgcttaaa

SEQ ID NO: 58445 - DNA, 20 bp, Human coronavirus
aatgcgttgctctatgcgat

SEQ ID NO: 58446 - DNA, 20 bp, Human coronavirus
tcattttaagcaattaggtt

SEQ ID NO: 58447 - DNA, 20 bp, Human coronavirus
taagcaattaggtttggttt

SEQ ID NO: 58448 - DNA, 20 bp, Human coronavirus
aagcaattaggtttggtttg

SEQ ID NO: 58449 - DNA, 20 bp, Human coronavirus
agcaattaggtttggtttgg

SEQ ID NO: 58450 - DNA, 20 bp, Human coronavirus
ggtttggtttggaataaaga

SEQ ID NO: 58451 - DNA, 20 bp, Human coronavirus
agtatgctattagtggtaaa

SEQ ID NO: 58452 - DNA, 20 bp, Human coronavirus
gtggtaaagaacgtgctaga

SEQ ID NO: 58453 - DNA, 20 bp, Human coronavirus
gtggtgtttctctgttgtct

SEQ ID NO: 58454 - DNA, 20 bp, Human coronavirus
ctctgttgtctacaatgacc

SEQ ID NO: 58455 - DNA, 20 bp, Human coronavirus
tctgttgtctacaatgacca

SEQ ID NO: 58456 - DNA, 20 bp, Human coronavirus
cagccatggtgttgggctct

SEQ ID NO: 58457 - DNA, 20 bp, Human coronavirus
agccatggtgttgggctcta

SEQ ID NO: 58458 - DNA, 20 bp, Human coronavirus
ggctctaagcatgttaattg

SEQ ID NO: 58459 - DNA, 20 bp, Human coronavirus
attgttgtactgcaacagat

SEQ ID NO: 58460 - DNA, 20 bp, Human coronavirus
ttgtactgcaacagataggt

SEQ ID NO: 58461 - DNA, 20 bp, Human coronavirus
tgttcccagcatactatgca

SEQ ID NO: 58462 - DNA, 20 bp, Human coronavirus
gttcccagcatactatgcaa

SEQ ID NO: 58463 - DNA, 20 bp, Human coronavirus
ttcccagcatactatgcaaa

SEQ ID NO: 58464 - DNA, 20 bp, Human coronavirus
ccagcatactatgcaaatag

SEQ ID NO: 58465 - DNA, 20 bp, Human coronavirus
acaaagatggtacctattat

SEQ ID NO: 58466 - DNA, 20 bp, Human coronavirus
ttatgctagtatgtatgaaa

SEQ ID NO: 58467 - DNA, 20 bp, Human coronavirus
tatgctagtatgtatgaaaa

SEQ ID NO: 58468 - DNA, 20 bp, Human coronavirus
atgctagtatgtatgaaaat

SEQ ID NO: 58469 - DNA, 20 bp, Human coronavirus
tgctagtatgtatgaaaatt

SEQ ID NO: 58470 - DNA, 20 bp, Human coronavirus
tacaatattgcaagctgctg

SEQ ID NO: 58471 - DNA, 20 bp, Human coronavirus
acgtgcaccaactattgcaa

SEQ ID NO: 58472 - DNA, 20 bp, Human coronavirus
cgtgcaccaactattgcaaa

SEQ ID NO: 58473 - DNA, 20 bp, Human coronavirus
caaaccaagagaagtattct

SEQ ID NO: 58474 - DNA, 20 bp, Human coronavirus
tagcatttataaattgcacc

SEQ ID NO: 58475 - DNA, 20 bp, Human coronavirus
ataaattgcaccctgctttt

SEQ ID NO: 58476 - DNA, 20 bp, Human coronavirus
gttgggtatggatgttgaaa

SEQ ID NO: 58477 - DNA, 20 bp, Human coronavirus
ggtatggatgttgaaagtgc

SEQ ID NO: 58478 - DNA, 20 bp, Human coronavirus
aaagtgctcatgtttgtggc

SEQ ID NO: 58479 - DNA, 20 bp, Human coronavirus
gtggcgataacataggtact

SEQ ID NO: 58480 - DNA, 20 bp, Human coronavirus
tggcgataacataggtacta

SEQ ID NO: 58481 - DNA, 20 bp, Human coronavirus
tgatatacaacagtggggtt

SEQ ID NO: 58482 - DNA, 20 bp, Human coronavirus
gatatacaacagtggggtta

SEQ ID NO: 58483 - DNA, 20 bp, Human coronavirus
atatacaacagtggggttat

SEQ ID NO: 58484 - DNA, 20 bp, Human coronavirus
tgttggttccttgagccaaa

SEQ ID NO: 58485 - DNA, 20 bp, Human coronavirus
gttccttgagccaaaaccac

SEQ ID NO: 58486 - DNA, 20 bp, Human coronavirus
tgacaagcaacctgttaata

SEQ ID NO: 58487 - DNA, 20 bp, Human coronavirus
atagtaatgtcaagttgttg

SEQ ID NO: 58488 - DNA, 20 bp, Human coronavirus
ttggattatgattatgcaac

SEQ ID NO: 58489 - DNA, 20 bp, Human coronavirus
gattatgattatgcaaccca

SEQ ID NO: 58490 - DNA, 20 bp, Human coronavirus
tgattatgcaacccatggtc

SEQ ID NO: 58491 - DNA, 20 bp, Human coronavirus
acaacttggtttttacaaat

SEQ ID NO: 58492 - DNA, 20 bp, Human coronavirus
gtttttacaaataaaacaac

SEQ ID NO: 58493 - DNA, 20 bp, Human coronavirus
ttacaaataaaacaacattg

SEQ ID NO: 58494 - DNA, 20 bp, Human coronavirus
tacaaataaaacaacattgc

SEQ ID NO: 58495 - DNA, 20 bp, Human coronavirus
acaaataaaacaacattgcc

SEQ ID NO: 58496 - DNA, 20 bp, Human coronavirus
atgaagttattatagataat

SEQ ID NO: 58497 - DNA, 20 bp, Human coronavirus
ttatagataataaaccttat

SEQ ID NO: 58498 - DNA, 20 bp, Human coronavirus
tagataataaaccttatagg

SEQ ID NO: 58499 - DNA, 20 bp, Human coronavirus
taggtggatgttgtggtgta

SEQ ID NO: 58500 - DNA, 20 bp, Human coronavirus
tggtgtaaagataaccactt

SEQ ID NO: 58501 - DNA, 20 bp, Human coronavirus
tgcactatggtgctggttct

SEQ ID NO: 58502 - DNA, 20 bp, Human coronavirus
gcactatggtgctggttctg

SEQ ID NO: 58503 - DNA, 20 bp, Human coronavirus
cactatggtgctggttctga

SEQ ID NO: 58504 - DNA, 20 bp, Human coronavirus
tgacaaaggtgtggcacctg

SEQ ID NO: 58505 - DNA, 20 bp, Human coronavirus
taaaacgttggctaccaccc

SEQ ID NO: 58506 - DNA, 20 bp, Human coronavirus
caattaggtgttcctgacaa

SEQ ID NO: 58507 - DNA, 20 bp, Human coronavirus
ggtgttcctgacaattcttc

SEQ ID NO: 58508 - DNA, 20 bp, Human coronavirus
ctgacaattcttcaactatt

SEQ ID NO: 58509 - DNA, 20 bp, Human coronavirus
ttcaactattgttacgggtt

SEQ ID NO: 58510 - DNA, 20 bp, Human coronavirus
aactattgttacgggtttat

SEQ ID NO: 58511 - DNA, 20 bp, Human coronavirus
atataatgtaactcgtactt

SEQ ID NO: 58512 - DNA, 20 bp, Human coronavirus
tataatgtaactcgtacttt

SEQ ID NO: 58513 - DNA, 20 bp, Human coronavirus
ttatgtgccagcagcttata

SEQ ID NO: 58514 - DNA, 20 bp, Human coronavirus
tatgtgccagcagcttataa

SEQ ID NO: 58515 - DNA, 20 bp, Human coronavirus
atgtgccagcagcttataaa

SEQ ID NO: 58516 - DNA, 20 bp, Human coronavirus
cccttttaataattggtttt

SEQ ID NO: 58517 - DNA, 20 bp, Human coronavirus
ccttttaataattggttttt

SEQ ID NO: 58518 - DNA, 20 bp, Human coronavirus
taataattggtttttgttaa

SEQ ID NO: 58519 - DNA, 20 bp, Human coronavirus
aataattggtttttgttaac

SEQ ID NO: 58520 - DNA, 20 bp, Human coronavirus
ataattggtttttgttaact

SEQ ID NO: 58521 - DNA, 20 bp, Human coronavirus
tggcccgtcctctcaacctt

SEQ ID NO: 58522 - DNA, 20 bp, Human coronavirus
ggcccgtcctctcaacctta

SEQ ID NO: 58523 - DNA, 20 bp, Human coronavirus
gcccgtcctctcaaccttat

SEQ ID NO: 58524 - DNA, 20 bp, Human coronavirus
ttactgttttataaacagca

SEQ ID NO: 58525 - DNA, 20 bp, Human coronavirus
ctgttttataaacagcacta

SEQ ID NO: 58526 - DNA, 20 bp, Human coronavirus
ggattgcaggatggttttta

SEQ ID NO: 58527 - DNA, 20 bp, Human coronavirus
gattgcaggatggtttttat

SEQ ID NO: 58528 - DNA, 20 bp, Human coronavirus
caggatggtttttattctgc

SEQ ID NO: 58529 - DNA, 20 bp, Human coronavirus
ttattctgcaaattttcttg

SEQ ID NO: 58530 - DNA, 20 bp, Human coronavirus
tattctgcaaattttcttga

SEQ ID NO: 58531 - DNA, 20 bp, Human coronavirus
ttattgtgacaccatgtaac

SEQ ID NO: 58532 - DNA, 20 bp, Human coronavirus
tattgtgacaccatgtaacc

SEQ ID NO: 58533 - DNA, 20 bp, Human coronavirus
attgtgacaccatgtaacca

SEQ ID NO: 58534 - DNA, 20 bp, Human coronavirus
ttgtgacaccatgtaaccaa

SEQ ID NO: 58535 - DNA, 20 bp, Human coronavirus
tgacaccatgtaaccaacca

SEQ ID NO: 58536 - DNA, 20 bp, Human coronavirus
aagccgtatagcaggacgta

SEQ ID NO: 58537 - DNA, 20 bp, Human coronavirus
ggaagatttgttgtttagca

SEQ ID NO: 58538 - DNA, 20 bp, Human coronavirus
gaagatttgttgtttagcaa

SEQ ID NO: 58539 - DNA, 20 bp, Human coronavirus
gttgtttagcaaagttgtta

SEQ ID NO: 58540 - DNA, 20 bp, Human coronavirus
ttgtttagcaaagttgttac

SEQ ID NO: 58541 - DNA, 20 bp, Human coronavirus
accatctcacttcacaattg

SEQ ID NO: 58542 - DNA, 20 bp, Human coronavirus
acaattgagacataattttc

SEQ ID NO: 58543 - DNA, 20 bp, Human coronavirus
agacataattttcaggccat

SEQ ID NO: 58544 - DNA, 20 bp, Human coronavirus
tcaggccatttctaattcaa

SEQ ID NO: 58545 - DNA, 20 bp, Human coronavirus
caggccatttctaattcaat

SEQ ID NO: 58546 - DNA, 20 bp, Human coronavirus
atggcatttatggctatgtt

SEQ ID NO: 58547 - DNA, 20 bp, Human coronavirus
atggctatgttctgcgtcaa

SEQ ID NO: 58548 - DNA, 20 bp, Human coronavirus
tggctatgttctgcgtcaac

SEQ ID NO: 58549 - DNA, 20 bp, Human coronavirus
tgcgtcaacctaacttggtt

SEQ ID NO: 58550 - DNA, 20 bp, Human coronavirus
gttctttattctgataatgg

SEQ ID NO: 58551 - DNA, 20 bp, Human coronavirus
gtgggtttggctcattattt

SEQ ID NO: 58552 - DNA, 20 bp, Human coronavirus
ggctcattatttctgttgtt

SEQ ID NO: 58553 - DNA, 20 bp, Human coronavirus
gctcattatttctgttgttt

SEQ ID NO: 58554 - DNA, 20 bp, Human coronavirus
tttctgttgtttttgttgta

SEQ ID NO: 58555 - DNA, 20 bp, Human coronavirus
ctgttgtttttgttgtattg

SEQ ID NO: 58556 - DNA, 20 bp, Human coronavirus
cagctgaagtactaaatgtc

SEQ ID NO: 58557 - DNA, 20 bp, Human coronavirus
tagaggtttatgtccattta

SEQ ID NO: 58558 - DNA, 20 bp, Human coronavirus
agaggtttatgtccatttac

SEQ ID NO: 58559 - DNA, 20 bp, Human coronavirus
gaggtttatgtccatttacg

SEQ ID NO: 58560 - DNA, 20 bp, Human coronavirus
atgtccatttacgtaactgg

SEQ ID NO: 58561 - DNA, 20 bp, Human coronavirus
acggacataattattactta

SEQ ID NO: 58562 - DNA, 20 bp, Human coronavirus
cggacataattattacttac

SEQ ID NO: 58563 - DNA, 20 bp, Human coronavirus
ttacttaccggtgatggctg

SEQ ID NO: 58564 - DNA, 20 bp, Human coronavirus
cttaccggtgatggctgcac

SEQ ID NO: 58565 - DNA, 20 bp, Human coronavirus
ccggtgatggctgcacctac

SEQ ID NO: 58566 - DNA, 20 bp, Human coronavirus
ggccgatgacagagctgcta

SEQ ID NO: 58567 - DNA, 20 bp, Human coronavirus
cctcctccttcattttacat

SEQ ID NO: 58568 - DNA, 20 bp, Human coronavirus
ctcctccttcattttacatg

SEQ ID NO: 58569 - DNA, 20 bp, Human coronavirus
attttacatgcctcttttgg

SEQ ID NO: 58570 - DNA, 20 bp, Human coronavirus
tacatgcctcttttggttag

SEQ ID NO: 58571 - DNA, 20 bp, Human coronavirus
tttgggttgctaaggaaggt

SEQ ID NO: 58572 - DNA, 20 bp, Human coronavirus
gggttgctaaggaaggtgct

SEQ ID NO: 58573 - DNA, 20 bp, Human coronavirus
ggttgctaaggaaggtgcta

SEQ ID NO: 58574 - DNA, 20 bp, Human coronavirus
ctaaggaaggtgctaaaact

SEQ ID NO: 58575 - DNA, 20 bp, Human coronavirus
ataccagtcttggtaatcgc

SEQ ID NO: 58576 - DNA, 20 bp, Human coronavirus
ttgctgctgttactttggct

SEQ ID NO: 58577 - DNA, 20 bp, Human coronavirus
ctgctgttactttggcttta

SEQ ID NO: 58578 - DNA, 20 bp, Human coronavirus
ctttggctttaaagaactta

SEQ ID NO: 58579 - DNA, 20 bp, Human coronavirus
ggctttaaagaacttaggtt

SEQ ID NO: 58580 - DNA, 20 bp, Human coronavirus
gctttaaagaacttaggttt

SEQ ID NO: 58581 - DNA, 20 bp, Human coronavirus
ctgaattgattcctaatcag

SEQ ID NO: 58582 - DNA, 20 bp, Human coronavirus
attcctaatcaggctgcgtt

SEQ ID NO: 58583 - DNA, 20 bp, Human coronavirus
ctaatcaggctgcgttattc

SEQ ID NO: 58584 - DNA, 20 bp, Human coronavirus
ttctttgatagtgaggttag

SEQ ID NO: 58585 - DNA, 20 bp, Human coronavirus
tttgatagtgaggttagcac

SEQ ID NO: 58586 - DNA, 20 bp, Human papillomavirus
gcctattggagtttgtttta

SEQ ID NO: 58587 - DNA, 20 bp, Human papillomavirus
gagtttgttttatattatca

SEQ ID NO: 58588 - DNA, 20 bp, Human papillomavirus
gttttatattatcaggagtc

SEQ ID NO: 58589 - DNA, 20 bp, Human papillomavirus
ttttatattatcaggagtct

SEQ ID NO: 58590 - DNA, 20 bp, Human papillomavirus
tatattatcaggagtcttat

SEQ ID NO: 58591 - DNA, 20 bp, Human papillomavirus
tgaggaaacgttagaggaaa

SEQ ID NO: 58592 - DNA, 20 bp, Human papillomavirus
gaggaaacctcacttggtga

SEQ ID NO: 58593 - DNA, 20 bp, Human papillomavirus
gtgacctagataatgtttct

SEQ ID NO: 58594 - DNA, 20 bp, Human papillomavirus
cttgtgttagcgacttatct

SEQ ID NO: 58595 - DNA, 20 bp, Human papillomavirus
ttgtgttagcgacttatctg

SEQ ID NO: 58596 - DNA, 20 bp, Human papillomavirus
tacagacctgacgcggtcgt

SEQ ID NO: 58597 - DNA, 20 bp, Human papillomavirus
acagacctgacgcggtcgta

SEQ ID NO: 58598 - DNA, 20 bp, Human papillomavirus
cagacctgacgcggtcgtac

SEQ ID NO: 58599 - DNA, 20 bp, Human papillomavirus
tggagattgggttttggcag

SEQ ID NO: 58600 - DNA, 20 bp, Human papillomavirus
ggttttggcagtttggggtg

SEQ ID NO: 58601 - DNA, 20 bp, Human papillomavirus
ttttggtataaaagatctat

SEQ ID NO: 58602 - DNA, 20 bp, Human papillomavirus
tggtataaaagatctatgtc

SEQ ID NO: 58603 - DNA, 20 bp, Human papillomavirus
ggtataaaagatctatgtct

SEQ ID NO: 58604 - DNA, 20 bp, Human papillomavirus
gtataaaagatctatgtctt

SEQ ID NO: 58605 - DNA, 20 bp, Human papillomavirus
aactgtttttacatggggta

SEQ ID NO: 58606 - DNA, 20 bp, Human papillomavirus
agcagtggaatctaattaga

SEQ ID NO: 58607 - DNA, 20 bp, Human papillomavirus
gacaagaacaagttcttttc

SEQ ID NO: 58608 - DNA, 20 bp, Human papillomavirus
ttttccatttcgccagaaaa

SEQ ID NO: 58609 - DNA, 20 bp, Human papillomavirus
tccatttcgccagaaaaaat

SEQ ID NO: 58610 - DNA, 20 bp, Human papillomavirus
ccatttcgccagaaaaaatg

SEQ ID NO: 58611 - DNA, 20 bp, Human papillomavirus
aagaagagtggcagcacact

SEQ ID NO: 58612 - DNA, 20 bp, Human papillomavirus
aggttacctatgacaataac

SEQ ID NO: 58613 - DNA, 20 bp, Human papillomavirus
cctatgacaataaccctgat

SEQ ID NO: 58614 - DNA, 20 bp, Human papillomavirus
caaattgtgtgccttgtctg

SEQ ID NO: 58615 - DNA, 20 bp, Human papillomavirus
tgtgccttgtctgattatca

SEQ ID NO: 58616 - DNA, 20 bp, Human papillomavirus
ggtgtagtcgatggacgtcg

SEQ ID NO: 58617 - DNA, 20 bp, Human papillomavirus
ctgggcggtgtcactctcgg

SEQ ID NO: 58618 - DNA, 20 bp, Human papillomavirus
gtaaagtttattgatgaggc

SEQ ID NO: 58619 - DNA, 20 bp, Human papillomavirus
attgatgaggctcaacgaga

SEQ ID NO: 58620 - DNA, 20 bp, Human papillomavirus
ttgatgaggctcaacgagag

SEQ ID NO: 58621 - DNA, 20 bp, Human papillomavirus
atgaggctcaacgagagaag

SEQ ID NO: 58622 - DNA, 20 bp, Human papillomavirus
cttgagagagttgctttgcc

SEQ ID NO: 58623 - DNA, 20 bp, Human papillomavirus
aaaataaaattgagcataca

SEQ ID NO: 58624 - DNA, 20 bp, Human papillomavirus
agcatacaacaattgctgat

SEQ ID NO: 58625 - DNA, 20 bp, Human papillomavirus
ctgataaaatattgcaatat

SEQ ID NO: 58626 - DNA, 20 bp, Human papillomavirus
caatatggcagtctgggagt

SEQ ID NO: 58627 - DNA, 20 bp, Human papillomavirus
ttttgggaggtttgggcatt

SEQ ID NO: 58628 - DNA, 20 bp, Human papillomavirus
tagatcctacaggccctgct

SEQ ID NO: 58629 - DNA, 20 bp, Human papillomavirus
ttcccctacaagatttaggt

SEQ ID NO: 58630 - DNA, 20 bp, Human papillomavirus
ccctacaagatttaggtaga

SEQ ID NO: 58631 - DNA, 20 bp, Human papillomavirus
aggtagagacttcccaatac

SEQ ID NO: 58632 - DNA, 20 bp, Human papillomavirus
ggtagagacttcccaatacc

SEQ ID NO: 58633 - DNA, 20 bp, Human papillomavirus
tatttgttagcaatggttca

SEQ ID NO: 58634 - DNA, 20 bp, Human papillomavirus
gttagcaatggttcaggtga

SEQ ID NO: 58635 - DNA, 20 bp, Human papillomavirus
ttagcaatggttcaggtgac

SEQ ID NO: 58636 - DNA, 20 bp, Human papillomavirus
gcaatggttcaggtgacagg

SEQ ID NO: 58637 - DNA, 20 bp, Human papillomavirus
aggtgacagggtggtgggcg

SEQ ID NO: 58638 - DNA, 20 bp, Human papillomavirus
atgaggtgtctattatcttc

SEQ ID NO: 58639 - DNA, 20 bp, Human papillomavirus
tcttccaaagagacttagat

SEQ ID NO: 58640 - DNA, 20 bp, Human papillomavirus
caaagagacttagatgctct

SEQ ID NO: 58641 - DNA, 20 bp, Human papillomavirus
gatgctcttgctcagacacc

SEQ ID NO: 58642 - DNA, 20 bp, Human papillomavirus
ctcagacaccagtgcctgaa

SEQ ID NO: 58643 - DNA, 20 bp, Human papillomavirus
aattattgcctttaggtgag

SEQ ID NO: 58644 - DNA, 20 bp, Human papillomavirus
ttgcctttaggtgagcatag

SEQ ID NO: 58645 - DNA, 20 bp, Human papillomavirus
cctttaggtgagcatagtca

SEQ ID NO: 58646 - DNA, 20 bp, Human papillomavirus
aggtgagcatagtcaaacaa

SEQ ID NO: 58647 - DNA, 20 bp, Human papillomavirus
ggtgagcatagtcaaacaac

SEQ ID NO: 58648 - DNA, 20 bp, Human papillomavirus
taccatgcaacatctgaacg

SEQ ID NO: 58649 - DNA, 20 bp, Human papillomavirus
gtttgagatctccagtaatc

SEQ ID NO: 58650 - DNA, 20 bp, Human papillomavirus
tttgagatctccagtaatca

SEQ ID NO: 58651 - DNA, 20 bp, Human papillomavirus
attactggagatctcaaaca

SEQ ID NO: 58652 - DNA, 20 bp, Human papillomavirus
ctggagatctcaaacaaagg

SEQ ID NO: 58653 - DNA, 20 bp, Human papillomavirus
gatgatgcagaaaatccaac

SEQ ID NO: 58654 - DNA, 20 bp, Human papillomavirus
tattaatactcatgcaaatg

SEQ ID NO: 58655 - DNA, 20 bp, Human papillomavirus
atactcatgcaaatggagat

SEQ ID NO: 58656 - DNA, 20 bp, Human papillomavirus
tagacaaaatactgcttttg

SEQ ID NO: 58657 - DNA, 20 bp, Human papillomavirus
tgatgcaaaacagacacaaa

SEQ ID NO: 58658 - DNA, 20 bp, Human papillomavirus
ctgctttacagcaagacaag

SEQ ID NO: 58659 - DNA, 20 bp, Human papillomavirus
acagcaagacaagtctgatg

SEQ ID NO: 58660 - DNA, 20 bp, Human papillomavirus
cagcaagacaagtctgatgt

SEQ ID NO: 58661 - DNA, 20 bp, Human papillomavirus
agatgttgttcaagcaacat

SEQ ID NO: 58662 - DNA, 20 bp, Human papillomavirus
gatgttgttcaagcaacatg

SEQ ID NO: 58663 - DNA, 20 bp, Human papillomavirus
catctgatgtccaattgttt

SEQ ID NO: 58664 - DNA, 20 bp, Human papillomavirus
atctgatgtccaattgttta

SEQ ID NO: 58665 - DNA, 20 bp, Human papillomavirus
tttaatagatcttactggct

SEQ ID NO: 58666 - DNA, 20 bp, Human papillomavirus
aatagatcttactggcttca

SEQ ID NO: 58667 - DNA, 20 bp, Human papillomavirus
atagatcttactggcttcag

SEQ ID NO: 58668 - DNA, 20 bp, Human papillomavirus
ctgcaatatgcaataaaagt

SEQ ID NO: 58669 - DNA, 20 bp, Human papillomavirus
ctttttgttaatccctccct

SEQ ID NO: 58670 - DNA, 20 bp, Human papillomavirus
tttttgttaatccctcccta

SEQ ID NO: 58671 - DNA, 20 bp, Human papillomavirus
ttgttaatccctccctactc

SEQ ID NO: 58672 - DNA, 20 bp, Human papillomavirus
tgttaatccctccctactcc

SEQ ID NO: 58673 - DNA, 20 bp, Human papillomavirus
gcccaaagacggtttgccaa

SEQ ID NO: 58674 - DNA, 20 bp, Human papillomavirus
cccaaagacggtttgccaac

SEQ ID NO: 58675 - DNA, 20 bp, Human papillomavirus
gccaaccgcggttaggactt

SEQ ID NO: 58676 - DNA, 20 bp, Human papillomavirus
ccaaccgcggttaggacttg

SEQ ID NO: 58677 - DNA, 20 bp, Human papillomavirus
ggacttgtttcaatttgctg

SEQ ID NO: 58678 - DNA, 20 bp, Human papillomavirus type 204
acttgtgcagcagatctgct

SEQ ID NO: 58679 - DNA, 20 bp, Human papillomavirus type 204
tgcagcagatctgctctcca

SEQ ID NO: 58680 - DNA, 20 bp, Human papillomavirus type 204
ttgattgtttatttttgtgt

SEQ ID NO: 58681 - DNA, 20 bp, Human papillomavirus type 204
tgattgtttatttttgtgtg

SEQ ID NO: 58682 - DNA, 20 bp, Human papillomavirus type 204
gattgtttatttttgtgtga

SEQ ID NO: 58683 - DNA, 20 bp, Human papillomavirus type 204
aatagatgaggcaccacaaa

SEQ ID NO: 58684 - DNA, 20 bp, Human papillomavirus type 204
atagatgaggcaccacaaag

SEQ ID NO: 58685 - DNA, 20 bp, Human papillomavirus type 204
cctggaattgttccaccaac

SEQ ID NO: 58686 - DNA, 20 bp, Human papillomavirus type 204
ttccaccaacaggaaagctt

SEQ ID NO: 58687 - DNA, 20 bp, Human papillomavirus type 204
caccaacaggaaagcttgga

SEQ ID NO: 58688 - DNA, 20 bp, Human papillomavirus type 204
tcgttgccaaatgaagttga

SEQ ID NO: 58689 - DNA, 20 bp, Human papillomavirus type 204
ccaaatgaagttgacactga

SEQ ID NO: 58690 - DNA, 20 bp, Human papillomavirus type 204
acactgatgttacggagagt

SEQ ID NO: 58691 - DNA, 20 bp, Human papillomavirus type 204
cggagagtcaaacccaggta

SEQ ID NO: 58692 - DNA, 20 bp, Human papillomavirus type 204
cattcagtttctacctgggt

SEQ ID NO: 58693 - DNA, 20 bp, Human papillomavirus type 204
gtttaaatgtacaatttcaa

SEQ ID NO: 58694 - DNA, 20 bp, Human papillomavirus type 204
aaatgtacaatttcaaaatt

SEQ ID NO: 58695 - DNA, 20 bp, Human papillomavirus type 204
aatgtacaatttcaaaattg

SEQ ID NO: 58696 - DNA, 20 bp, Human papillomavirus type 204
caaaattgacattcacatat

SEQ ID NO: 58697 - DNA, 20 bp, Human papillomavirus type 204
aaaattgacattcacatatg

SEQ ID NO: 58698 - DNA, 20 bp, Human papillomavirus type 204
ttggttgcagcccttatcag

SEQ ID NO: 58699 - DNA, 20 bp, Human papillomavirus type 204
tggttgcagcccttatcaga

SEQ ID NO: 58700 - DNA, 20 bp, Human papillomavirus type 204
ggttgcagcccttatcagat

SEQ ID NO: 58701 - DNA, 20 bp, Human papillomavirus type 204
gttgcagcccttatcagata

SEQ ID NO: 58702 - DNA, 20 bp, Human papillomavirus type 204
cagcccttatcagatacaaa

SEQ ID NO: 58703 - DNA, 20 bp, Human papillomavirus type 204
aagatcaaataacacattgg

SEQ ID NO: 58704 - DNA, 20 bp, Human papillomavirus type 204
gaccttaataaaacaagagc

SEQ ID NO: 58705 - DNA, 20 bp, Human papillomavirus type 204
ataaaacaagagcaagtgct

SEQ ID NO: 58706 - DNA, 20 bp, Human papillomavirus type 204
ttcactatgctcgacaaaat

SEQ ID NO: 58707 - DNA, 20 bp, Human papillomavirus type 204
tcactatgctcgacaaaatg

SEQ ID NO: 58708 - DNA, 20 bp, Human papillomavirus type 204
ggtgtcttcttcggtggtct

SEQ ID NO: 58709 - DNA, 20 bp, Human papillomavirus type 204
ttcggtggtcttggtattgg

SEQ ID NO: 58710 - DNA, 20 bp, Human papillomavirus type 204
ggtggtcttggtattggaac

SEQ ID NO: 58711 - DNA, 20 bp, Human papillomavirus type 204
gtattggaactggtagagga

SEQ ID NO: 58712 - DNA, 20 bp, Human papillomavirus type 204
gaactggtagaggatctggt

SEQ ID NO: 58713 - DNA, 20 bp, Human papillomavirus type 204
accctgcttctgatcttcct

SEQ ID NO: 58714 - DNA, 20 bp, Human papillomavirus type 204
tgatcttcctacatctacta

SEQ ID NO: 58715 - DNA, 20 bp, Human papillomavirus type 204
ctacatctactacaataggg

SEQ ID NO: 58716 - DNA, 20 bp, Human papillomavirus type 204
attttgggtcacccctattg

SEQ ID NO: 58717 - DNA, 20 bp, Human papillomavirus type 204
tgggtcacccctattgtagt

SEQ ID NO: 58718 - DNA, 20 bp, Human papillomavirus type 204
ttgaatttcatagtgggcgt

SEQ ID NO: 58719 - DNA, 20 bp, Human papillomavirus type 204
aatttcatagtgggcgtgca

SEQ ID NO: 58720 - DNA, 20 bp, Human papillomavirus type 204
catagtgggcgtgcatccag

SEQ ID NO: 58721 - DNA, 20 bp, Human papillomavirus type 204
atagtgggcgtgcatccagc

SEQ ID NO: 58722 - DNA, 20 bp, Human papillomavirus type 204
gacacagatattgtagcaga

SEQ ID NO: 58723 - DNA, 20 bp, Human papillomavirus type 204
aatagatttgatgatgtgga

SEQ ID NO: 58724 - DNA, 20 bp, Human papillomavirus type 204
atagatttgatgatgtggaa

SEQ ID NO: 58725 - DNA, 20 bp, Human papillomavirus type 204
gatgatgtggaaaatcctgc

SEQ ID NO: 58726 - DNA, 20 bp, Human papillomavirus type 204
atgatgtggaaaatcctgct

SEQ ID NO: 58727 - DNA, 20 bp, Human papillomavirus type 204
gatcctaaacaaacacaagt

SEQ ID NO: 58728 - DNA, 20 bp, Human papillomavirus type 204
tggaaatttggattttaggc

SEQ ID NO: 58729 - DNA, 20 bp, Human papillomavirus type 204
ggaaatttggattttaggcg

SEQ ID NO: 58730 - DNA, 20 bp, Human papillomavirus type 204
gaaatttggattttaggcga

SEQ ID NO: 58731 - DNA, 20 bp, Human papillomavirus type 204
ggattttaggcgattacaag

SEQ ID NO: 58732 - DNA, 20 bp, Human papillomavirus type 204
gattttaggcgattacaagg

SEQ ID NO: 58733 - DNA, 20 bp, Human papillomavirus type 204
ctacagacaattattttgct

SEQ ID NO: 58734 - DNA, 20 bp, Human papillomavirus type 204
ttttgctgttcccagtggtt

SEQ ID NO: 58735 - DNA, 20 bp, Human papillomavirus type 204
tgctgttcccagtggttctc

SEQ ID NO: 58736 - DNA, 20 bp, Human papillomavirus type 204
gctgttcccagtggttctct

SEQ ID NO: 58737 - DNA, 20 bp, Human papillomavirus type 204
ctgttcccagtggttctctc

SEQ ID NO: 58738 - DNA, 20 bp, Human papillomavirus type 204
agtacggtatgtatatccct

SEQ ID NO: 58739 - DNA, 20 bp, Human papillomavirus type 204
taaacatctcagacaagttg

SEQ ID NO: 58740 - DNA, 20 bp, Human papillomavirus type 204
tagcatcctttttggcagca

SEQ ID NO: 58741 - DNA, 20 bp, Human papillomavirus type 204
ttggcagcatcgtttggcag

SEQ ID NO: 58742 - DNA, 20 bp, Human papillomavirus type 204
tggcagcatcgtttggcagc

SEQ ID NO: 58743 - DNA, 20 bp, Influenza B virus
aggtgggtccgggagcaacc

SEQ ID NO: 58744 - DNA, 20 bp, Influenza B virus
gaagcaggaattctggagtg

SEQ ID NO: 58745 - DNA, 20 bp, Influenza B virus
aagcaggaattctggagtgc

SEQ ID NO: 58746 - DNA, 20 bp, Influenza B virus
tggagtgctatgaaaggttt

SEQ ID NO: 58747 - DNA, 20 bp, Influenza B virus
tcatggcaaagagcccttga

SEQ ID NO: 58748 - DNA, 20 bp, Influenza B virus
tgtttatggatccctctgct

SEQ ID NO: 58749 - DNA, 20 bp, Influenza B virus
atggatccctctgctggaat

SEQ ID NO: 58750 - DNA, 20 bp, Influenza B virus
tggatccctctgctggaatt

SEQ ID NO: 58751 - DNA, 20 bp, Influenza B virus
aagggtttgagccatactgt

SEQ ID NO: 58752 - DNA, 20 bp, Influenza B virus
gagccatactgtgtgaaaaa

SEQ ID NO: 58753 - DNA, 20 bp, Influenza B virus
tccttgagagtgttggtgaa

SEQ ID NO: 58754 - DNA, 20 bp, Influenza B virus
agagtgttggtgaacggaac

SEQ ID NO: 58755 - DNA, 20 bp, Influenza B virus
gtgaacggaaccttcctcaa

SEQ ID NO: 58756 - DNA, 20 bp, Influenza B virus
ctcaagcaccctaatggaga

SEQ ID NO: 58757 - DNA, 20 bp, Influenza B virus
tcaactcttcatagattgaa

SEQ ID NO: 58758 - DNA, 20 bp, Influenza B virus
aaagccaattcgagcagctg

SEQ ID NO: 58759 - DNA, 20 bp, Influenza B virus
gagcagctgaaactgcggtg

SEQ ID NO: 58760 - DNA, 20 bp, Influenza B virus
tcccaatttggtcaagagca

SEQ ID NO: 58761 - DNA, 20 bp, Influenza B virus
ggtcaagagcaccgattatc

SEQ ID NO: 58762 - DNA, 20 bp, Influenza B virus
gtcaagagcaccgattatca

SEQ ID NO: 58763 - DNA, 20 bp, Hepatitis A virus
atacctcaccgccgtttgcc

SEQ ID NO: 58764 - DNA, 20 bp, Hepatitis A virus
gcctaggctataggctaaat

SEQ ID NO: 58765 - DNA, 20 bp, Hepatitis A virus
cctaggctataggctaaatt

SEQ ID NO: 58766 - DNA, 20 bp, Hepatitis A virus
tccctttcccttttcccttt

SEQ ID NO: 58767 - DNA, 20 bp, Hepatitis A virus
ccctttcccttttccctttc

SEQ ID NO: 58768 - DNA, 20 bp, Hepatitis A virus
gggacacagatgtttggaac

SEQ ID NO: 58769 - DNA, 20 bp, Hepatitis A virus
ggaacgtcaccttgcagtgt

SEQ ID NO: 58770 - DNA, 20 bp, Hepatitis A virus
gaacgtcaccttgcagtgtt

SEQ ID NO: 58771 - DNA, 20 bp, Hepatitis A virus
cagtgttaacttggctttca

SEQ ID NO: 58772 - DNA, 20 bp, Hepatitis A virus
acttggctttcatgaatctc

SEQ ID NO: 58773 - DNA, 20 bp, Hepatitis A virus
ggcagacattgaggaagagc

SEQ ID NO: 58774 - DNA, 20 bp, Hepatitis A virus
gcagacattgaggaagagca

SEQ ID NO: 58775 - DNA, 20 bp, Hepatitis A virus
aggaagagcaaatgattcaa

SEQ ID NO: 58776 - DNA, 20 bp, Hepatitis A virus
aatcagttgataggactgca

SEQ ID NO: 58777 - DNA, 20 bp, Hepatitis A virus
ataggactgcagtgactggt

SEQ ID NO: 58778 - DNA, 20 bp, Hepatitis A virus
gctgttcaagggttgttgag

SEQ ID NO: 58779 - DNA, 20 bp, Hepatitis A virus
ctgttcaagggttgttgaga

SEQ ID NO: 58780 - DNA, 20 bp, Hepatitis A virus
aagggttgttgagataccat

SEQ ID NO: 58781 - DNA, 20 bp, Hepatitis A virus
ttgagataccatacatatgc

SEQ ID NO: 58782 - DNA, 20 bp, Hepatitis A virus
agataccatacatatgcaag

SEQ ID NO: 58783 - DNA, 20 bp, Hepatitis A virus
ccactttaaagatccacaat

SEQ ID NO: 58784 - DNA, 20 bp, Hepatitis A virus
aaagatccacaatacccagt

SEQ ID NO: 58785 - DNA, 20 bp, Hepatitis A virus
aagatccacaatacccagtt

SEQ ID NO: 58786 - DNA, 20 bp, Hepatitis A virus
gggaattgacaattagagtt

SEQ ID NO: 58787 - DNA, 20 bp, Hepatitis A virus
ggaattgacaattagagttt

SEQ ID NO: 58788 - DNA, 20 bp, Hepatitis A virus
ggatcaggaagattggaaat

SEQ ID NO: 58789 - DNA, 20 bp, Hepatitis A virus
gatcaggaagattggaaatc

SEQ ID NO: 58790 - DNA, 20 bp, Hepatitis A virus
gaaatctgatccgtcccagg

SEQ ID NO: 58791 - DNA, 20 bp, Hepatitis A virus
ctcattttactacttggaca

SEQ ID NO: 58792 - DNA, 20 bp, Hepatitis A virus
tactacttggacatctattc

SEQ ID NO: 58793 - DNA, 20 bp, Hepatitis A virus
ttcccaccaaatatcattca

SEQ ID NO: 58794 - DNA, 20 bp, Hepatitis A virus
tcccaccaaatatcattcag

SEQ ID NO: 58795 - DNA, 20 bp, Hepatitis A virus
cccaccaaatatcattcagg

SEQ ID NO: 58796 - DNA, 20 bp, Hepatitis A virus
ccaccaaatatcattcaggt

SEQ ID NO: 58797 - DNA, 20 bp, Hepatitis A virus
aggtagattactgttttgtt

SEQ ID NO: 58798 - DNA, 20 bp, Hepatitis A virus
ggaagcttattgtgtattgt

SEQ ID NO: 58799 - DNA, 20 bp, Hepatitis A virus
ttgtgtattgttataacaga

SEQ ID NO: 58800 - DNA, 20 bp, Hepatitis A virus
tgtattgttataacagattg

SEQ ID NO: 58801 - DNA, 20 bp, Hepatitis A virus
ttataacagattgacctctc

SEQ ID NO: 58802 - DNA, 20 bp, Hepatitis A virus
taacagattgacctctcctt

SEQ ID NO: 58803 - DNA, 20 bp, Hepatitis A virus
caggagtacaagcacctgtg

SEQ ID NO: 58804 - DNA, 20 bp, Hepatitis A virus
aggagtacaagcacctgtgg

SEQ ID NO: 58805 - DNA, 20 bp, Hepatitis A virus
aggatccagttttagcaaag

SEQ ID NO: 58806 - DNA, 20 bp, Hepatitis A virus
tagcaaagaaagtacctgag

SEQ ID NO: 58807 - DNA, 20 bp, Hepatitis A virus
agcaaagaaagtacctgaga

SEQ ID NO: 58808 - DNA, 20 bp, Hepatitis A virus
gccatcaacactgaggtggt

SEQ ID NO: 58809 - DNA, 20 bp, Hepatitis A virus
ccatcaacactgaggtggtt

SEQ ID NO: 58810 - DNA, 20 bp, Hepatitis A virus
ttcaacttgtttcagttgta

SEQ ID NO: 58811 - DNA, 20 bp, Hepatitis A virus
tcaacttgtttcagttgtat

SEQ ID NO: 58812 - DNA, 20 bp, Hepatitis A virus
caacttgtttcagttgtata

SEQ ID NO: 58813 - DNA, 20 bp, Hepatitis A virus
gagagtcatatagaatgcag

SEQ ID NO: 58814 - DNA, 20 bp, Hepatitis A virus
agagtcatatagaatgcagg

SEQ ID NO: 58815 - DNA, 20 bp, Hepatitis A virus
gaagttgggaaacaaagact

SEQ ID NO: 58816 - DNA, 20 bp, Hepatitis A virus
ggaaacaaagactcaagtat

SEQ ID NO: 58817 - DNA, 20 bp, Hepatitis A virus
atttgacaattcttcctgag

SEQ ID NO: 58818 - DNA, 20 bp, Hepatitis A virus
aaggaggtttggattctctt

SEQ ID NO: 58819 - DNA, 20 bp, Hepatitis A virus
aggaggtttggattctcttt

SEQ ID NO: 58820 - DNA, 20 bp, Hepatitis A virus
ggattctctttggccgcagg

SEQ ID NO: 58821 - DNA, 20 bp, Hepatitis A virus
gattctctttggccgcaggc

SEQ ID NO: 58822 - DNA, 20 bp, Hepatitis A virus
tctttggccgcaggcagaag

SEQ ID NO: 58823 - DNA, 20 bp, Hepatitis A virus
gcatcattgatgatattggc

SEQ ID NO: 58824 - DNA, 20 bp, Hepatitis A virus
catcattgatgatattggcc

SEQ ID NO: 58825 - DNA, 20 bp, Hepatitis A virus
atgatattggccaaaacaca

SEQ ID NO: 58826 - DNA, 20 bp, Hepatitis A virus
gccaaaacacaacagatgag

SEQ ID NO: 58827 - DNA, 20 bp, Hepatitis A virus
gtcagatttttgtcagttag

SEQ ID NO: 58828 - DNA, 20 bp, Hepatitis A virus
tctggctttttccaatctgt

SEQ ID NO: 58829 - DNA, 20 bp, Hepatitis A virus
ttccaatctgttactaatca

SEQ ID NO: 58830 - DNA, 20 bp, Hepatitis A virus
tccaatctgttactaatcac

SEQ ID NO: 58831 - DNA, 20 bp, Hepatitis A virus
ccaatctgttactaatcaca

SEQ ID NO: 58832 - DNA, 20 bp, Hepatitis A virus
caatctgttactaatcacaa

SEQ ID NO: 58833 - DNA, 20 bp, Hepatitis A virus
ggaagaacttggttcagttt

SEQ ID NO: 58834 - DNA, 20 bp, Hepatitis A virus
gttcagtttggagttggaga

SEQ ID NO: 58835 - DNA, 20 bp, Hepatitis A virus
agtttggagttggagagaag

SEQ ID NO: 58836 - DNA, 20 bp, Hepatitis A virus
ggagttggagagaagaatgg

SEQ ID NO: 58837 - DNA, 20 bp, Hepatitis A virus
gagttggagagaagaatgga

SEQ ID NO: 58838 - DNA, 20 bp, Hepatitis A virus
gtttcatcgaatcaatctat

SEQ ID NO: 58839 - DNA, 20 bp, Hepatitis A virus
catcgaatcaatctatacag

SEQ ID NO: 58840 - DNA, 20 bp, Hepatitis A virus
atcgaatcaatctatacaga

SEQ ID NO: 58841 - DNA, 20 bp, Hepatitis A virus
ggcatccatgttgctggagg

SEQ ID NO: 58842 - DNA, 20 bp, Hepatitis A virus
ctggaggaaattcaattctt

SEQ ID NO: 58843 - DNA, 20 bp, Hepatitis A virus
attttcctgcagctatgccc

SEQ ID NO: 58844 - DNA, 20 bp, Hepatitis A virus
tcctgcagctatgccctttt

SEQ ID NO: 58845 - DNA, 20 bp, Hepatitis A virus
cctgcagctatgcccttttc

SEQ ID NO: 58846 - DNA, 20 bp, Hepatitis A virus
ctgcagctatgcccttttct

SEQ ID NO: 58847 - DNA, 20 bp, Hepatitis A virus
tctaaagctgaaattgatcc

SEQ ID NO: 58848 - DNA, 20 bp, Hepatitis A virus
accaaaagagatttaatttg

SEQ ID NO: 58849 - DNA, 20 bp, Hepatitis A virus
aatttggttggatgaaaatg

SEQ ID NO: 58850 - DNA, 20 bp, Hepatitis A virus
atttggttggatgaaaatgg

SEQ ID NO: 58851 - DNA, 20 bp, Hepatitis A virus
ggttggatgaaaatggttta

SEQ ID NO: 58852 - DNA, 20 bp, Hepatitis A virus
gttggatgaaaatggtttat

SEQ ID NO: 58853 - DNA, 20 bp, Hepatitis A virus
gggtccagctattagttatt

SEQ ID NO: 58854 - DNA, 20 bp, Hepatitis A virus
gttattttcatttgaatcca

SEQ ID NO: 58855 - DNA, 20 bp, Hepatitis A virus
ttttcatttgaatccaggtt

SEQ ID NO: 58856 - DNA, 20 bp, Hepatitis A virus
tcatttgaatccaggtttcc

SEQ ID NO: 58857 - DNA, 20 bp, Hepatitis A virus
catttgaatccaggtttcca

SEQ ID NO: 58858 - DNA, 20 bp, Influenza A virus
tcgctcaaaaacttcccgga

SEQ ID NO: 58859 - DNA, 20 bp, Influenza A virus
cgctcaaaaacttcccggaa

SEQ ID NO: 58860 - DNA, 20 bp, Influenza A virus
gctcaaaaacttcccggaaa

SEQ ID NO: 58861 - DNA, 20 bp, Influenza A virus
ccggaaatgacaacagcacg

SEQ ID NO: 58862 - DNA, 20 bp, Influenza A virus
ggcaccatgcagtaccaaac

SEQ ID NO: 58863 - DNA, 20 bp, Influenza A virus
caaaataagaaatgggacct

SEQ ID NO: 58864 - DNA, 20 bp, Influenza A virus
ttgttgaacgcagcaaagcc

SEQ ID NO: 58865 - DNA, 20 bp, Influenza A virus
tgttgaacgcagcaaagcct

SEQ ID NO: 58866 - DNA, 20 bp, Influenza A virus
gttgaacgcagcaaagccta

SEQ ID NO: 58867 - DNA, 20 bp, Influenza A virus
ttgaacgcagcaaagcctac

SEQ ID NO: 58868 - DNA, 20 bp, Influenza A virus
aacgtgactatgccaaacaa

SEQ ID NO: 58869 - DNA, 20 bp, Influenza A virus
gacaaactgtacatttgggg

SEQ ID NO: 58870 - DNA, 20 bp, Influenza A virus
acaaactgtacatttggggg

SEQ ID NO: 58871 - DNA, 20 bp, Influenza A virus
ggggggttcaccacccgggt

SEQ ID NO: 58872 - DNA, 20 bp, Influenza A virus
gggggttcaccacccgggta

SEQ ID NO: 58873 - DNA, 20 bp, Influenza A virus
ctcctcggggttacttcaaa

SEQ ID NO: 58874 - DNA, 20 bp, Influenza A virus
cttcaaaatacgaagtggga

SEQ ID NO: 58875 - DNA, 20 bp, Influenza A virus
aaaatacgaagtgggaaaag

SEQ ID NO: 58876 - DNA, 20 bp, Influenza A virus
gcaaatgcaattctgaatgc

SEQ ID NO: 58877 - DNA, 20 bp, Influenza A virus
tgaatgcatcactccaaatg

SEQ ID NO: 58878 - DNA, 20 bp, Influenza A virus
ggcgcaatcgcgggtttcat

SEQ ID NO: 58879 - DNA, 20 bp, Influenza A virus
gcgcaatcgcgggtttcata

SEQ ID NO: 58880 - DNA, 20 bp, Influenza A virus
catagaaaatggttgggagg

SEQ ID NO: 58881 - DNA, 20 bp, Influenza A virus
atagaaaatggttgggaggg

SEQ ID NO: 58882 - DNA, 20 bp, Influenza A virus
ggagggaatggtagacggtt

SEQ ID NO: 58883 - DNA, 20 bp, Influenza A virus
aggacactaaaatagatctc

SEQ ID NO: 58884 - DNA, 20 bp, Influenza A virus
ttgtggccctggagaaccaa

SEQ ID NO: 58885 - DNA, 20 bp, Influenza A virus
tggccctggagaaccaacat

SEQ ID NO: 58886 - DNA, 20 bp, Influenza A virus
gatcaattgtatgttggttc

SEQ ID NO: 58887 - DNA, 20 bp, Influenza A virus
tatgttggttctccagggcc

SEQ ID NO: 58888 - DNA, 20 bp, Influenza A virus
cagatcaaaggtgttgagtt

SEQ ID NO: 58889 - DNA, 20 bp, Influenza A virus
agttgaagtcaggatacaaa

SEQ ID NO: 58890 - DNA, 20 bp, Influenza A virus
aagtcaggatacaaagattg

SEQ ID NO: 58891 - DNA, 20 bp, Influenza A virus
gatcctatggatttcctttg

SEQ ID NO: 58892 - DNA, 20 bp, Influenza A virus
cctttgccatatcatgtttt

SEQ ID NO: 58893 - DNA, 20 bp, Human papillomavirus type 96
ctaggacattttatatacag

SEQ ID NO: 58894 - DNA, 20 bp, Human papillomavirus type 96
taggacattttatatacaga

SEQ ID NO: 58895 - DNA, 20 bp, Human papillomavirus type 96
tatatacagacatacagatc

SEQ ID NO: 58896 - DNA, 20 bp, Human papillomavirus type 96
atatacagacatacagatct

SEQ ID NO: 58897 - DNA, 20 bp, Human papillomavirus type 96
tatacagacatacagatctc

SEQ ID NO: 58898 - DNA, 20 bp, Human papillomavirus type 96
gaacatttttatgaaaaaac

SEQ ID NO: 58899 - DNA, 20 bp, Human papillomavirus type 96
aacatttttatgaaaaaaca

SEQ ID NO: 58900 - DNA, 20 bp, Human papillomavirus type 96
ttatgaaaaaacagtcaagg

SEQ ID NO: 58901 - DNA, 20 bp, Human papillomavirus type 96
tatgaaaaaacagtcaaggg

SEQ ID NO: 58902 - DNA, 20 bp, Human papillomavirus type 96
atgaaaaaacagtcaaggga

SEQ ID NO: 58903 - DNA, 20 bp, Human papillomavirus type 96
tcctgcccattgacctgcat

SEQ ID NO: 58904 - DNA, 20 bp, Human papillomavirus type 96
acctgcattgtgacgaagag

SEQ ID NO: 58905 - DNA, 20 bp, Human papillomavirus type 96
tgacgaagagttgacagaag

SEQ ID NO: 58906 - DNA, 20 bp, Human papillomavirus type 96
acagaagagcagtcagaaaa

SEQ ID NO: 58907 - DNA, 20 bp, Human papillomavirus type 96
tgacaggttttctgactgct

SEQ ID NO: 58908 - DNA, 20 bp, Human papillomavirus type 96
cagaaatggcagataataga

SEQ ID NO: 58909 - DNA, 20 bp, Human papillomavirus type 96
atcctaaagaagggtgtagt

SEQ ID NO: 58910 - DNA, 20 bp, Human papillomavirus type 96
gttttctcttgaagcagact

SEQ ID NO: 58911 - DNA, 20 bp, Human papillomavirus type 96
tctcttgaagcagactgtag

SEQ ID NO: 58912 - DNA, 20 bp, Human papillomavirus type 96
ctcttgaagcagactgtagt

SEQ ID NO: 58913 - DNA, 20 bp, Human papillomavirus type 96
aaacgaaagtatttcagtcc

SEQ ID NO: 58914 - DNA, 20 bp, Human papillomavirus type 96
cagtccgaaagagttgcagc

SEQ ID NO: 58915 - DNA, 20 bp, Human papillomavirus type 96
agtccgaaagagttgcagca

SEQ ID NO: 58916 - DNA, 20 bp, Human papillomavirus type 96
cagcagcttagccctcgttt

SEQ ID NO: 58917 - DNA, 20 bp, Human papillomavirus type 96
gccctcgtttggaagcaata

SEQ ID NO: 58918 - DNA, 20 bp, Human papillomavirus type 96
ggggtggggtttatggaact

SEQ ID NO: 58919 - DNA, 20 bp, Human papillomavirus type 96
gggtggggtttatggaactg

SEQ ID NO: 58920 - DNA, 20 bp, Human papillomavirus type 96
atggaactgtgtaggaaatt

SEQ ID NO: 58921 - DNA, 20 bp, Human papillomavirus type 96
tggaactgtgtaggaaattt

SEQ ID NO: 58922 - DNA, 20 bp, Human papillomavirus type 96
aatagcaataagacttgttg

SEQ ID NO: 58923 - DNA, 20 bp, Human papillomavirus type 96
tgataaaattagtacaacat

SEQ ID NO: 58924 - DNA, 20 bp, Human papillomavirus type 96
gataaaattagtacaacatg

SEQ ID NO: 58925 - DNA, 20 bp, Human papillomavirus type 96
ataaaattagtacaacatgg

SEQ ID NO: 58926 - DNA, 20 bp, Human papillomavirus type 96
gtacaacatggtcatgggtg

SEQ ID NO: 58927 - DNA, 20 bp, Human papillomavirus type 96
acaaggtaatacacgcatag

SEQ ID NO: 58928 - DNA, 20 bp, Human papillomavirus type 96
tgttacaaatatttacaggg

SEQ ID NO: 58929 - DNA, 20 bp, Human papillomavirus type 96
caaatatttacaggggctgt

SEQ ID NO: 58930 - DNA, 20 bp, Human papillomavirus type 96
acaggggctgtaaggcagct

SEQ ID NO: 58931 - DNA, 20 bp, Human papillomavirus type 96
caggggctgtaaggcagctg

SEQ ID NO: 58932 - DNA, 20 bp, Human papillomavirus type 96
ttaataaagttgaacaaaaa

SEQ ID NO: 58933 - DNA, 20 bp, Human papillomavirus type 96
gatacagtcaaccctattga

SEQ ID NO: 58934 - DNA, 20 bp, Human papillomavirus type 96
accctgttgcaccttcagtt

SEQ ID NO: 58935 - DNA, 20 bp, Human papillomavirus type 96
caccttcagttgtccctctt

SEQ ID NO: 58936 - DNA, 20 bp, Human papillomavirus type 96
agttgtccctcttacagaca

SEQ ID NO: 58937 - DNA, 20 bp, Human papillomavirus type 96
tccctcttacagacacagga

SEQ ID NO: 58938 - DNA, 20 bp, Human papillomavirus type 96
ggaaacgagcaaccatcaga

SEQ ID NO: 58939 - DNA, 20 bp, Human papillomavirus type 96
gcactcaagttcacttttac

SEQ ID NO: 58940 - DNA, 20 bp, Human papillomavirus type 96
acttttacagagatataagc

SEQ ID NO: 58941 - DNA, 20 bp, Human papillomavirus type 96
tacagagatataagcactat

SEQ ID NO: 58942 - DNA, 20 bp, Human papillomavirus type 96
acagagatataagcactatt

SEQ ID NO: 58943 - DNA, 20 bp, Human papillomavirus type 96
gtaatttttttgcagatgtc

SEQ ID NO: 58944 - DNA, 20 bp, Human papillomavirus type 96
taatttttttgcagatgtca

SEQ ID NO: 58945 - DNA, 20 bp, Human papillomavirus type 96
ttttgcagatgtcatcattg

SEQ ID NO: 58946 - DNA, 20 bp, Human papillomavirus type 96
tttgcagatgtcatcattgt

SEQ ID NO: 58947 - DNA, 20 bp, Human papillomavirus type 96
ttgcagatgtcatcattgtg

SEQ ID NO: 58948 - DNA, 20 bp, Human papillomavirus type 96
agggtacacttaccggatcc

SEQ ID NO: 58949 - DNA, 20 bp, Human papillomavirus type 96
gggtacacttaccggatcct

SEQ ID NO: 58950 - DNA, 20 bp, Human papillomavirus type 96
ccggatcctaacagatttgc

SEQ ID NO: 58951 - DNA, 20 bp, Human papillomavirus type 96
gctctagctgacatgtcagt

SEQ ID NO: 58952 - DNA, 20 bp, Human papillomavirus type 96
ctctagctgacatgtcagtg

SEQ ID NO: 58953 - DNA, 20 bp, Human papillomavirus type 96
aaatgtttgttttgggttgt

SEQ ID NO: 58954 - DNA, 20 bp, Human papillomavirus type 96
gttttgggttgtataccctg

SEQ ID NO: 58955 - DNA, 20 bp, Human papillomavirus type 96
ttttgggttgtataccctgc

SEQ ID NO: 58956 - DNA, 20 bp, Human papillomavirus type 96
tgggttgtataccctgcttg

SEQ ID NO: 58957 - DNA, 20 bp, Human papillomavirus type 96
gggttgtataccctgcttgg

SEQ ID NO: 58958 - DNA, 20 bp, Human papillomavirus type 96
cttcttttatgccagaagag

SEQ ID NO: 58959 - DNA, 20 bp, Human papillomavirus type 96
ttttatgccagaagagaaca

SEQ ID NO: 58960 - DNA, 20 bp, Human papillomavirus type 96
tatgccagaagagaacaatg

SEQ ID NO: 58961 - DNA, 20 bp, Human papillomavirus type 96
atgccagaagagaacaatgt

SEQ ID NO: 58962 - DNA, 20 bp, Human papillomavirus type 96
tgccagaagagaacaatgtt

SEQ ID NO: 58963 - DNA, 20 bp, Influenza A virus
ctcatgcagattgccatcct

SEQ ID NO: 58964 - DNA, 20 bp, Influenza A virus
ccatcctggtaactactgtg

SEQ ID NO: 58965 - DNA, 20 bp, Influenza A virus
cattttaagcaacatgagtg

SEQ ID NO: 58966 - DNA, 20 bp, Influenza A virus
taagcaacatgagtgcgact

SEQ ID NO: 58967 - DNA, 20 bp, Influenza A virus
aagcaacatgagtgcgactc

SEQ ID NO: 58968 - DNA, 20 bp, Influenza A virus
gcacctttttctaaggacaa

SEQ ID NO: 58969 - DNA, 20 bp, Influenza A virus
cacctttttctaaggacaat

SEQ ID NO: 58970 - DNA, 20 bp, Influenza A virus
ttctaaggacaattcaatcc

SEQ ID NO: 58971 - DNA, 20 bp, Influenza A virus
tctaaggacaattcaatccg

SEQ ID NO: 58972 - DNA, 20 bp, Influenza A virus
ctaaggacaattcaatccgg

SEQ ID NO: 58973 - DNA, 20 bp, Influenza A virus
tcacgatggaaaagcatggt

SEQ ID NO: 58974 - DNA, 20 bp, Influenza A virus
catgtttgtgtcactgggga

SEQ ID NO: 58975 - DNA, 20 bp, Influenza A virus
gtgtcactggggatgataaa

SEQ ID NO: 58976 - DNA, 20 bp, Influenza A virus
tgtcactggggatgataaaa

SEQ ID NO: 58977 - DNA, 20 bp, Influenza A virus
catttttatcatccccagtg

SEQ ID NO: 58978 - DNA, 20 bp, Influenza A virus
tcaggaagtgctcagcatgt

SEQ ID NO: 58979 - DNA, 20 bp, Influenza A virus
ctgttatcctcgatatcctg

SEQ ID NO: 58980 - DNA, 20 bp, Influenza A virus
tcctcgatatcctgacgtca

SEQ ID NO: 58981 - DNA, 20 bp, Influenza A virus
gagcctttccagttgtctct

SEQ ID NO: 58982 - DNA, 20 bp, Influenza A virus
ccagttgtctctgcagatac

SEQ ID NO: 58983 - DNA, 20 bp, Influenza A virus
gacaatggagatgacgtgtg

SEQ ID NO: 58984 - DNA, 20 bp, Influenza A virus
acaatggagatgacgtgtgg

SEQ ID NO: 58985 - DNA, 20 bp, Influenza A virus
acgctcaggttatgaaactt

SEQ ID NO: 58986 - DNA, 20 bp, Influenza A virus
cgctcaggttatgaaacttt

SEQ ID NO: 58987 - DNA, 20 bp, Influenza A virus
tgaaactttcaaagtcattg

SEQ ID NO: 58988 - DNA, 20 bp, Human beta herpesvirus 6A
cacgcgcgtgtcggctacga

SEQ ID NO: 58989 - DNA, 20 bp, Human beta herpesvirus 6A
cacgcgacagatccgtctct

SEQ ID NO: 58990 - DNA, 20 bp, Human beta herpesvirus 6A
gagtgggagagcacagagct

SEQ ID NO: 58991 - DNA, 20 bp, Human beta herpesvirus 6A
cgcccgcgtctccagtccgt

SEQ ID NO: 58992 - DNA, 20 bp, Human beta herpesvirus 6A
gcccgcgtctccagtccgtc

SEQ ID NO: 58993 - DNA, 20 bp, Human beta herpesvirus 6A
ccttcgcgtttctctccaca

SEQ ID NO: 58994 - DNA, 20 bp, Human beta herpesvirus 6A
gcgtttctctccacatctcc

SEQ ID NO: 58995 - DNA, 20 bp, Human beta herpesvirus 6A
ctctccacatctccgcacgt

SEQ ID NO: 58996 - DNA, 20 bp, Human beta herpesvirus 6A
tctccacatctccgcacgtc

SEQ ID NO: 58997 - DNA, 20 bp, Human beta herpesvirus 6A
acgtcaaccgccaggacggg

SEQ ID NO: 58998 - DNA, 20 bp, Human beta herpesvirus 6A
ttccgcccatgaggcgggac

SEQ ID NO: 58999 - DNA, 20 bp, Human beta herpesvirus 6A
cgcccatgaggcgggacttc

SEQ ID NO: 59000 - DNA, 20 bp, Human beta herpesvirus 6A
gagacgagccacccttcgta

SEQ ID NO: 59001 - DNA, 20 bp, Human beta herpesvirus 6A
gtatacgtccggcccctccc

SEQ ID NO: 59002 - DNA, 20 bp, Human beta herpesvirus 6A
cgcaacgagggggtgcgtcc

SEQ ID NO: 59003 - DNA, 20 bp, Human beta herpesvirus 6A
acaagacgagggctgcaacg

SEQ ID NO: 59004 - DNA, 20 bp, Human beta herpesvirus 6A
caagacgagggctgcaacgc

SEQ ID NO: 59005 - DNA, 20 bp, Human beta herpesvirus 6A
ttcatacgtcacggcgtcgc

SEQ ID NO: 59006 - DNA, 20 bp, Human beta herpesvirus 6A
atacgtcacggcgtcgcgtt

SEQ ID NO: 59007 - DNA, 20 bp, Human beta herpesvirus 6A
cagccctcgtcttgtaaact

SEQ ID NO: 59008 - DNA, 20 bp, Human beta herpesvirus 6A
ccgaggagggcccgcgcgcg

SEQ ID NO: 59009 - DNA, 20 bp, Human beta herpesvirus 6A
tctctcctccggcgtatcct

SEQ ID NO: 59010 - DNA, 20 bp, Human beta herpesvirus 6A
tccggcctcccgggtacggc

SEQ ID NO: 59011 - DNA, 20 bp, Human beta herpesvirus 6A
cgccgtgtctttcgataagg

SEQ ID NO: 59012 - DNA, 20 bp, Human beta herpesvirus 6A
gccgtgtctttcgataaggc

SEQ ID NO: 59013 - DNA, 20 bp, Human beta herpesvirus 6A
cgataaggctctcgtgccgt

SEQ ID NO: 59014 - DNA, 20 bp, Human beta herpesvirus 6A
gataaggctctcgtgccgtt

SEQ ID NO: 59015 - DNA, 20 bp, Human beta herpesvirus 6A
ccagagaccgaacgcgtcct

SEQ ID NO: 59016 - DNA, 20 bp, Human beta herpesvirus 6A
cagagaccgaacgcgtcctc

SEQ ID NO: 59017 - DNA, 20 bp, Human beta herpesvirus 6A
aacgcgtagatctccccgca

SEQ ID NO: 59018 - DNA, 20 bp, Human beta herpesvirus 6A
aacggtgtgttcgacgacgc

SEQ ID NO: 59019 - DNA, 20 bp, Human beta herpesvirus 6A
acggtgtgttcgacgacgcg

SEQ ID NO: 59020 - DNA, 20 bp, Human beta herpesvirus 6A
ggaatggtatacgtgacccg

SEQ ID NO: 59021 - DNA, 20 bp, Human beta herpesvirus 6A
tcggacgggtcccttataaa

SEQ ID NO: 59022 - DNA, 20 bp, Human beta herpesvirus 6A
taaatgtcgtggtccaataa

SEQ ID NO: 59023 - DNA, 20 bp, Human beta herpesvirus 6A
ttggaccacgacatttataa

SEQ ID NO: 59024 - DNA, 20 bp, Human beta herpesvirus 6A
gaccacgacatttataaggg

SEQ ID NO: 59025 - DNA, 20 bp, Human beta herpesvirus 6A
accagcacgttgtctatcca

SEQ ID NO: 59026 - DNA, 20 bp, Human beta herpesvirus 6A
tctatccaatcgtaataata

SEQ ID NO: 59027 - DNA, 20 bp, Human beta herpesvirus 6A
ttacgattggatagacaacg

SEQ ID NO: 59028 - DNA, 20 bp, Human beta herpesvirus 6A
cgattggatagacaacgtgc

SEQ ID NO: 59029 - DNA, 20 bp, Human beta herpesvirus 6A
gatagacaacgtgctggtta

SEQ ID NO: 59030 - DNA, 20 bp, Human beta herpesvirus 6A
attaaatttcagcctccgtt

SEQ ID NO: 59031 - DNA, 20 bp, Human beta herpesvirus 6A
ttaaatttcagcctccgttt

SEQ ID NO: 59032 - DNA, 20 bp, Human beta herpesvirus 6A
aatttcagcctccgttttga

SEQ ID NO: 59033 - DNA, 20 bp, Human beta herpesvirus 6A
cagcctccgttttgactcac

SEQ ID NO: 59034 - DNA, 20 bp, Human beta herpesvirus 6A
agcctccgttttgactcaca

SEQ ID NO: 59035 - DNA, 20 bp, Human beta herpesvirus 6A
cacatttcttgcaactctgc

SEQ ID NO: 59036 - DNA, 20 bp, Human beta herpesvirus 6A
cttgcaactctgcggcagac

SEQ ID NO: 59037 - DNA, 20 bp, Human beta herpesvirus 6A
ttgcaactctgcggcagact

SEQ ID NO: 59038 - DNA, 20 bp, Human beta herpesvirus 6A
caactctgcggcagactttg

SEQ ID NO: 59039 - DNA, 20 bp, Human beta herpesvirus 6A
gtgggaaatggaattttaca

SEQ ID NO: 59040 - DNA, 20 bp, Human beta herpesvirus 6A
ttagccactgcacccactaa

SEQ ID NO: 59041 - DNA, 20 bp, Human beta herpesvirus 6A
gccactgcacccactaaaca

SEQ ID NO: 59042 - DNA, 20 bp, Human beta herpesvirus 6A
caaacttgcaaacctgacct

SEQ ID NO: 59043 - DNA, 20 bp, Human beta herpesvirus 6A
caaacctgacctcgataaag

SEQ ID NO: 59044 - DNA, 20 bp, Human beta herpesvirus 6A
atttgctcttccatatgtcg

SEQ ID NO: 59045 - DNA, 20 bp, Human beta herpesvirus 6A
cccgccggagatttcaaagc

SEQ ID NO: 59046 - DNA, 20 bp, Human beta herpesvirus 6A
caaagcatactttcgcaaca

SEQ ID NO: 59047 - DNA, 20 bp, Human beta herpesvirus 6A
aaagcatactttcgcaacat

SEQ ID NO: 59048 - DNA, 20 bp, Human beta herpesvirus 6A
cgcaacatagagggaaatga

SEQ ID NO: 59049 - DNA, 20 bp, Human beta herpesvirus 6A
gcaacatagagggaaatgac

SEQ ID NO: 59050 - DNA, 20 bp, Human beta herpesvirus 6A
ggcatctctcgatctagtac

SEQ ID NO: 59051 - DNA, 20 bp, Human beta herpesvirus 6A
gcatctctcgatctagtaca

SEQ ID NO: 59052 - DNA, 20 bp, Human beta herpesvirus 6A
accgcagagttgcctgagtt

SEQ ID NO: 59053 - DNA, 20 bp, Human beta herpesvirus 6A
ccgcagagttgcctgagttt

SEQ ID NO: 59054 - DNA, 20 bp, Human beta herpesvirus 6A
cctgagttttcggtattcga

SEQ ID NO: 59055 - DNA, 20 bp, Human beta herpesvirus 6A
agtatagtctagtgtgtcgt

SEQ ID NO: 59056 - DNA, 20 bp, Human beta herpesvirus 6A
gttgtgtcgcactgggtttt

SEQ ID NO: 59057 - DNA, 20 bp, Human beta herpesvirus 6A
tgtcgcactgggttttgaag

SEQ ID NO: 59058 - DNA, 20 bp, Human beta herpesvirus 6A
tgaagaagaagatgggatgt

SEQ ID NO: 59059 - DNA, 20 bp, Human beta herpesvirus 6A
gaagaagaagatgggatgtg

SEQ ID NO: 59060 - DNA, 20 bp, Human beta herpesvirus 6A
tttgtataaaagttaaatgt

SEQ ID NO: 59061 - DNA, 20 bp, Human beta herpesvirus 6A
ttgtataaaagttaaatgtt

SEQ ID NO: 59062 - DNA, 20 bp, Human beta herpesvirus 6A
tgtataaaagttaaatgtta

SEQ ID NO: 59063 - DNA, 20 bp, Human beta herpesvirus 6A
gtataaaagttaaatgttat

SEQ ID NO: 59064 - DNA, 20 bp, Human beta herpesvirus 6A
tataaaagttaaatgttata

SEQ ID NO: 59065 - DNA, 20 bp, Human beta herpesvirus 6A
tttttctcttttaaatgtta

SEQ ID NO: 59066 - DNA, 20 bp, Human beta herpesvirus 6A
ttttctcttttaaatgttac

SEQ ID NO: 59067 - DNA, 20 bp, Human beta herpesvirus 6A
tttctcttttaaatgttaca

SEQ ID NO: 59068 - DNA, 20 bp, Human beta herpesvirus 6A
ttctcttttaaatgttacaa

SEQ ID NO: 59069 - DNA, 20 bp, Human beta herpesvirus 6A
tctcttttaaatgttacaac

SEQ ID NO: 59070 - DNA, 20 bp, Human beta herpesvirus 6A
atatttagcgtgacggtgct

SEQ ID NO: 59071 - DNA, 20 bp, Human beta herpesvirus 6A
agcgtgacggtgctccgatc

SEQ ID NO: 59072 - DNA, 20 bp, Human beta herpesvirus 6A
gcgtgacggtgctccgatca

SEQ ID NO: 59073 - DNA, 20 bp, Human beta herpesvirus 6A
tttcgtgattggaaaccgtc

SEQ ID NO: 59074 - DNA, 20 bp, Human beta herpesvirus 6A
cgtgattggaaaccgtcgct

SEQ ID NO: 59075 - DNA, 20 bp, Human beta herpesvirus 6A
aataaagaagagaaccttcc

SEQ ID NO: 59076 - DNA, 20 bp, Human beta herpesvirus 6A
ccgagggtcattcgactcac

SEQ ID NO: 59077 - DNA, 20 bp, Human beta herpesvirus 6A
gactcacatcattgaagcgg

SEQ ID NO: 59078 - DNA, 20 bp, Human beta herpesvirus 6A
aagcggattacgttcgctgc

SEQ ID NO: 59079 - DNA, 20 bp, Human beta herpesvirus 6A
cgttcgctgcaacggcgatc

SEQ ID NO: 59080 - DNA, 20 bp, Human beta herpesvirus 6A
gattgcgcgattaggttaga

SEQ ID NO: 59081 - DNA, 20 bp, Human beta herpesvirus 6A
cgcgattaggttagattcgg

SEQ ID NO: 59082 - DNA, 20 bp, Human beta herpesvirus 6A
ggttagattcggaaaccata

SEQ ID NO: 59083 - DNA, 20 bp, Human beta herpesvirus 6A
gattcggaaaccatagctgt

SEQ ID NO: 59084 - DNA, 20 bp, Human beta herpesvirus 6A
ggaaaccatagctgtccatg

SEQ ID NO: 59085 - DNA, 20 bp, Human beta herpesvirus 6A
ggtttggccttgttccgtaa

SEQ ID NO: 59086 - DNA, 20 bp, Human beta herpesvirus 6A
ggccttgttccgtaattaaa

SEQ ID NO: 59087 - DNA, 20 bp, Human beta herpesvirus 6A
gccttgttccgtaattaaaa

SEQ ID NO: 59088 - DNA, 20 bp, Human beta herpesvirus 6A
ttccgtaattaaaacgtcgt

SEQ ID NO: 59089 - DNA, 20 bp, Human beta herpesvirus 6A
cgtaattaaaacgtcgttga

SEQ ID NO: 59090 - DNA, 20 bp, Human beta herpesvirus 6A
cttgcgattgttctgcgata

SEQ ID NO: 59091 - DNA, 20 bp, Human beta herpesvirus 6A
cgattgttctgcgatagagg

SEQ ID NO: 59092 - DNA, 20 bp, Human beta herpesvirus 6A
ttctgcgatagaggaattgc

SEQ ID NO: 59093 - DNA, 20 bp, Human beta herpesvirus 6A
tgcgatagaggaattgcttt

SEQ ID NO: 59094 - DNA, 20 bp, Human beta herpesvirus 6A
ctttgtcacgagtcgcttct

SEQ ID NO: 59095 - DNA, 20 bp, Human beta herpesvirus 6A
gcaagcagaccagtttacag

SEQ ID NO: 59096 - DNA, 20 bp, Human beta herpesvirus 6A
caagcagaccagtttacagg

SEQ ID NO: 59097 - DNA, 20 bp, Human beta herpesvirus 6A
acaggtatgggcgcaaagtg

SEQ ID NO: 59098 - DNA, 20 bp, Human beta herpesvirus 6A
caggtatgggcgcaaagtgc

SEQ ID NO: 59099 - DNA, 20 bp, Human beta herpesvirus 6A
cacatgccgcaagatactgg

SEQ ID NO: 59100 - DNA, 20 bp, Human beta herpesvirus 6A
gtgcctctaaccgttgttct

SEQ ID NO: 59101 - DNA, 20 bp, Human beta herpesvirus 6A
ttcttggagatgacgggtta

SEQ ID NO: 59102 - DNA, 20 bp, Human beta herpesvirus 6A
ttggagatgacgggttagag

SEQ ID NO: 59103 - DNA, 20 bp, Human beta herpesvirus 6A
gagatgacgggttagagatt

SEQ ID NO: 59104 - DNA, 20 bp, Human beta herpesvirus 6A
gagattttggaagcatacgt

SEQ ID NO: 59105 - DNA, 20 bp, Human beta herpesvirus 6A
gtgacgccaaaaaatgctta

SEQ ID NO: 59106 - DNA, 20 bp, Human beta herpesvirus 6A
tgccttattgttcgacgatg

SEQ ID NO: 59107 - DNA, 20 bp, Human beta herpesvirus 6A
ttgttcgacgatgatttgtg

SEQ ID NO: 59108 - DNA, 20 bp, Human beta herpesvirus 6A
ttcgacgatgatttgtgttt

SEQ ID NO: 59109 - DNA, 20 bp, Human beta herpesvirus 6A
gacgatgatttgtgtttgct

SEQ ID NO: 59110 - DNA, 20 bp, Human beta herpesvirus 6A
cgctactccataggctattt

SEQ ID NO: 59111 - DNA, 20 bp, Human beta herpesvirus 6A
gttttttcagtacggcggaa

SEQ ID NO: 59112 - DNA, 20 bp, Human beta herpesvirus 6A
ttttttcagtacggcggaat

SEQ ID NO: 59113 - DNA, 20 bp, Human beta herpesvirus 6A
tttcagtacggcggaatctc

SEQ ID NO: 59114 - DNA, 20 bp, Human beta herpesvirus 6A
ttcagtacggcggaatctcg

SEQ ID NO: 59115 - DNA, 20 bp, Human beta herpesvirus 6A
gctcgtgatcctacaagggc

SEQ ID NO: 59116 - DNA, 20 bp, Human beta herpesvirus 6A
tgccacgacgtgctgcaagg

SEQ ID NO: 59117 - DNA, 20 bp, Human beta herpesvirus 6A
cagcacgtcgtggcagaaca

SEQ ID NO: 59118 - DNA, 20 bp, Human beta herpesvirus 6A
gcgaggtgcagaccgctgct

SEQ ID NO: 59119 - DNA, 20 bp, Human beta herpesvirus 6A
gtccagcagcggtctgcacc

SEQ ID NO: 59120 - DNA, 20 bp, Human beta herpesvirus 6A
cgcgacgctgggcgcgtctc

SEQ ID NO: 59121 - DNA, 20 bp, Human beta herpesvirus 6A
gacgtgatcgccgcggccgc

SEQ ID NO: 59122 - DNA, 20 bp, Human beta herpesvirus 6A
tgttcgtcggcggccgcggc

SEQ ID NO: 59123 - DNA, 20 bp, Human beta herpesvirus 6A
gtcggcggccgcggcgatca

SEQ ID NO: 59124 - DNA, 20 bp, Human beta herpesvirus 6A
gttccgcacatacgctggtc

SEQ ID NO: 59125 - DNA, 20 bp, Human beta herpesvirus 6A
cgcacatacgctggtccggc

SEQ ID NO: 59126 - DNA, 20 bp, Human beta herpesvirus 6A
ggtggtcttgactttggcgg

SEQ ID NO: 59127 - DNA, 20 bp, Human beta herpesvirus 6A
actttggcgggacctctgtt

SEQ ID NO: 59128 - DNA, 20 bp, Human beta herpesvirus 6A
ggcgggacctctgttagcgt

SEQ ID NO: 59129 - DNA, 20 bp, Human beta herpesvirus 6A
gcgggacctctgttagcgtt

SEQ ID NO: 59130 - DNA, 20 bp, Human beta herpesvirus 6A
tccttccctcttccctttaa

SEQ ID NO: 59131 - DNA, 20 bp, Human beta herpesvirus 6A
ccttccctcttccctttaac

SEQ ID NO: 59132 - DNA, 20 bp, Human beta herpesvirus 6A
cttccctcttccctttaacc

SEQ ID NO: 59133 - DNA, 20 bp, Human beta herpesvirus 6A
cctcttccctttaaccccac

SEQ ID NO: 59134 - DNA, 20 bp, Human beta herpesvirus 6A
cctttaaccccacgaaaaat

SEQ ID NO: 59135 - DNA, 20 bp, Influenza B virus
atttgattataaaaccaaga

SEQ ID NO: 59136 - DNA, 20 bp, Influenza B virus
tttgattataaaaccaagag

SEQ ID NO: 59137 - DNA, 20 bp, Influenza B virus
gattataaaaccaagaggtt

SEQ ID NO: 59138 - DNA, 20 bp, Influenza B virus
attataaaaccaagaggttt

SEQ ID NO: 59139 - DNA, 20 bp, Influenza B virus
taaaaccaagaggtttatcg

SEQ ID NO: 59140 - DNA, 20 bp, Influenza B virus
agtttgaaaaacctatggca

SEQ ID NO: 59141 - DNA, 20 bp, Influenza B virus
gaaaaacctatggcaagttc

SEQ ID NO: 59142 - DNA, 20 bp, Influenza B virus
aaaaacctatggcaagttct

SEQ ID NO: 59143 - DNA, 20 bp, Influenza B virus
taataggggaagaagaaatt

SEQ ID NO: 59144 - DNA, 20 bp, Influenza B virus
aaaaaggaattgacttcaaa

SEQ ID NO: 59145 - DNA, 20 bp, Influenza B virus
acaaccatgagctaccagaa

SEQ ID NO: 59146 - DNA, 20 bp, Influenza B virus
caaccatgagctaccagaag

SEQ ID NO: 59147 - DNA, 20 bp, Influenza B virus
catataatgcctttctcctc

SEQ ID NO: 59148 - DNA, 20 bp, Influenza B virus
ctcctcatgtctgatgagtt

SEQ ID NO: 59149 - DNA, 20 bp, Influenza B virus
tcctcatgtctgatgagttg

SEQ ID NO: 59150 - DNA, 20 bp, Influenza B virus
cagaaaaccaattatgccaa

SEQ ID NO: 59151 - DNA, 20 bp, Influenza B virus
tgccaagtgggccacaggag

SEQ ID NO: 59152 - DNA, 20 bp, Influenza B virus
ggttcttcttggtacatcgt

SEQ ID NO: 59153 - DNA, 20 bp, Influenza B virus
ttcttggtacatcgtttcgt

SEQ ID NO: 59154 - DNA, 20 bp, Influenza B virus
ttggtacatcgtttcgtcat

SEQ ID NO: 59155 - DNA, 20 bp, Influenza B virus
aaaattggctccctatttgt

SEQ ID NO: 59156 - DNA, 20 bp, Influenza B virus
aaattggctccctatttgtg

SEQ ID NO: 59157 - DNA, 20 bp, Influenza B virus
gctccctatttgtgagtgga

SEQ ID NO: 59158 - DNA, 20 bp, Influenza B virus
gtgagtggaagagaaaaacc

SEQ ID NO: 59159 - DNA, 20 bp, Influenza B virus
tgagtggaagagaaaaacct

SEQ ID NO: 59160 - DNA, 20 bp, Influenza B virus
tttcaagggagacagagtga

SEQ ID NO: 59161 - DNA, 20 bp, Influenza B virus
caagggagacagagtgaata

SEQ ID NO: 59162 - DNA, 20 bp, Influenza B virus
aagggagacagagtgaataa

SEQ ID NO: 59163 - DNA, 20 bp, Influenza B virus
cagtattgggactcaggaag

SEQ ID NO: 59164 - DNA, 20 bp, Influenza B virus
agtattgggactcaggaagg

SEQ ID NO: 59165 - DNA, 20 bp, Influenza A virus
accttctagaagacaagcat

SEQ ID NO: 59166 - DNA, 20 bp, Influenza A virus
tagaagacaagcataacggg

SEQ ID NO: 59167 - DNA, 20 bp, Influenza A virus
gtttgcatagtttcccgtta

SEQ ID NO: 59168 - DNA, 20 bp, Influenza A virus
gcatagtttcccgttatgct

SEQ ID NO: 59169 - DNA, 20 bp, Influenza A virus
catagtttcccgttatgctt

SEQ ID NO: 59170 - DNA, 20 bp, Influenza A virus
tggaaacacctagttcagac

SEQ ID NO: 59171 - DNA, 20 bp, Influenza A virus
agacaatggaacgtgttacc

SEQ ID NO: 59172 - DNA, 20 bp, Influenza A virus
cccaggagatttcatcgatt

SEQ ID NO: 59173 - DNA, 20 bp, Influenza A virus
catcgattatgaggagctaa

SEQ ID NO: 59174 - DNA, 20 bp, Influenza A virus
atcgattatgaggagctaag

SEQ ID NO: 59175 - DNA, 20 bp, Influenza A virus
accatccatctactagtgct

SEQ ID NO: 59176 - DNA, 20 bp, Influenza A virus
ttgtggggtcatcaagatac

SEQ ID NO: 59177 - DNA, 20 bp, Influenza A virus
tgtggggtcatcaagataca

SEQ ID NO: 59178 - DNA, 20 bp, Influenza A virus
gtggggtcatcaagatacag

SEQ ID NO: 59179 - DNA, 20 bp, Influenza A virus
tggggtcatcaagatacagc

SEQ ID NO: 59180 - DNA, 20 bp, Influenza A virus
gcaatggaaagaaatgctgg

SEQ ID NO: 59181 - DNA, 20 bp, Influenza A virus
tcatttcagatacaccagtc

SEQ ID NO: 59182 - DNA, 20 bp, Influenza A virus
cagatacaccagtccacgat

SEQ ID NO: 59183 - DNA, 20 bp, Influenza A virus
agatacaccagtccacgatt

SEQ ID NO: 59184 - DNA, 20 bp, Influenza A virus
caatacaacttgtcaaacac

SEQ ID NO: 59185 - DNA, 20 bp, Influenza A virus
gggccattgccggtttcatt

SEQ ID NO: 59186 - DNA, 20 bp, Influenza A virus
ccggtttcattgaagggggg

SEQ ID NO: 59187 - DNA, 20 bp, Influenza A virus
cattgaaggggggtggacag

SEQ ID NO: 59188 - DNA, 20 bp, Influenza A virus
attgaaggggggtggacagg

SEQ ID NO: 59189 - DNA, 20 bp, Influenza A virus
aaggggggtggacagggatg

SEQ ID NO: 59190 - DNA, 20 bp, Human herpesvirus 6B
gttaacgggatcgtcccctt

SEQ ID NO: 59191 - DNA, 20 bp, Human herpesvirus 6B
acgggatcgtccccttggct

SEQ ID NO: 59192 - DNA, 20 bp, Human herpesvirus 6B
gctcgtgctcctacaagcgc

SEQ ID NO: 59193 - DNA, 20 bp, Human herpesvirus 6B
gaacacgtcgtggcagaaca

SEQ ID NO: 59194 - DNA, 20 bp, Human herpesvirus 6B
taggagcacgagccaagggg

SEQ ID NO: 59195 - DNA, 20 bp, Human herpesvirus 6B
cctcgagtgacgccggagac

SEQ ID NO: 59196 - DNA, 20 bp, Human herpesvirus 6B
ctcgagtgacgccggagaca

SEQ ID NO: 59197 - DNA, 20 bp, Human herpesvirus 6B
acctgaacgacacctccctg

SEQ ID NO: 59198 - DNA, 20 bp, Human herpesvirus 6B
gagctgctgctgcgcctggg

SEQ ID NO: 59199 - DNA, 20 bp, Human herpesvirus 6B
aggtcaagcgccaggacggg

SEQ ID NO: 59200 - DNA, 20 bp, Human herpesvirus 6B
ccgccgacgcgcctgcgcga

SEQ ID NO: 59201 - DNA, 20 bp, Human herpesvirus 6B
gagtgggggtgagagggacg

SEQ ID NO: 59202 - DNA, 20 bp, Human herpesvirus 6B
gcttgcggtggtgtgttttt

SEQ ID NO: 59203 - DNA, 20 bp, Human herpesvirus 6B
cttgcggtggtgtgtttttt

SEQ ID NO: 59204 - DNA, 20 bp, Human herpesvirus 6B
cggtggtgtgtttttttttt

SEQ ID NO: 59205 - DNA, 20 bp, Human herpesvirus 6B
gcaaggcgagggctgcagcg

SEQ ID NO: 59206 - DNA, 20 bp, Human herpesvirus 6B
caaggcgagggctgcagcgg

SEQ ID NO: 59207 - DNA, 20 bp, Human herpesvirus 6B
gttccgcacatacgccggtc

SEQ ID NO: 59208 - DNA, 20 bp, Human herpesvirus 6B
cgcacatacgccggtccggc

SEQ ID NO: 59209 - DNA, 20 bp, Human herpesvirus 6B
ctcatacgccacggggtccc

SEQ ID NO: 59210 - DNA, 20 bp, Human herpesvirus 6B
tgggaaacgtgcccacgccg

SEQ ID NO: 59211 - DNA, 20 bp, Human herpesvirus 6B
cccagaatcacgcctccgct

SEQ ID NO: 59212 - DNA, 20 bp, Human herpesvirus 6B
ccagaatcacgcctccgctg

SEQ ID NO: 59213 - DNA, 20 bp, Human herpesvirus 6B
tccgccctcctgggtacggc

SEQ ID NO: 59214 - DNA, 20 bp, Human herpesvirus 6B
gccgcgcggagctttctttg

SEQ ID NO: 59215 - DNA, 20 bp, Human herpesvirus 6B
ctttgagtttgccgtaccca

SEQ ID NO: 59216 - DNA, 20 bp, Human herpesvirus 6B
tttgagtttgccgtacccag

SEQ ID NO: 59217 - DNA, 20 bp, Human herpesvirus 6B
gagtttgccgtacccaggag

SEQ ID NO: 59218 - DNA, 20 bp, Human herpesvirus 6B
ccatgagacacttggaaccg

SEQ ID NO: 59219 - DNA, 20 bp, Human herpesvirus 6B
catgagacacttggaaccgt

SEQ ID NO: 59220 - DNA, 20 bp, Human herpesvirus 6B
gaaccgtagacgggctcgaa

SEQ ID NO: 59221 - DNA, 20 bp, Human herpesvirus 6B
cagagaccgaacgcgtcctc

SEQ ID NO: 59222 - DNA, 20 bp, Human herpesvirus 6B
ggtctctggaagcacggctt

SEQ ID NO: 59223 - DNA, 20 bp, Human herpesvirus 6B
gccaactcggcctgcgtgat

SEQ ID NO: 59224 - DNA, 20 bp, Human herpesvirus 6B
gccacctccgacatgctcgg

SEQ ID NO: 59225 - DNA, 20 bp, Human herpesvirus 6B
gccaagctgtctcgcggata

SEQ ID NO: 59226 - DNA, 20 bp, Human herpesvirus 6B
aattttccagcgattcgaat

SEQ ID NO: 59227 - DNA, 20 bp, Human herpesvirus 6B
tccagcgattcgaatctggg

SEQ ID NO: 59228 - DNA, 20 bp, Human herpesvirus 6B
ccagcgattcgaatctgggg

SEQ ID NO: 59229 - DNA, 20 bp, Human herpesvirus 6B
cagcgattcgaatctggggc

SEQ ID NO: 59230 - DNA, 20 bp, Human herpesvirus 6B
gaatctggggccgtcataca

SEQ ID NO: 59231 - DNA, 20 bp, Human herpesvirus 6B
tttatgacagtgaacagaga

SEQ ID NO: 59232 - DNA, 20 bp, Human herpesvirus 6B
ttatgacagtgaacagagag

SEQ ID NO: 59233 - DNA, 20 bp, Human herpesvirus 6B
tatgacagtgaacagagagc

SEQ ID NO: 59234 - DNA, 20 bp, Human herpesvirus 6B
atgacagtgaacagagagca

SEQ ID NO: 59235 - DNA, 20 bp, Human herpesvirus 6B
tgacagtgaacagagagcag

SEQ ID NO: 59236 - DNA, 20 bp, Human herpesvirus 6B
ccaaaagactatgtagtaca

SEQ ID NO: 59237 - DNA, 20 bp, Human herpesvirus 6B
tcatccactgacgattctga

SEQ ID NO: 59238 - DNA, 20 bp, Human herpesvirus 6B
catccactgacgattctgat

SEQ ID NO: 59239 - DNA, 20 bp, Human herpesvirus 6B
atccactgacgattctgatg

SEQ ID NO: 59240 - DNA, 20 bp, Human herpesvirus 6B
tgatggcgagttctgatcat

SEQ ID NO: 59241 - DNA, 20 bp, Human herpesvirus 6B
catagagcatggcgcacgct

SEQ ID NO: 59242 - DNA, 20 bp, Human herpesvirus 6B
taacttcgacggacgatccc

SEQ ID NO: 59243 - DNA, 20 bp, Human herpesvirus 6B
aacttcgacggacgatccca

SEQ ID NO: 59244 - DNA, 20 bp, Human herpesvirus 6B
acttcgacggacgatcccat

SEQ ID NO: 59245 - DNA, 20 bp, Human herpesvirus 6B
gacggacgatcccatattgt

SEQ ID NO: 59246 - DNA, 20 bp, Human herpesvirus 6B
tctcgatataccggatcata

SEQ ID NO: 59247 - DNA, 20 bp, Human herpesvirus 6B
ctcgatataccggatcataa

SEQ ID NO: 59248 - DNA, 20 bp, Human herpesvirus 6B
tcgatataccggatcataac

SEQ ID NO: 59249 - DNA, 20 bp, Human herpesvirus 6B
cgtcgtttccgccaacaaat

SEQ ID NO: 59250 - DNA, 20 bp, Human herpesvirus 6B
ccgccaacaaatacagtgtc

SEQ ID NO: 59251 - DNA, 20 bp, Human herpesvirus 6B
ccccaggcagaaacatatcc

SEQ ID NO: 59252 - DNA, 20 bp, Human herpesvirus 6B
cccaggcagaaacatatcca

SEQ ID NO: 59253 - DNA, 20 bp, Human herpesvirus 6B
caatctctctgggcagcaaa

SEQ ID NO: 59254 - DNA, 20 bp, Human herpesvirus 6B
tttaaaaggaaaaataactt

SEQ ID NO: 59255 - DNA, 20 bp, Human herpesvirus 6B
aaaaggaaaaataactttat

SEQ ID NO: 59256 - DNA, 20 bp, Human herpesvirus 6B
gttgtgaagactccattgaa

SEQ ID NO: 59257 - DNA, 20 bp, Human herpesvirus 6B
tgaagactccattgaatgtt

SEQ ID NO: 59258 - DNA, 20 bp, Human herpesvirus 6B
aatgttcgttccaatgggcc

SEQ ID NO: 59259 - DNA, 20 bp, Human herpesvirus 6B
gttccaatgggccgatatcg

SEQ ID NO: 59260 - DNA, 20 bp, Human herpesvirus 6B
caatgggccgatatcgtcga

SEQ ID NO: 59261 - DNA, 20 bp, Human herpesvirus 6B
tcgtaagcattctactaaac

SEQ ID NO: 59262 - DNA, 20 bp, Human herpesvirus 6B
tactaaacgcgtataccgac

SEQ ID NO: 59263 - DNA, 20 bp, Human herpesvirus 6B
aaaaatacgtaaacccctgg

SEQ ID NO: 59264 - DNA, 20 bp, Human herpesvirus 6B
gccgttatggtctgtttgat

SEQ ID NO: 59265 - DNA, 20 bp, Human herpesvirus 6B
ccgttatggtctgtttgatc

SEQ ID NO: 59266 - DNA, 20 bp, Human herpesvirus 6B
ttagccactgcacccactaa

SEQ ID NO: 59267 - DNA, 20 bp, Human herpesvirus 6B
gccactgcacccactaaaca

SEQ ID NO: 59268 - DNA, 20 bp, Human herpesvirus 6B
caaacttgcaagcctgagct

SEQ ID NO: 59269 - DNA, 20 bp, Human herpesvirus 6B
caagcctgagctcgataaag

SEQ ID NO: 59270 - DNA, 20 bp, Human herpesvirus 6B
tagtgctttatcgagctcag

SEQ ID NO: 59271 - DNA, 20 bp, Human herpesvirus 6B
gatttaaccttaggcgtacc

SEQ ID NO: 59272 - DNA, 20 bp, Human herpesvirus 6B
aaccttaggcgtaccttggt

SEQ ID NO: 59273 - DNA, 20 bp, Human herpesvirus 6B
accttaggcgtaccttggtt

SEQ ID NO: 59274 - DNA, 20 bp, Human herpesvirus 6B
ggcgtaccttggtttttatg

SEQ ID NO: 59275 - DNA, 20 bp, Human herpesvirus 6B
gtttttatgtgaacgatgag

SEQ ID NO: 59276 - DNA, 20 bp, Human herpesvirus 6B
caggaaacgttgtcgtattg

SEQ ID NO: 59277 - DNA, 20 bp, Human herpesvirus 6B
tcgtattgcatctgtcggac

SEQ ID NO: 59278 - DNA, 20 bp, Human herpesvirus 6B
catctgtcggacttccacaa

SEQ ID NO: 59279 - DNA, 20 bp, Human herpesvirus 6B
cacaaccctgatgtaataaa

SEQ ID NO: 59280 - DNA, 20 bp, Human herpesvirus 6B
cgtgtgaagggtacaggttt

SEQ ID NO: 59281 - DNA, 20 bp, Human herpesvirus 6B
aaagtcagtcctcactaaga

SEQ ID NO: 59282 - DNA, 20 bp, Human herpesvirus 6B
gggagaaaatagatcaaggg

SEQ ID NO: 59283 - DNA, 20 bp, Human herpesvirus 6B
ttagcaacttgtcgcgatgc

SEQ ID NO: 59284 - DNA, 20 bp, Human herpesvirus 6B
gcaacttgtcgcgatgccct

SEQ ID NO: 59285 - DNA, 20 bp, Human herpesvirus 6B
tcgcgatgcccttgatctat

SEQ ID NO: 59286 - DNA, 20 bp, Human herpesvirus 6B
tgtatcttgcttcccatgtc

SEQ ID NO: 59287 - DNA, 20 bp, Human herpesvirus 6B
gtatcttgcttcccatgtct

SEQ ID NO: 59288 - DNA, 20 bp, Human herpesvirus 6B
tatcttgcttcccatgtctg

SEQ ID NO: 59289 - DNA, 20 bp, Human herpesvirus 6B
cttcccatgtctgatttaat

SEQ ID NO: 59290 - DNA, 20 bp, Human herpesvirus 6B
ccatgtctgatttaattcgc

SEQ ID NO: 59291 - DNA, 20 bp, Human herpesvirus 6B
acgataaagacagggctaaa

SEQ ID NO: 59292 - DNA, 20 bp, Human herpesvirus 6B
ccttgtgtcgtctgttgtta

SEQ ID NO: 59293 - DNA, 20 bp, Human herpesvirus 6B
tgtcgtctgttgttaggacc

SEQ ID NO: 59294 - DNA, 20 bp, Human herpesvirus 6B
ttaggaccggttgcggtgcc

SEQ ID NO: 59295 - DNA, 20 bp, Human herpesvirus 6B
ggaccggttgcggtgccatg

SEQ ID NO: 59296 - DNA, 20 bp, Human herpesvirus 6B
ccgcgttcgtttagcatatg

SEQ ID NO: 59297 - DNA, 20 bp, Human herpesvirus 6B
gtttagcatatgggcgtgat

SEQ ID NO: 59298 - DNA, 20 bp, Human herpesvirus 6B
agcatatgggcgtgatcttc

SEQ ID NO: 59299 - DNA, 20 bp, Human herpesvirus 6B
gcatatgggcgtgatcttcg

SEQ ID NO: 59300 - DNA, 20 bp, Human herpesvirus 6B
gcatacgtaagaaactacgg

SEQ ID NO: 59301 - DNA, 20 bp, Human herpesvirus 6B
tgcagggtgctttgcttcag

SEQ ID NO: 59302 - DNA, 20 bp, Human herpesvirus 6B
gcttcagtggaagattctct

SEQ ID NO: 59303 - DNA, 20 bp, Human herpesvirus 6B
cttcagtggaagattctcta

SEQ ID NO: 59304 - DNA, 20 bp, Human herpesvirus 6B
agtggaagattctctaatgc

SEQ ID NO: 59305 - DNA, 20 bp, Human herpesvirus 6B
tctaatgcgaacactagtcc

SEQ ID NO: 59306 - DNA, 20 bp, Human herpesvirus 6B
gaatcccaactctttttcgc

SEQ ID NO: 59307 - DNA, 20 bp, Human herpesvirus 6B
ttcgcagatggtcttgtatt

SEQ ID NO: 59308 - DNA, 20 bp, Human herpesvirus 6B
tcgcagatggtcttgtattc

SEQ ID NO: 59309 - DNA, 20 bp, Human herpesvirus 6B
cgcagatggtcttgtattcc

SEQ ID NO: 59310 - DNA, 20 bp, Human herpesvirus 6B
gcagatggtcttgtattcca

SEQ ID NO: 59311 - DNA, 20 bp, Human herpesvirus 6B
agcgctcgcgataaagagag

SEQ ID NO: 59312 - DNA, 20 bp, Human herpesvirus 6B
tcgaggtcatggtccagatc

SEQ ID NO: 59313 - DNA, 20 bp, Human herpesvirus 6B
tagcgatcacaatcgttatt

SEQ ID NO: 59314 - DNA, 20 bp, Human herpesvirus 6B
tgatcgctataacccggatc

SEQ ID NO: 59315 - DNA, 20 bp, Human herpesvirus 6B
atcgcgagcgctgaacatag

SEQ ID NO: 59316 - DNA, 20 bp, Human herpesvirus 6B
ataatttgttttttgaacag

SEQ ID NO: 59317 - DNA, 20 bp, Human herpesvirus 6B
gttttttgaacaggtctcga

SEQ ID NO: 59318 - DNA, 20 bp, Human herpesvirus 6B
ttttttgaacaggtctcgaa

SEQ ID NO: 59319 - DNA, 20 bp, Human herpesvirus 6B
tttgaacaggtctcgaacgt

SEQ ID NO: 59320 - DNA, 20 bp, Human herpesvirus 6B
ttgaacaggtctcgaacgtc

SEQ ID NO: 59321 - DNA, 20 bp, Human herpesvirus 6B
atgcgtattctcactcaatg

SEQ ID NO: 59322 - DNA, 20 bp, Human herpesvirus 6B
tcactcaatggttgtctatg

SEQ ID NO: 59323 - DNA, 20 bp, Human herpesvirus 6B
tctatgtgtgacgtccgcat

SEQ ID NO: 59324 - DNA, 20 bp, Human herpesvirus 6B
tccggactataccatgatgc

SEQ ID NO: 59325 - DNA, 20 bp, Human herpesvirus 6B
agtgagaatacgcatcaaga

SEQ ID NO: 59326 - DNA, 20 bp, Human herpesvirus 6B
cacgcggcagatccgtctct

SEQ ID NO: 59327 - DNA, 20 bp, Human herpesvirus 6B
gttaacgggatcgtcccctt

SEQ ID NO: 59328 - DNA, 20 bp, Human herpesvirus 6B
acgggatcgtccccttggct

SEQ ID NO: 59329 - DNA, 20 bp, Human herpesvirus 6B
gctcgtgctcctacaagcgc

SEQ ID NO: 59330 - DNA, 20 bp, Human herpesvirus 6B
taggagcacgagccaagggg

SEQ ID NO: 59331 - DNA, 20 bp, Human herpesvirus 6B
gagtgggagagaacagagct

SEQ ID NO: 59332 - DNA, 20 bp, Human herpesvirus 6B
gttttccgtgtcacggcgcg

SEQ ID NO: 59333 - DNA, 20 bp, Human herpesvirus 6B
tccgtgtcacggcgcgcgca

SEQ ID NO: 59334 - DNA, 20 bp, Human herpesvirus 6B
ccgtgtcacggcgcgcgcat

SEQ ID NO: 59335 - DNA, 20 bp, Human herpesvirus 6B
cgtgtcacggcgcgcgcata

SEQ ID NO: 59336 - DNA, 20 bp, Human herpesvirus 6B
gcccgtttacatcggggtcc

SEQ ID NO: 59337 - DNA, 20 bp, Human herpesvirus 6B
acatcggggtccgcagacgc

SEQ ID NO: 59338 - DNA, 20 bp, Human herpesvirus 6B
catcggggtccgcagacgcg

SEQ ID NO: 59339 - DNA, 20 bp, Human herpesvirus 6B
tgccagggcgttgcgctgtc

SEQ ID NO: 59340 - DNA, 20 bp, Human herpesvirus 6B
cgctgtcggttccgcacaaa

SEQ ID NO: 59341 - DNA, 20 bp, Human herpesvirus 6B
gcaaggcgagggctgcagcg

SEQ ID NO: 59342 - DNA, 20 bp, Human herpesvirus 6B
caaggcgagggctgcagcgg

SEQ ID NO: 59343 - DNA, 20 bp, Human herpesvirus 6B
ctcatacgccacggggtccc

SEQ ID NO: 59344 - DNA, 20 bp, Human herpesvirus 6B
caaactccgttacgttcgac

SEQ ID NO: 59345 - DNA, 20 bp, Human herpesvirus 6B
cgttcgacgccagacggcag

SEQ ID NO: 59346 - DNA, 20 bp, Influenza A virus
aactgtataggaagctcaag

SEQ ID NO: 59347 - DNA, 20 bp, Influenza A virus
catggggccaaagaaatctc

SEQ ID NO: 59348 - DNA, 20 bp, Influenza A virus
ctttggccccatggaatgtt

SEQ ID NO: 59349 - DNA, 20 bp, Influenza A virus
tttggccccatggaatgtta

SEQ ID NO: 59350 - DNA, 20 bp, Influenza A virus
ggccccatggaatgttatct

SEQ ID NO: 59351 - DNA, 20 bp, Influenza A virus
ggatcttgcacttgatattg

SEQ ID NO: 59352 - DNA, 20 bp, Influenza A virus
cacttgatattgtggattct

SEQ ID NO: 59353 - DNA, 20 bp, Influenza A virus
atattgtggattcttgatcg

SEQ ID NO: 59354 - DNA, 20 bp, Influenza A virus
tggattcttgatcgtctttt

SEQ ID NO: 59355 - DNA, 20 bp, Influenza A virus
ttgatcgtctttttttcaaa

SEQ ID NO: 59356 - DNA, 20 bp, Influenza A virus
gcagacaatggattgggtga

SEQ ID NO: 59357 - DNA, 20 bp, Influenza A virus
cagacaatggattgggtgat

SEQ ID NO: 59358 - DNA, 20 bp, Influenza A virus
ggtgatgccccattccttga

SEQ ID NO: 59359 - DNA, 20 bp, Influenza A virus
cttgatcggctccgccgaga

SEQ ID NO: 59360 - DNA, 20 bp, Influenza A virus
atcggctccgccgagatcaa

SEQ ID NO: 59361 - DNA, 20 bp, Influenza A virus
atgctcatgcctaggcaaaa

SEQ ID NO: 59362 - DNA, 20 bp, Influenza A virus
gcgtgcgattggaccaggcg

SEQ ID NO: 59363 - DNA, 20 bp, Influenza A virus
cgtgcgattggaccaggcga

SEQ ID NO: 59364 - DNA, 20 bp, Influenza A virus
gaccaggcgatcatggaaaa

SEQ ID NO: 59365 - DNA, 20 bp, Influenza A virus
agtgtaatctttaaccgatt

SEQ ID NO: 59366 - DNA, 20 bp, Influenza A virus
gagtctctgaaaatatacag

SEQ ID NO: 59367 - DNA, 20 bp, Influenza A virus
gcttggagaaactgtgatga

SEQ ID NO: 59368 - DNA, 20 bp, Influenza A virus
gagaaactgtgatgagaatg

SEQ ID NO: 59369 - DNA, 20 bp, Influenza A virus
actacctccagagcagaaat

SEQ ID NO: 59370 - DNA, 20 bp, Influenza A virus
tcatttctgctctggaggta

SEQ ID NO: 59371 - DNA, 20 bp, Human papillomavirus type 7
cggctccacagctagaactt

SEQ ID NO: 59372 - DNA, 20 bp, Human papillomavirus type 7
aaataaagttctagctgtgg

SEQ ID NO: 59373 - DNA, 20 bp, Human papillomavirus type 7
tagctgtggagccgcaacgt

SEQ ID NO: 59374 - DNA, 20 bp, Human papillomavirus type 7
tttgggttggtttttatatg

SEQ ID NO: 59375 - DNA, 20 bp, Human papillomavirus type 7
ttgggttggtttttatatgt

SEQ ID NO: 59376 - DNA, 20 bp, Human papillomavirus type 7
agatacgctgcatatgcacc

SEQ ID NO: 59377 - DNA, 20 bp, Human papillomavirus type 7
gatacgctgcatatgcacca

SEQ ID NO: 59378 - DNA, 20 bp, Human papillomavirus type 7
acaattttagaagtgagaat

SEQ ID NO: 59379 - DNA, 20 bp, Human papillomavirus type 7
tagaagtgagaataagatgc

SEQ ID NO: 59380 - DNA, 20 bp, Human papillomavirus type 7
agaagtgagaataagatgct

SEQ ID NO: 59381 - DNA, 20 bp, Human papillomavirus type 7
caagtaaatttgcaatcatt

SEQ ID NO: 59382 - DNA, 20 bp, Human papillomavirus type 7
gcaatcatttaaaatagtaa

SEQ ID NO: 59383 - DNA, 20 bp, Human papillomavirus type 7
caatcatttaaaatagtaac

SEQ ID NO: 59384 - DNA, 20 bp, Human papillomavirus type 7
ctattttaaatgattgcaaa

SEQ ID NO: 59385 - DNA, 20 bp, Human papillomavirus type 7
taaatgattgcaaatttact

SEQ ID NO: 59386 - DNA, 20 bp, Human papillomavirus type 7
aggtacagaggatgtggggt

SEQ ID NO: 59387 - DNA, 20 bp, Human papillomavirus type 7
aggatggtttttagttgagg

SEQ ID NO: 59388 - DNA, 20 bp, Human papillomavirus type 7
ttagttgaggctgtggtaga

SEQ ID NO: 59389 - DNA, 20 bp, Human papillomavirus type 7
tagttgaggctgtggtagat

SEQ ID NO: 59390 - DNA, 20 bp, Human papillomavirus type 7
agttgaggctgtggtagata

SEQ ID NO: 59391 - DNA, 20 bp, Human papillomavirus type 7
aagtgctagaagaaagcagt

SEQ ID NO: 59392 - DNA, 20 bp, Human papillomavirus type 7
tacagcaacttagtccgcgt

SEQ ID NO: 59393 - DNA, 20 bp, Human papillomavirus type 7
gtccgcgtacacaggtggta

SEQ ID NO: 59394 - DNA, 20 bp, Human papillomavirus type 7
aaatgcaaggatttaaatgc

SEQ ID NO: 59395 - DNA, 20 bp, Human papillomavirus type 7
aatgcaaggatttaaatgct

SEQ ID NO: 59396 - DNA, 20 bp, Human papillomavirus type 7
cttgcattgtgtagatataa

SEQ ID NO: 59397 - DNA, 20 bp, Human papillomavirus type 7
cattgtgtagatataaggta

SEQ ID NO: 59398 - DNA, 20 bp, Human papillomavirus type 7
tgtagatataaggtagcaaa

SEQ ID NO: 59399 - DNA, 20 bp, Human papillomavirus type 7
ccaaaatgttaaatgtacca

SEQ ID NO: 59400 - DNA, 20 bp, Human papillomavirus type 7
aatgtaccagataatcaact

SEQ ID NO: 59401 - DNA, 20 bp, Human papillomavirus type 7
agtttaactcagatggtgca

SEQ ID NO: 59402 - DNA, 20 bp, Human papillomavirus type 7
gtttaactcagatggtgcag

SEQ ID NO: 59403 - DNA, 20 bp, Human papillomavirus type 7
aactcagatggtgcagtggg

SEQ ID NO: 59404 - DNA, 20 bp, Human papillomavirus type 7
actcagatggtgcagtgggc

SEQ ID NO: 59405 - DNA, 20 bp, Human papillomavirus type 7
ttatgcacaaatagcagata

SEQ ID NO: 59406 - DNA, 20 bp, Human papillomavirus type 7
gtgccaggaacagttgttag

SEQ ID NO: 59407 - DNA, 20 bp, Human papillomavirus type 7
tgccaggaacagttgttaga

SEQ ID NO: 59408 - DNA, 20 bp, Human papillomavirus type 7
ttagaactttatgaacaaga

SEQ ID NO: 59409 - DNA, 20 bp, Human papillomavirus type 7
gaactttatgaacaagacag

SEQ ID NO: 59410 - DNA, 20 bp, Human papillomavirus type 7
atgaacaagacagcaaacag

SEQ ID NO: 59411 - DNA, 20 bp, Human papillomavirus type 7
gcaaactactgaatataact

SEQ ID NO: 59412 - DNA, 20 bp, Human papillomavirus type 7
caaactactgaatataactt

SEQ ID NO: 59413 - DNA, 20 bp, Human papillomavirus type 7
gagccatggacgttacagga

SEQ ID NO: 59414 - DNA, 20 bp, Human papillomavirus type 7
caggacacaagtcaagaact

SEQ ID NO: 59415 - DNA, 20 bp, Human papillomavirus type 7
cagaaccaaagaaatgtttt

SEQ ID NO: 59416 - DNA, 20 bp, Human papillomavirus type 7
aaagcaacaacaaaatcagg

SEQ ID NO: 59417 - DNA, 20 bp, Human papillomavirus type 7
ctgattttgttgttgctttc

SEQ ID NO: 59418 - DNA, 20 bp, Human papillomavirus type 7
tgttgttgctttcaatatca

SEQ ID NO: 59419 - DNA, 20 bp, Human papillomavirus type 7
gttgttgctttcaatatcag

SEQ ID NO: 59420 - DNA, 20 bp, Human papillomavirus type 7
ttgttgctttcaatatcagg

SEQ ID NO: 59421 - DNA, 20 bp, Human papillomavirus type 7
tagatatatcttctactaat

SEQ ID NO: 59422 - DNA, 20 bp, Human papillomavirus type 7
agatatatcttctactaata

SEQ ID NO: 59423 - DNA, 20 bp, Human papillomavirus type 7
gatatatcttctactaatac

SEQ ID NO: 59424 - DNA, 20 bp, Human papillomavirus type 7
tactaatacagtacatgtta

SEQ ID NO: 59425 - DNA, 20 bp, Human papillomavirus type 7
catctaccacacaccataac

SEQ ID NO: 59426 - DNA, 20 bp, Human papillomavirus type 7
ccttctgttcctgcaggtac

SEQ ID NO: 59427 - DNA, 20 bp, Human papillomavirus type 7
cttctgttcctgcaggtaca

SEQ ID NO: 59428 - DNA, 20 bp, Human papillomavirus type 7
tgttcctgcaggtacaccat

SEQ ID NO: 59429 - DNA, 20 bp, Human papillomavirus type 7
ctgcaggtacaccatatttg

SEQ ID NO: 59430 - DNA, 20 bp, Human papillomavirus type 7
gcctgtgtcaccttctatac

SEQ ID NO: 59431 - DNA, 20 bp, Human papillomavirus type 7
agagtacgcttgcccgaccc

SEQ ID NO: 59432 - DNA, 20 bp, Human papillomavirus type 7
gagtacgcttgcccgaccct

SEQ ID NO: 59433 - DNA, 20 bp, Human papillomavirus type 7
cccgaccctaataaatttgg

SEQ ID NO: 59434 - DNA, 20 bp, Human papillomavirus type 7
attagggtcgggcaagcgta

SEQ ID NO: 59435 - DNA, 20 bp, Human papillomavirus type 7
ttagggtcgggcaagcgtac

SEQ ID NO: 59436 - DNA, 20 bp, Human papillomavirus type 7
tgtattgtaggctgtactcc

SEQ ID NO: 59437 - DNA, 20 bp, Human papillomavirus type 7
taggctgtactcctcctatt

SEQ ID NO: 59438 - DNA, 20 bp, Human papillomavirus type 7
gagaatattggggtatgggt

SEQ ID NO: 59439 - DNA, 20 bp, Human papillomavirus type 7
gggtatgggtacaccgtgca

SEQ ID NO: 59440 - DNA, 20 bp, Human papillomavirus type 7
taaagtgtctcctggtgact

SEQ ID NO: 59441 - DNA, 20 bp, Human papillomavirus type 7
ctcttctgggtcagtcaccc

SEQ ID NO: 59442 - DNA, 20 bp, Human papillomavirus type 7
tgggtcagtcacccccaaac

SEQ ID NO: 59443 - DNA, 20 bp, Human papillomavirus type 7
tgtatgtgtgtgtgtgtgat

SEQ ID NO: 59444 - DNA, 20 bp, Human papillomavirus type 7
cactcccttatgtgttgtta

SEQ ID NO: 59445 - DNA, 20 bp, Human papillomavirus type 7
tgttttcttacgtttggggg

SEQ ID NO: 59446 - DNA, 20 bp, Human papillomavirus type 7
gggtgaggttgccacacctt

SEQ ID NO: 59447 - DNA, 20 bp, Human papillomavirus type 7
ccacacctttaattacactt

SEQ ID NO: 59448 - DNA, 20 bp, Human papillomavirus type 7
aattacacttttattgcact

SEQ ID NO: 59449 - DNA, 20 bp, Human papillomavirus type 7
attacacttttattgcactg

SEQ ID NO: 59450 - DNA, 20 bp, Human papillomavirus type 7
cacttttattgcactgttac

SEQ ID NO: 59451 - DNA, 20 bp, Human papillomavirus type 53
tttgaaaatacagaagagcg

SEQ ID NO: 59452 - DNA, 20 bp, Human papillomavirus type 53
gaaaatacagaagagcgacc

SEQ ID NO: 59453 - DNA, 20 bp, Human papillomavirus type 53
aaaatacagaagagcgacca

SEQ ID NO: 59454 - DNA, 20 bp, Human papillomavirus type 53
caccagctatgtgaagttgt

SEQ ID NO: 59455 - DNA, 20 bp, Human papillomavirus type 53
tgaataaaccattgctggag

SEQ ID NO: 59456 - DNA, 20 bp, Human papillomavirus type 53
agatattacaattgttcagt

SEQ ID NO: 59457 - DNA, 20 bp, Human papillomavirus type 53
caattgttcagtgtacgggg

SEQ ID NO: 59458 - DNA, 20 bp, Human papillomavirus type 53
ttcagtgtacggggctagcc

SEQ ID NO: 59459 - DNA, 20 bp, Human papillomavirus type 53
agtgtacggggctagcctgg

SEQ ID NO: 59460 - DNA, 20 bp, Human papillomavirus type 53
tctgatttatcaataaggtg

SEQ ID NO: 59461 - DNA, 20 bp, Human papillomavirus type 53
cacaatatattatagaactt

SEQ ID NO: 59462 - DNA, 20 bp, Human papillomavirus type 53
tagaacttataccacaaact

SEQ ID NO: 59463 - DNA, 20 bp, Human papillomavirus type 53
taccacaaactgagattgac

SEQ ID NO: 59464 - DNA, 20 bp, Human papillomavirus type 53
acctgcaatgccatgagcaa

SEQ ID NO: 59465 - DNA, 20 bp, Human papillomavirus type 53
aacagctcagaggatgagga

SEQ ID NO: 59466 - DNA, 20 bp, Human papillomavirus type 53
catgccaaaacacacatgca

SEQ ID NO: 59467 - DNA, 20 bp, Human papillomavirus type 53
aaacgaaagtatttaggcag

SEQ ID NO: 59468 - DNA, 20 bp, Human papillomavirus type 53
aggcagtccattaggtgata

SEQ ID NO: 59469 - DNA, 20 bp, Human papillomavirus type 53
ggcagtccattaggtgatat

SEQ ID NO: 59470 - DNA, 20 bp, Human papillomavirus type 53
ggtgatattagtaatcagca

SEQ ID NO: 59471 - DNA, 20 bp, Human papillomavirus type 53
ctacattttaatatatcttg

SEQ ID NO: 59472 - DNA, 20 bp, Human papillomavirus type 53
taatatatcttgtatttgtt

SEQ ID NO: 59473 - DNA, 20 bp, Human papillomavirus type 53
aatatatcttgtatttgttg

SEQ ID NO: 59474 - DNA, 20 bp, Human papillomavirus type 53
atatatcttgtatttgttgc

SEQ ID NO: 59475 - DNA, 20 bp, Human papillomavirus type 53
tatttgttgcagtggcatta

SEQ ID NO: 59476 - DNA, 20 bp, Human papillomavirus type 53
caacatagctttgaggactg

SEQ ID NO: 59477 - DNA, 20 bp, Human papillomavirus type 53
gaggactgtcaatttgaact

SEQ ID NO: 59478 - DNA, 20 bp, Human papillomavirus type 53
aggactgtcaatttgaacta

SEQ ID NO: 59479 - DNA, 20 bp, Human papillomavirus type 53
gaactatctaaaatggtgca

SEQ ID NO: 59480 - DNA, 20 bp, Human papillomavirus type 53
aactatctaaaatggtgcag

SEQ ID NO: 59481 - DNA, 20 bp, Human papillomavirus type 53
ctaaggtatcaaggggtcga

SEQ ID NO: 59482 - DNA, 20 bp, Human papillomavirus type 53
atttcatttttaagttattt

SEQ ID NO: 59483 - DNA, 20 bp, Human papillomavirus type 53
tttcatttttaagttatttt

SEQ ID NO: 59484 - DNA, 20 bp, Human papillomavirus type 53
catttttaagttattttaaa

SEQ ID NO: 59485 - DNA, 20 bp, Human papillomavirus type 53
atttttaagttattttaaat

SEQ ID NO: 59486 - DNA, 20 bp, Human papillomavirus type 53
aataatgcaaactggaaatg

SEQ ID NO: 59487 - DNA, 20 bp, Human papillomavirus type 53
ttttgaaaggacatggtcca

SEQ ID NO: 59488 - DNA, 20 bp, Human papillomavirus type 53
tttgaaaggacatggtccag

SEQ ID NO: 59489 - DNA, 20 bp, Human papillomavirus type 53
ttgaaaggacatggtccaga

SEQ ID NO: 59490 - DNA, 20 bp, Human papillomavirus type 53
tgaaaggacatggtccagat

SEQ ID NO: 59491 - DNA, 20 bp, Human papillomavirus type 53
tgcagtaagctatgagggca

SEQ ID NO: 59492 - DNA, 20 bp, Human papillomavirus type 53
tatacatgacggccataaaa

SEQ ID NO: 59493 - DNA, 20 bp, Human papillomavirus type 53
tacaaactttaaagacgagg

SEQ ID NO: 59494 - DNA, 20 bp, Human papillomavirus type 53
aaagacgaggccaccaaata

SEQ ID NO: 59495 - DNA, 20 bp, Human papillomavirus type 53
aagacgaggccaccaaatat

SEQ ID NO: 59496 - DNA, 20 bp, Human papillomavirus type 53
tgggacgttttcccggccgc

SEQ ID NO: 59497 - DNA, 20 bp, Human papillomavirus type 53
tcccggccgcagggatgatg

SEQ ID NO: 59498 - DNA, 20 bp, Human papillomavirus type 53
cccggccgcagggatgatga

SEQ ID NO: 59499 - DNA, 20 bp, Human papillomavirus type 53
ccggccgcagggatgatgag

SEQ ID NO: 59500 - DNA, 20 bp, Human papillomavirus type 53
gttactgtatcatccaccta

SEQ ID NO: 59501 - DNA, 20 bp, Human papillomavirus type 53
ttactgtatcatccacctat

SEQ ID NO: 59502 - DNA, 20 bp, Human papillomavirus type 53
ctgtatcatccacctatcat

SEQ ID NO: 59503 - DNA, 20 bp, Human papillomavirus type 53
gacaaatgtaaactgtgctg

SEQ ID NO: 59504 - DNA, 20 bp, Human papillomavirus type 53
tattactgttgtatataaag

SEQ ID NO: 59505 - DNA, 20 bp, Human papillomavirus type 53
caaccattgtgttgtgtgtt

SEQ ID NO: 59506 - DNA, 20 bp, Human papillomavirus type 53
tgttgtgtgttagttttgtg

SEQ ID NO: 59507 - DNA, 20 bp, Human papillomavirus type 53
tgtgttagttttgtgttttt

SEQ ID NO: 59508 - DNA, 20 bp, Human papillomavirus type 53
gttttgtgtttttgctttgc

SEQ ID NO: 59509 - DNA, 20 bp, Human papillomavirus type 53
tgtgtttttgctttgctgct

SEQ ID NO: 59510 - DNA, 20 bp, Human papillomavirus type 53
gtagaccctcctgttattga

SEQ ID NO: 59511 - DNA, 20 bp, Human papillomavirus type 53
tagaccctcctgttattgag

SEQ ID NO: 59512 - DNA, 20 bp, Human papillomavirus type 53
ttgaggtcccccaaactggt

SEQ ID NO: 59513 - DNA, 20 bp, Human papillomavirus type 53
aggtcccccaaactggtgag

SEQ ID NO: 59514 - DNA, 20 bp, Human papillomavirus type 53
ataagtaccccaacatctgg

SEQ ID NO: 59515 - DNA, 20 bp, Human papillomavirus type 53
accttttcaccatcaggtgt

SEQ ID NO: 59516 - DNA, 20 bp, Human papillomavirus type 53
tcaccatcaggtgtggcacc

SEQ ID NO: 59517 - DNA, 20 bp, Human papillomavirus type 53
caccatcaggtgtggcacct

SEQ ID NO: 59518 - DNA, 20 bp, Human papillomavirus type 53
accatcaggtgtggcacctg

SEQ ID NO: 59519 - DNA, 20 bp, Human papillomavirus type 53
tttagacattgtggctttac

SEQ ID NO: 59520 - DNA, 20 bp, Human papillomavirus type 53
tacagggctccacatttgcg

SEQ ID NO: 59521 - DNA, 20 bp, Human papillomavirus type 53
gcgttatggcctgtttattt

SEQ ID NO: 59522 - DNA, 20 bp, Human papillomavirus type 53
cgttatggcctgtttatttt

SEQ ID NO: 59523 - DNA, 20 bp, Human papillomavirus type 53
tggcctgtttattttttgaa

SEQ ID NO: 59524 - DNA, 20 bp, Human papillomavirus type 53
attttttgaaacgtaggcgt

SEQ ID NO: 59525 - DNA, 20 bp, Human papillomavirus type 53
gtcgcctcctgttgccacta

SEQ ID NO: 59526 - DNA, 20 bp, Human papillomavirus type 53
tcgcctcctgttgccactag

SEQ ID NO: 59527 - DNA, 20 bp, Human papillomavirus type 53
ccactagcttagaggacaaa

SEQ ID NO: 59528 - DNA, 20 bp, Human papillomavirus type 53
gaggacaaatacagatatgt

SEQ ID NO: 59529 - DNA, 20 bp, Human papillomavirus type 53
tgacaggttatagctgcact

SEQ ID NO: 59530 - DNA, 20 bp, Human papillomavirus type 53
gtcacttactgtaggctgcc

SEQ ID NO: 59531 - DNA, 20 bp, Human papillomavirus type 53
ctgtaggctgccaactatgc

SEQ ID NO: 59532 - DNA, 20 bp, Human papillomavirus type 53
tacctgcataccttagtgct

SEQ ID NO: 59533 - DNA, 20 bp, Human papillomavirus type 53
acctgcataccttagtgctt

SEQ ID NO: 59534 - DNA, 20 bp, Human papillomavirus type 53
cctgcataccttagtgcttt

SEQ ID NO: 59535 - DNA, 20 bp, Human rhinovirus 1
ttccggtaactttgtacgcc

SEQ ID NO: 59536 - DNA, 20 bp, Human rhinovirus 1
cggtaactttgtacgccagt

SEQ ID NO: 59537 - DNA, 20 bp, Human rhinovirus 1
gtacgccagtttttccctcc

SEQ ID NO: 59538 - DNA, 20 bp, Human rhinovirus 1
tacgccagtttttccctccc

SEQ ID NO: 59539 - DNA, 20 bp, Human rhinovirus 1
ttccctcccctccccatcct

SEQ ID NO: 59540 - DNA, 20 bp, Human rhinovirus 1
cagatgaggctggacattcc

SEQ ID NO: 59541 - DNA, 20 bp, Human rhinovirus 1
cccactggtaacagtggtcc

SEQ ID NO: 59542 - DNA, 20 bp, Human rhinovirus 1
acaccctgtccgatctttgg

SEQ ID NO: 59543 - DNA, 20 bp, Human rhinovirus 1
ggcttcacacctcatgagag

SEQ ID NO: 59544 - DNA, 20 bp, Human rhinovirus 1
gcttcacacctcatgagagg

SEQ ID NO: 59545 - DNA, 20 bp, Human rhinovirus 1
gaaaaggggatcccaacact

SEQ ID NO: 59546 - DNA, 20 bp, Human rhinovirus 1
aggcttgtggctattcagac

SEQ ID NO: 59547 - DNA, 20 bp, Human rhinovirus 1
tggctattcagacaggatta

SEQ ID NO: 59548 - DNA, 20 bp, Human rhinovirus 1
agacaggattatgcaaataa

SEQ ID NO: 59549 - DNA, 20 bp, Human rhinovirus 1
tgcaaataaccagaggagat

SEQ ID NO: 59550 - DNA, 20 bp, Human rhinovirus 1
tctggtgcaagagcaaaaaa

SEQ ID NO: 59551 - DNA, 20 bp, Human rhinovirus 1
ctggtgcaagagcaaaaaac

SEQ ID NO: 59552 - DNA, 20 bp, Human rhinovirus 1
tggtgcaagagcaaaaaaca

SEQ ID NO: 59553 - DNA, 20 bp, Human rhinovirus 1
aacaaggattacctgtatat

SEQ ID NO: 59554 - DNA, 20 bp, Human rhinovirus 1
cctgtatatataactccagg

SEQ ID NO: 59555 - DNA, 20 bp, Human rhinovirus 1
tcaataaaagtagacattac

SEQ ID NO: 59556 - DNA, 20 bp, Human rhinovirus 1
caataaaagtagacattaca

SEQ ID NO: 59557 - DNA, 20 bp, Human rhinovirus 1
aataaaagtagacattacat

SEQ ID NO: 59558 - DNA, 20 bp, Human rhinovirus 1
catcacagcctttggctaca

SEQ ID NO: 59559 - DNA, 20 bp, Human rhinovirus 1
ggctacaactttaattgggg

SEQ ID NO: 59560 - DNA, 20 bp, Human rhinovirus 1
tgtgggatgttggattgcag

SEQ ID NO: 59561 - DNA, 20 bp, Human rhinovirus 1
gattgcagtctactatatct

SEQ ID NO: 59562 - DNA, 20 bp, Human rhinovirus 1
cagtctactatatctcttgt

SEQ ID NO: 59563 - DNA, 20 bp, Human rhinovirus 1
ttgtaccatgggtgagtgcc

SEQ ID NO: 59564 - DNA, 20 bp, Human rhinovirus 1
taccatgggtgagtgccagc

SEQ ID NO: 59565 - DNA, 20 bp, Human rhinovirus 1
tgtccacatctcaagaataa

SEQ ID NO: 59566 - DNA, 20 bp, Human rhinovirus 1
attacactgactataatgga

SEQ ID NO: 59567 - DNA, 20 bp, Human rhinovirus 1
cactgactataatggacagg

SEQ ID NO: 59568 - DNA, 20 bp, Human rhinovirus 1
cacaaaatggaaaatcacac

SEQ ID NO: 59569 - DNA, 20 bp, Human rhinovirus 1
acaaaatggaaaatcacact

SEQ ID NO: 59570 - DNA, 20 bp, Human rhinovirus 1
aaaaagaaacgatttctcat

SEQ ID NO: 59571 - DNA, 20 bp, Human rhinovirus 1
ctcatggcaatcaggcacca

SEQ ID NO: 59572 - DNA, 20 bp, Human rhinovirus 1
tcatggcaatcaggcaccaa

SEQ ID NO: 59573 - DNA, 20 bp, Human rhinovirus 1
tggcaacatggacagccatt

SEQ ID NO: 59574 - DNA, 20 bp, Human rhinovirus 1
cctagattttctttaccatt

SEQ ID NO: 59575 - DNA, 20 bp, Human rhinovirus 1
atagatcttagacaatttca

SEQ ID NO: 59576 - DNA, 20 bp, Human rhinovirus 1
tagatcttagacaatttcac

SEQ ID NO: 59577 - DNA, 20 bp, Human rhinovirus 1
gacaatttcactgtgctgag

SEQ ID NO: 59578 - DNA, 20 bp, Human rhinovirus 1
cactgtgctgaggaacaagg

SEQ ID NO: 59579 - DNA, 20 bp, Human rhinovirus 1
actgtgctgaggaacaaggc

SEQ ID NO: 59580 - DNA, 20 bp, Human rhinovirus 1
acactaattggttgcaatgg

SEQ ID NO: 59581 - DNA, 20 bp, Human rhinovirus 1
gttgcaatggttcaccatgg

SEQ ID NO: 59582 - DNA, 20 bp, Human rhinovirus 1
caatggttcaccatggagat

SEQ ID NO: 59583 - DNA, 20 bp, Human rhinovirus 1
accatggagatttctcaaag

SEQ ID NO: 59584 - DNA, 20 bp, Human rhinovirus 1
ctcaaagaaaagttttgcaa

SEQ ID NO: 59585 - DNA, 20 bp, Human rhinovirus 1
acaatcacattttggaagaa

SEQ ID NO: 59586 - DNA, 20 bp, Human rhinovirus 1
caatcacattttggaagaag

SEQ ID NO: 59587 - DNA, 20 bp, Human rhinovirus 1
tggaagaagacaaaagaagg

SEQ ID NO: 59588 - DNA, 20 bp, Human rhinovirus 1
ggaagaagacaaaagaagga

SEQ ID NO: 59589 - DNA, 20 bp, Human rhinovirus 1
gaagaagacaaaagaaggag

SEQ ID NO: 59590 - DNA, 20 bp, Human papillomavirus type 166
ggcagtgatctttatccagg

SEQ ID NO: 59591 - DNA, 20 bp, Human papillomavirus type 166
gcagtgatctttatccaggt

SEQ ID NO: 59592 - DNA, 20 bp, Human papillomavirus type 166
atccaggtaagtacaagctg

SEQ ID NO: 59593 - DNA, 20 bp, Human papillomavirus type 166
tccaggtaagtacaagctga

SEQ ID NO: 59594 - DNA, 20 bp, Human papillomavirus type 166
atgagtcaaaaggttggcac

SEQ ID NO: 59595 - DNA, 20 bp, Human papillomavirus type 166
ttaaggcttcagcgcttgaa

SEQ ID NO: 59596 - DNA, 20 bp, Human papillomavirus type 166
aggcttcagcgcttgaaggt

SEQ ID NO: 59597 - DNA, 20 bp, Human papillomavirus type 166
agcgcttgaaggtcttttgc

SEQ ID NO: 59598 - DNA, 20 bp, Human papillomavirus type 166
aaggtcttttgcataaatct

SEQ ID NO: 59599 - DNA, 20 bp, Human papillomavirus type 166
tgcataaatctttacagagc

SEQ ID NO: 59600 - DNA, 20 bp, Human papillomavirus type 166
gatacatttgaagatatttt

SEQ ID NO: 59601 - DNA, 20 bp, Human papillomavirus type 166
gaagatattttcgatgaaag

SEQ ID NO: 59602 - DNA, 20 bp, Human papillomavirus type 166
aagatattttcgatgaaagt

SEQ ID NO: 59603 - DNA, 20 bp, Human papillomavirus type 166
tcgatgaaagtacagatggt

SEQ ID NO: 59604 - DNA, 20 bp, Human papillomavirus type 166
cgatgaaagtacagatggtt

SEQ ID NO: 59605 - DNA, 20 bp, Human papillomavirus type 166
ggttacggttgtatttaatg

SEQ ID NO: 59606 - DNA, 20 bp, Human papillomavirus type 166
cggttgtatttaatgcttta

SEQ ID NO: 59607 - DNA, 20 bp, Human papillomavirus type 166
tatttaatgctttagaagaa

SEQ ID NO: 59608 - DNA, 20 bp, Human papillomavirus type 166
aatgctttagaagaagtaat

SEQ ID NO: 59609 - DNA, 20 bp, Human papillomavirus type 166
atgctttagaagaagtaatt

SEQ ID NO: 59610 - DNA, 20 bp, Human papillomavirus type 166
tttaaattgtaataatcaag

SEQ ID NO: 59611 - DNA, 20 bp, Human papillomavirus type 166
ttaaattgtaataatcaagt

SEQ ID NO: 59612 - DNA, 20 bp, Human papillomavirus type 166
taaattgtaataatcaagta

SEQ ID NO: 59613 - DNA, 20 bp, Human papillomavirus type 166
aaattgtaataatcaagtaa

SEQ ID NO: 59614 - DNA, 20 bp, Human papillomavirus type 166
aattgtaataatcaagtaaa

SEQ ID NO: 59615 - DNA, 20 bp, Human papillomavirus type 166
atgcaaaacatagagtccca

SEQ ID NO: 59616 - DNA, 20 bp, Human papillomavirus type 166
aactacctccattagttgtt

SEQ ID NO: 59617 - DNA, 20 bp, Human papillomavirus type 166
gttgttacaaccaacttaga

SEQ ID NO: 59618 - DNA, 20 bp, Human papillomavirus type 166
ttacaaccaacttagatgta

SEQ ID NO: 59619 - DNA, 20 bp, Human papillomavirus type 166
caaccaacttagatgtaaaa

SEQ ID NO: 59620 - DNA, 20 bp, Human papillomavirus type 166
gaatgctgatgttgttaaga

SEQ ID NO: 59621 - DNA, 20 bp, Human papillomavirus type 166
ttaagaagtttaagtaaatc

SEQ ID NO: 59622 - DNA, 20 bp, Human papillomavirus type 166
agaagtttaagtaaatcaca

SEQ ID NO: 59623 - DNA, 20 bp, Human papillomavirus type 166
aagtaaatcacagtatgcct

SEQ ID NO: 59624 - DNA, 20 bp, Human papillomavirus type 166
agtaaatcacagtatgcctc

SEQ ID NO: 59625 - DNA, 20 bp, Human papillomavirus type 166
ccctgagaggaggcctacct

SEQ ID NO: 59626 - DNA, 20 bp, Human papillomavirus type 166
gacgacgacaaggaggagaa

SEQ ID NO: 59627 - DNA, 20 bp, Human papillomavirus type 166
tccttgttctcctccttgtc

SEQ ID NO: 59628 - DNA, 20 bp, Human papillomavirus type 166
ttctcctccttgtcgtcgtc

SEQ ID NO: 59629 - DNA, 20 bp, Human papillomavirus type 166
tcctccttgtcgtcgtcgaa

SEQ ID NO: 59630 - DNA, 20 bp, Human papillomavirus type 166
acatatggtcaattaaatag

SEQ ID NO: 59631 - DNA, 20 bp, Human papillomavirus type 166
aatagcttataatgtacaga

SEQ ID NO: 59632 - DNA, 20 bp, Human papillomavirus type 166
taatgtacagagcaggtaga

SEQ ID NO: 59633 - DNA, 20 bp, Human papillomavirus type 166
tgcagaggagctatataaac

SEQ ID NO: 59634 - DNA, 20 bp, Human papillomavirus type 166
tattttatttttaacatcag

SEQ ID NO: 59635 - DNA, 20 bp, Human papillomavirus type 166
tatcgtctacagatgagtct

SEQ ID NO: 59636 - DNA, 20 bp, Human papillomavirus type 166
tgggggtggaattggttgca

SEQ ID NO: 59637 - DNA, 20 bp, Human papillomavirus type 166
gggggtggaattggttgcac

SEQ ID NO: 59638 - DNA, 20 bp, Human papillomavirus type 166
ggggtggaattggttgcaca

SEQ ID NO: 59639 - DNA, 20 bp, Human papillomavirus type 166
gttgcacatctagtactgca

SEQ ID NO: 59640 - DNA, 20 bp, Human papillomavirus type 166
agagatattagagtattaca

SEQ ID NO: 59641 - DNA, 20 bp, Human papillomavirus type 166
gagatattagagtattacat

SEQ ID NO: 59642 - DNA, 20 bp, Human papillomavirus type 166
gagtattacatagaccttcc

SEQ ID NO: 59643 - DNA, 20 bp, Human papillomavirus type 166
catagaccttcctattttac

SEQ ID NO: 59644 - DNA, 20 bp, Human papillomavirus type 166
ctattttacaaccgataccg

SEQ ID NO: 59645 - DNA, 20 bp, Human papillomavirus type 166
ctacaaagcagcaaaccatt

SEQ ID NO: 59646 - DNA, 20 bp, Human papillomavirus type 166
taccatcacaaacagagcca

SEQ ID NO: 59647 - DNA, 20 bp, Human papillomavirus type 166
ttatagatttattttcagat

SEQ ID NO: 59648 - DNA, 20 bp, Human papillomavirus type 166
tagatttattttcagatgac

SEQ ID NO: 59649 - DNA, 20 bp, Human papillomavirus type 166
attttcagatgacttttact

SEQ ID NO: 59650 - DNA, 20 bp, Human papillomavirus type 166
catgcacaggacatccttat

SEQ ID NO: 59651 - DNA, 20 bp, Human papillomavirus type 166
atgcacaggacatccttatt

SEQ ID NO: 59652 - DNA, 20 bp, Human papillomavirus type 166
tttcaataaatattcagatg

SEQ ID NO: 59653 - DNA, 20 bp, Human papillomavirus type 166
caataaatattcagatgttg

SEQ ID NO: 59654 - DNA, 20 bp, Human papillomavirus type 166
aataaatattcagatgttga

SEQ ID NO: 59655 - DNA, 20 bp, Human papillomavirus type 166
caatggaaggtactgactat

SEQ ID NO: 59656 - DNA, 20 bp, Human papillomavirus type 166
catagctaagcaggataata

SEQ ID NO: 59657 - DNA, 20 bp, Human papillomavirus type 166
cttcccacatttattataca

SEQ ID NO: 59658 - DNA, 20 bp, Human papillomavirus type 166
ccacatttattatacaacac

SEQ ID NO: 59659 - DNA, 20 bp, Human papillomavirus type 166
attatacaacaccgagtggc

SEQ ID NO: 59660 - DNA, 20 bp, Human papillomavirus type 166
cgcagagtataaattctggg

SEQ ID NO: 59661 - DNA, 20 bp, Human papillomavirus type 166
tgggacgttgatttaacaga

SEQ ID NO: 59662 - DNA, 20 bp, Human papillomavirus type 166
atttaacagagaaatttacc

SEQ ID NO: 59663 - DNA, 20 bp, Human papillomavirus type 166
aacagagaaatttacctctg

SEQ ID NO: 59664 - DNA, 20 bp, Human papillomavirus type 166
acagagaaatttacctctga

SEQ ID NO: 59665 - DNA, 20 bp, Human rhinovirus C
gaggggaagccatttaagtg

SEQ ID NO: 59666 - DNA, 20 bp, Human rhinovirus C
aggggaagccatttaagtga

SEQ ID NO: 59667 - DNA, 20 bp, Human rhinovirus C
tcacttaaatggcttcccct

SEQ ID NO: 59668 - DNA, 20 bp, Human rhinovirus C
aatggcttcccctcaaagag

SEQ ID NO: 59669 - DNA, 20 bp, Human rhinovirus C
ccctcaaagaggggcaggca

SEQ ID NO: 59670 - DNA, 20 bp, Human rhinovirus C
gggtgtccgtgtttcctgtt

SEQ ID NO: 59671 - DNA, 20 bp, Human rhinovirus C
ggtgtccgtgtttcctgttt

SEQ ID NO: 59672 - DNA, 20 bp, Human rhinovirus C
cctgttttctttaaatactt

SEQ ID NO: 59673 - DNA, 20 bp, Human rhinovirus C
ctgttttctttaaatacttg

SEQ ID NO: 59674 - DNA, 20 bp, Human rhinovirus C
tctttaaatacttgcttatg

SEQ ID NO: 59675 - DNA, 20 bp, Human rhinovirus C
caaatccagctttaatgtca

SEQ ID NO: 59676 - DNA, 20 bp, Human rhinovirus C
aatgtcaccaactgttgaag

SEQ ID NO: 59677 - DNA, 20 bp, Human rhinovirus C
atgtcaccaactgttgaagc

SEQ ID NO: 59678 - DNA, 20 bp, Human rhinovirus C
aagcatgtgggatgtccgat

SEQ ID NO: 59679 - DNA, 20 bp, Human rhinovirus C
aacaaattactatcgggaat

SEQ ID NO: 59680 - DNA, 20 bp, Human rhinovirus C
cctgattgccttaaagatat

SEQ ID NO: 59681 - DNA, 20 bp, Human rhinovirus C
ccttaaagatatgggcatct

SEQ ID NO: 59682 - DNA, 20 bp, Human rhinovirus C
aagatatgggcatcttcggg

SEQ ID NO: 59683 - DNA, 20 bp, Human rhinovirus C
gggcaaaatctgtaccatca

SEQ ID NO: 59684 - DNA, 20 bp, Human rhinovirus C
ggtaggtcagggtacataat

SEQ ID NO: 59685 - DNA, 20 bp, Human rhinovirus C
tttaattgtaatgggaccct

SEQ ID NO: 59686 - DNA, 20 bp, Human rhinovirus C
aattgtaatgggaccctgct

SEQ ID NO: 59687 - DNA, 20 bp, Human rhinovirus C
attgtaatgggaccctgctt

SEQ ID NO: 59688 - DNA, 20 bp, Human rhinovirus C
taatgggaccctgcttggta

SEQ ID NO: 59689 - DNA, 20 bp, Human rhinovirus C
gtaacatcactatattccca

SEQ ID NO: 59690 - DNA, 20 bp, Human rhinovirus C
ccaacacggctgccaagtgg

SEQ ID NO: 59691 - DNA, 20 bp, Human rhinovirus C
ctcacaactgaggacgagca

SEQ ID NO: 59692 - DNA, 20 bp, Human rhinovirus C
tcacaactgaggacgagcag

SEQ ID NO: 59693 - DNA, 20 bp, Human rhinovirus C
gccgactgctcgtcctcagt

SEQ ID NO: 59694 - DNA, 20 bp, Human rhinovirus C
tgagaaattgttgagatcca

SEQ ID NO: 59695 - DNA, 20 bp, Human rhinovirus C
tgatacccatggacattagc

SEQ ID NO: 59696 - DNA, 20 bp, Human rhinovirus C
gcaacactctcttttctacc

SEQ ID NO: 59697 - DNA, 20 bp, Human rhinovirus C
tctaccactttactaggtga

SEQ ID NO: 59698 - DNA, 20 bp, Human rhinovirus C
ctaccactttactaggtgaa

SEQ ID NO: 59699 - DNA, 20 bp, Human rhinovirus C
taccactttactaggtgaag

SEQ ID NO: 59700 - DNA, 20 bp, Human rhinovirus C
gactcaaaacccagttgagg

SEQ ID NO: 59701 - DNA, 20 bp, Human rhinovirus C
actcaaaacccagttgagga

SEQ ID NO: 59702 - DNA, 20 bp, Human rhinovirus C
aggactacatagacaaggtg

SEQ ID NO: 59703 - DNA, 20 bp, Human rhinovirus C
aaccaagtgctttgggcgct

SEQ ID NO: 59704 - DNA, 20 bp, Human rhinovirus C
gggcgctatggaaattgggg

SEQ ID NO: 59705 - DNA, 20 bp, Human rhinovirus C
tgcaaaatgggatataaact

SEQ ID NO: 59706 - DNA, 20 bp, Human rhinovirus C
gcaaaatgggatataaactt

SEQ ID NO: 59707 - DNA, 20 bp, Human rhinovirus C
caaaatgggatataaacttc

SEQ ID NO: 59708 - DNA, 20 bp, Human rhinovirus C
caagagcatgcacaagtcag

SEQ ID NO: 59709 - DNA, 20 bp, Human rhinovirus C
gaaatgtttacatatgctag

SEQ ID NO: 59710 - DNA, 20 bp, Human rhinovirus C
actggattgggttcagctta

SEQ ID NO: 59711 - DNA, 20 bp, Human rhinovirus C
ggttcagcttattatatgtt

SEQ ID NO: 59712 - DNA, 20 bp, Human rhinovirus C
agcttattatatgttttatg

SEQ ID NO: 59713 - DNA, 20 bp, Human rhinovirus C
ttatatgttttatgatggtt

SEQ ID NO: 59714 - DNA, 20 bp, Human rhinovirus C
tatgttttatgatggttatg

SEQ ID NO: 59715 - DNA, 20 bp, Human rhinovirus C
agaaaccagatgacactact

SEQ ID NO: 59716 - DNA, 20 bp, Human rhinovirus C
attaaccacaggactgatat

SEQ ID NO: 59717 - DNA, 20 bp, Human rhinovirus C
ttaaccacaggactgatata

SEQ ID NO: 59718 - DNA, 20 bp, Human rhinovirus C
accacaggactgatataaaa

SEQ ID NO: 59719 - DNA, 20 bp, Human rhinovirus C
gtccatacagccactatgat

SEQ ID NO: 59720 - DNA, 20 bp, Human rhinovirus C
agatagatatataccagtta

SEQ ID NO: 59721 - DNA, 20 bp, Human rhinovirus C
gatagatatataccagttaa

SEQ ID NO: 59722 - DNA, 20 bp, Human rhinovirus C
aattagaagcacacgactgg

SEQ ID NO: 59723 - DNA, 20 bp, Human rhinovirus C
gaagcacacgactggtatca

SEQ ID NO: 59724 - DNA, 20 bp, Human rhinovirus C
ttacccacagcacatccagt

SEQ ID NO: 59725 - DNA, 20 bp, Human rhinovirus C
aggactatgtgacacaatta

SEQ ID NO: 59726 - DNA, 20 bp, Human rhinovirus C
gggagtgcctttggtagcgg

SEQ ID NO: 59727 - DNA, 20 bp, Human rhinovirus C
ggtagcggtttcactgacac

SEQ ID NO: 59728 - DNA, 20 bp, Human rhinovirus C
gtagcggtttcactgacaca

SEQ ID NO: 59729 - DNA, 20 bp, Human rhinovirus C
cactgacacacttaaagacc

SEQ ID NO: 59730 - DNA, 20 bp, Human rhinovirus C
ctcaaggaccggttatgtca

SEQ ID NO: 59731 - DNA, 20 bp, Human rhinovirus C
tcaaggaccggttatgtcag

SEQ ID NO: 59732 - DNA, 20 bp, Human rhinovirus C
tgtcagtggttaaacatcac

SEQ ID NO: 59733 - DNA, 20 bp, Human rhinovirus C
aacatcactagaccgccaag

SEQ ID NO: 59734 - DNA, 20 bp, Human rhinovirus C
aagaaattcactgaatgctg

SEQ ID NO: 59735 - DNA, 20 bp, Human rhinovirus C
actcccttcctccagaccct

SEQ ID NO: 59736 - DNA, 20 bp, Human rhinovirus C
ctcccttcctccagacccta

SEQ ID NO: 59737 - DNA, 20 bp, Human rhinovirus C
ctccagaccctaaacatttt

SEQ ID NO: 59738 - DNA, 20 bp, Human rhinovirus C
tgatgggtatgatcaacaag

SEQ ID NO: 59739 - DNA, 20 bp, Human rhinovirus C
gatgggtatgatcaacaaga

SEQ ID NO: 59740 - DNA, 20 bp, Human rhinovirus C
acaggcgcttctacttagat

SEQ ID NO: 59741 - DNA, 20 bp, Human rhinovirus C
tacttagatttagatcttaa

SEQ ID NO: 59742 - DNA, 20 bp, Human rhinovirus C
gatttagatcttaagatctt

SEQ ID NO: 59743 - DNA, 20 bp, Human rhinovirus C
agatcttaagatcttgcaag

SEQ ID NO: 59744 - DNA, 20 bp, Human rhinovirus C
gatcttaagatcttgcaagg

SEQ ID NO: 59745 - DNA, 20 bp, Human rhinovirus C
gcaataatttaacagctata

SEQ ID NO: 59746 - DNA, 20 bp, Human rhinovirus C
aacagctatatttcagggct

SEQ ID NO: 59747 - DNA, 20 bp, Human rhinovirus C
acagctatatttcagggctt

SEQ ID NO: 59748 - DNA, 20 bp, Human rhinovirus C
cagggcttgggtgataagga

SEQ ID NO: 59749 - DNA, 20 bp, Human rhinovirus C
agggcttgggtgataaggaa

SEQ ID NO: 59750 - DNA, 20 bp, Human rhinovirus C
agaagagcaaccttgcaagg

SEQ ID NO: 59751 - DNA, 20 bp, Human rhinovirus C
caaggtcctgaacatgaatt

SEQ ID NO: 59752 - DNA, 20 bp, Human rhinovirus C
taataagggcattcaaaaat

SEQ ID NO: 59753 - DNA, 20 bp, Human rhinovirus C
aaaaattcatgttcaggacc

SEQ ID NO: 59754 - DNA, 20 bp, Human rhinovirus C
atgttcaggaccttgcaagg

SEQ ID NO: 59755 - DNA, 20 bp, Human rhinovirus C
ccacccacatgtattcctat

SEQ ID NO: 59756 - DNA, 20 bp, Human rhinovirus C
cacccacatgtattcctatg

SEQ ID NO: 59757 - DNA, 20 bp, Human rhinovirus C
ctatgatattacctgtgttg

SEQ ID NO: 59758 - DNA, 20 bp, Human rhinovirus C
cctgtgttggccagcactgc

SEQ ID NO: 59759 - DNA, 20 bp, Human rhinovirus C
gccagcactgcaccacattg

SEQ ID NO: 59760 - DNA, 20 bp, Human rhinovirus C
acaccccaaggatccacgat

SEQ ID NO: 59761 - DNA, 20 bp, Human rhinovirus C
caccccaaggatccacgatt

SEQ ID NO: 59762 - DNA, 20 bp, Human rhinovirus C
gaagtagacctcactacagc

SEQ ID NO: 59763 - DNA, 20 bp, Human rhinovirus C
tgtcaaaatataaaggtaat

SEQ ID NO: 59764 - DNA, 20 bp, Human rhinovirus C
atgtccctatgaatgagtac

SEQ ID NO: 59765 - DNA, 20 bp, Human rhinovirus C
aacaacgctactaaagacac

SEQ ID NO: 59766 - DNA, 20 bp, Human rhinovirus C
gatctgtatggtattgatct

SEQ ID NO: 59767 - DNA, 20 bp, Human rhinovirus C
atctaccctacataactttc

SEQ ID NO: 59768 - DNA, 20 bp, Human rhinovirus C
cctaaaggatgaactccgcg

SEQ ID NO: 59769 - DNA, 20 bp, Human rhinovirus C
ctaaaggatgaactccgcgc

SEQ ID NO: 59770 - DNA, 20 bp, Human rhinovirus C
tggtcacaaatgcatgctat

SEQ ID NO: 59771 - DNA, 20 bp, Human rhinovirus C
ggtcacaaatgcatgctatg

SEQ ID NO: 59772 - DNA, 20 bp, Human rhinovirus C
gtcacaaatgcatgctatgt

SEQ ID NO: 59773 - DNA, 20 bp, Human rhinovirus C
gatggagaactcattgcttt

SEQ ID NO: 59774 - DNA, 20 bp, Human rhinovirus C
cttttgattacaccaattat

SEQ ID NO: 59775 - DNA, 20 bp, Human rhinovirus C
aaacctgactccaaatacaa

SEQ ID NO: 59776 - DNA, 20 bp, Human rhinovirus C
aacctgactccaaatacaaa

SEQ ID NO: 59777 - DNA, 20 bp, Human rhinovirus C
ctgatacatcctgtttactc

SEQ ID NO: 59778 - DNA, 20 bp, Human rhinovirus C
tgatacatcctgtttactca

SEQ ID NO: 59779 - DNA, 20 bp, Human rhinovirus C
actcaatgcaggatgtttat

SEQ ID NO: 59780 - DNA, 20 bp, Influenza A virus
gatatttcattgccatcatc

SEQ ID NO: 59781 - DNA, 20 bp, Influenza A virus
cattgccatcatccatttca

SEQ ID NO: 59782 - DNA, 20 bp, Influenza A virus
attgccatcatccatttcat

SEQ ID NO: 59783 - DNA, 20 bp, Influenza A virus
ccatcatccatttcattctg

SEQ ID NO: 59784 - DNA, 20 bp, Influenza A virus
cattctgagagcagggttct

SEQ ID NO: 59785 - DNA, 20 bp, Influenza A virus
gtggaacaggaatgggccga

SEQ ID NO: 59786 - DNA, 20 bp, Influenza A virus
tccaaaggtttacaaaacat

SEQ ID NO: 59787 - DNA, 20 bp, Influenza A virus
acaaaacatactttgagaag

SEQ ID NO: 59788 - DNA, 20 bp, Influenza A virus
tcaaagtatgttttgtaaac

SEQ ID NO: 59789 - DNA, 20 bp, Influenza A virus
tgtaaacctttggataatgg

SEQ ID NO: 59790 - DNA, 20 bp, Influenza A virus
acatcagagtcgcaattgac

SEQ ID NO: 59791 - DNA, 20 bp, Influenza A virus
acaataacaaaagagaagaa

SEQ ID NO: 59792 - DNA, 20 bp, Influenza A virus
taaaattgctcctttaatgg

SEQ ID NO: 59793 - DNA, 20 bp, Influenza A virus
ctcctttaatggtggcatac

SEQ ID NO: 59794 - DNA, 20 bp, Influenza A virus
aatggtggcatacatgttgg

SEQ ID NO: 59795 - DNA, 20 bp, Influenza A virus
caggcaacctccaaacattg

SEQ ID NO: 59796 - DNA, 20 bp, Influenza A virus
aaaataaaagtacatgaggg

SEQ ID NO: 59797 - DNA, 20 bp, Influenza A virus
acaatggttgggcggagagc

SEQ ID NO: 59798 - DNA, 20 bp, Influenza A virus
ggcggagagcaacagctatc

SEQ ID NO: 59799 - DNA, 20 bp, Influenza A virus
tagttgctttcctcaggata

SEQ ID NO: 59800 - DNA, 20 bp, Influenza A virus
aaccccatgcatcaactcct

SEQ ID NO: 59801 - DNA, 20 bp, Influenza A virus
caaaaagatgcaaaagtgct

SEQ ID NO: 59802 - DNA, 20 bp, Influenza A virus
cagaactggggaattgaacc

SEQ ID NO: 59803 - DNA, 20 bp, Influenza A virus
agaactggggaattgaacct

SEQ ID NO: 59804 - DNA, 20 bp, Influenza A virus
aattccccagttctgaaaca

SEQ ID NO: 59805 - DNA, 20 bp, Influenza A virus
tctcctgaagaggttagtga

SEQ ID NO: 59806 - DNA, 20 bp, Influenza A virus
gtgaaacacagggaacagag

SEQ ID NO: 59807 - DNA, 20 bp, Influenza A virus
acaataacatattcatcctc

SEQ ID NO: 59808 - DNA, 20 bp, Influenza A virus
aggatgaatatgttattgtc

SEQ ID NO: 59809 - DNA, 20 bp, Influenza A virus
ttgtcaacttctctgttccc

SEQ ID NO: 59810 - DNA, 20 bp, Human adenovirus
acgtcaagacgcacggccgg

SEQ ID NO: 59811 - DNA, 20 bp, Human adenovirus
ccgcagaggcgtggcctagc

SEQ ID NO: 59812 - DNA, 20 bp, Human adenovirus
aaacccggaaacggccgatt

SEQ ID NO: 59813 - DNA, 20 bp, Human adenovirus
aacccggaaacggccgattt

SEQ ID NO: 59814 - DNA, 20 bp, Human adenovirus
tcccacggccacgcccggat

SEQ ID NO: 59815 - DNA, 20 bp, Human adenovirus
cgattacggtgtttttttcg

SEQ ID NO: 59816 - DNA, 20 bp, Human adenovirus
gattacggtgtttttttcgc

SEQ ID NO: 59817 - DNA, 20 bp, Human adenovirus
cggtgtttttttcgccaatt

SEQ ID NO: 59818 - DNA, 20 bp, Human adenovirus
ttttcgccaatttccgcgtc

SEQ ID NO: 59819 - DNA, 20 bp, Human adenovirus
tttcgccaatttccgcgtcc

SEQ ID NO: 59820 - DNA, 20 bp, Human adenovirus
ggaggtaaatgcccaggaga

SEQ ID NO: 59821 - DNA, 20 bp, Human adenovirus
gaggtaaatgcccaggagaa

SEQ ID NO: 59822 - DNA, 20 bp, Human adenovirus
aatatttccagaatctatga

SEQ ID NO: 59823 - DNA, 20 bp, Human adenovirus
atatttccagaatctatgat

SEQ ID NO: 59824 - DNA, 20 bp, Human adenovirus
ccagaatctatgattcttca

SEQ ID NO: 59825 - DNA, 20 bp, Human adenovirus
ctgcgctctgtgttacatga

SEQ ID NO: 59826 - DNA, 20 bp, Human adenovirus
tcatgtaacacagagcgcag

SEQ ID NO: 59827 - DNA, 20 bp, Human adenovirus
catgtaacacagagcgcagg

SEQ ID NO: 59828 - DNA, 20 bp, Human adenovirus
atgtaacacagagcgcagga

SEQ ID NO: 59829 - DNA, 20 bp, Human adenovirus
gggtctccggtctgttcccg

SEQ ID NO: 59830 - DNA, 20 bp, Human adenovirus
acaaaattgaggatttgttg

SEQ ID NO: 59831 - DNA, 20 bp, Human adenovirus
caaaattgaggatttgttgc

SEQ ID NO: 59832 - DNA, 20 bp, Human adenovirus
aggatttgttgcaggacgtg

SEQ ID NO: 59833 - DNA, 20 bp, Human adenovirus
gttgcaggacgtgggtggga

SEQ ID NO: 59834 - DNA, 20 bp, Human adenovirus
ttgcaggacgtgggtgggaa

SEQ ID NO: 59835 - DNA, 20 bp, Human adenovirus
tggaggatagttcagacggg

SEQ ID NO: 59836 - DNA, 20 bp, Human adenovirus
agacgggtgctccgggtttt

SEQ ID NO: 59837 - DNA, 20 bp, Human adenovirus
tggagacactggtttggaac

SEQ ID NO: 59838 - DNA, 20 bp, Human adenovirus
ggagacactggtttggaact

SEQ ID NO: 59839 - DNA, 20 bp, Human adenovirus
gagacactggtttggaactc

SEQ ID NO: 59840 - DNA, 20 bp, Human adenovirus
gcagccatgcacctgtggag

SEQ ID NO: 59841 - DNA, 20 bp, Human adenovirus
cagccatgcacctgtggagg

SEQ ID NO: 59842 - DNA, 20 bp, Human adenovirus
aactactggcttttacagcc

SEQ ID NO: 59843 - DNA, 20 bp, Human adenovirus
tacagccagcagcgtcgggt

SEQ ID NO: 59844 - DNA, 20 bp, Human adenovirus
acagccagcagcgtcgggtc

SEQ ID NO: 59845 - DNA, 20 bp, Human adenovirus
agaaatatgccaagatagcc

SEQ ID NO: 59846 - DNA, 20 bp, Human adenovirus
caagtacagggtgactaaga

SEQ ID NO: 59847 - DNA, 20 bp, Human adenovirus
aacatgcctgctacatctcg

SEQ ID NO: 59848 - DNA, 20 bp, Human adenovirus
cccgagatgtagcaggcatg

SEQ ID NO: 59849 - DNA, 20 bp, Human adenovirus
aatattcacggtcttagtca

SEQ ID NO: 59850 - DNA, 20 bp, Human adenovirus
gaaaaatgctacctgggagt

SEQ ID NO: 59851 - DNA, 20 bp, Human adenovirus
aaaaatgctacctgggagtc

SEQ ID NO: 59852 - DNA, 20 bp, Human adenovirus
cctagaaacgggctgctttt

SEQ ID NO: 59853 - DNA, 20 bp, Human adenovirus
tgcctggtgaagggcacagc

SEQ ID NO: 59854 - DNA, 20 bp, Human adenovirus
gcctggtgaagggcacagcc

SEQ ID NO: 59855 - DNA, 20 bp, Human adenovirus
gagaacgatgccttctccag

SEQ ID NO: 59856 - DNA, 20 bp, Human adenovirus
tccagggtgaacctgaacgg

SEQ ID NO: 59857 - DNA, 20 bp, Human adenovirus
gacatggatgtctcggtgta

SEQ ID NO: 59858 - DNA, 20 bp, Human adenovirus
acatggatgtctcggtgtac

SEQ ID NO: 59859 - DNA, 20 bp, Human adenovirus
gtctcatcgtatctcaggat

SEQ ID NO: 59860 - DNA, 20 bp, Human adenovirus
gtcagaatgtgatgggatca

SEQ ID NO: 59861 - DNA, 20 bp, Human adenovirus
cagcaaattcctcgaccatg

SEQ ID NO: 59862 - DNA, 20 bp, Human adenovirus
ctcgaccatgacctacgcga

SEQ ID NO: 59863 - DNA, 20 bp, Human adenovirus
acagcaccgccgcagccgcg

SEQ ID NO: 59864 - DNA, 20 bp, Human adenovirus
gctggaagcactgggcgccc

SEQ ID NO: 59865 - DNA, 20 bp, Human adenovirus
agagtgcggtggattttttc

SEQ ID NO: 59866 - DNA, 20 bp, Human adenovirus
tttccaggacccggtagagg

SEQ ID NO: 59867 - DNA, 20 bp, Human adenovirus
ttccaggacccggtagaggt

SEQ ID NO: 59868 - DNA, 20 bp, Human adenovirus
tccaggacccggtagaggtg

SEQ ID NO: 59869 - DNA, 20 bp, Human adenovirus
ccaggacccggtagaggtgg

SEQ ID NO: 59870 - DNA, 20 bp, Human adenovirus
gcgatgttaccgcccagatc

SEQ ID NO: 59871 - DNA, 20 bp, Human adenovirus
ccgcccagatcccgccgggg

SEQ ID NO: 59872 - DNA, 20 bp, Human adenovirus
atgttgtgcaggaccaccag

SEQ ID NO: 59873 - DNA, 20 bp, Human adenovirus
tgcaggaccaccaggacaat

SEQ ID NO: 59874 - DNA, 20 bp, Human adenovirus
cccaagtgcacgggctacat

SEQ ID NO: 59875 - DNA, 20 bp, Human adenovirus
cttaacagctgggacttgcc

SEQ ID NO: 59876 - DNA, 20 bp, Human adenovirus
ttaacagctgggacttgccg

SEQ ID NO: 59877 - DNA, 20 bp, Human adenovirus
acagctgggacttgccgcac

SEQ ID NO: 59878 - DNA, 20 bp, Human adenovirus
ccgcacccggttgggccgta

SEQ ID NO: 59879 - DNA, 20 bp, Human adenovirus
ggccgtagatgaccccgatg

SEQ ID NO: 59880 - DNA, 20 bp, Human adenovirus
ctcgtttcgggggttgggac

SEQ ID NO: 59881 - DNA, 20 bp, Human adenovirus
cgggggttgggacgactgcg

SEQ ID NO: 59882 - DNA, 20 bp, Human adenovirus
gggggttgggacgactgcga

SEQ ID NO: 59883 - DNA, 20 bp, Human adenovirus
ggacgactgcgactgtaggg

SEQ ID NO: 59884 - DNA, 20 bp, Human adenovirus
tgccctacagtcgcagtcgt

SEQ ID NO: 59885 - DNA, 20 bp, Human adenovirus
cagggcgtacagtttgggcg

SEQ ID NO: 59886 - DNA, 20 bp, Human adenovirus
gggcgcgagaaagaccgact

SEQ ID NO: 59887 - DNA, 20 bp, Human adenovirus
ggcgcgagaaagaccgactc

SEQ ID NO: 59888 - DNA, 20 bp, Human adenovirus
gcccccgagtcggtctttct

SEQ ID NO: 59889 - DNA, 20 bp, Human adenovirus
cccccgagtcggtctttctc

SEQ ID NO: 59890 - DNA, 20 bp, Human adenovirus
gtcttggcgtggacgcgcgc

SEQ ID NO: 59891 - DNA, 20 bp, Human adenovirus
tcttggcgtggacgcgcgcc

SEQ ID NO: 59892 - DNA, 20 bp, Human adenovirus
gcgtggacgcgcgccttcgt

SEQ ID NO: 59893 - DNA, 20 bp, Human adenovirus
gtctcagagtggtccgagtt

SEQ ID NO: 59894 - DNA, 20 bp, Human adenovirus
ctttacgaggaggaccgcgg

SEQ ID NO: 59895 - DNA, 20 bp, Human adenovirus
cctctcaagagcgggcataa

SEQ ID NO: 59896 - DNA, 20 bp, Human adenovirus
tcagtttctagaaacgagga

SEQ ID NO: 59897 - DNA, 20 bp, Human adenovirus
ctagaaacgaggaggatttg

SEQ ID NO: 59898 - DNA, 20 bp, Human adenovirus
tagaaacgaggaggatttga

SEQ ID NO: 59899 - DNA, 20 bp, Human adenovirus
gatgttggcctgccctgccg

SEQ ID NO: 59900 - DNA, 20 bp, Human adenovirus
gggaaaaacagtggtgcgct

SEQ ID NO: 59901 - DNA, 20 bp, Human adenovirus
tgcagggtgaccaggtccac

SEQ ID NO: 59902 - DNA, 20 bp, Human adenovirus
tgcccgacgagcgcaccact

SEQ ID NO: 59903 - DNA, 20 bp, Human adenovirus
gccccgccttcttggcaccc

SEQ ID NO: 59904 - DNA, 20 bp, Human adenovirus
ttggcaccctcgcatgagtt

SEQ ID NO: 59905 - DNA, 20 bp, Human adenovirus
gcaccctcgcatgagttgta

SEQ ID NO: 59906 - DNA, 20 bp, Human adenovirus
tatgactacgtgcgcgccag

SEQ ID NO: 59907 - DNA, 20 bp, Human adenovirus
tcccacctacatcggcatcc

SEQ ID NO: 59908 - DNA, 20 bp, Human adenovirus
tccacggggagggcgtaagc

SEQ ID NO: 59909 - DNA, 20 bp, Human adenovirus
agcggccttgcggagcgagg

SEQ ID NO: 59910 - DNA, 20 bp, Human adenovirus
cggagcgaggtgtgcgtcag

SEQ ID NO: 59911 - DNA, 20 bp, Human adenovirus
aagtaccagtttttgaaagt

SEQ ID NO: 59912 - DNA, 20 bp, Human adenovirus
agtaccagtttttgaaagtc

SEQ ID NO: 59913 - DNA, 20 bp, Human adenovirus
atgttgtgcccgacaatgta

SEQ ID NO: 59914 - DNA, 20 bp, Human adenovirus
tgcccgacaatgtatagttc

SEQ ID NO: 59915 - DNA, 20 bp, Human adenovirus
catgaatcgcgggcggcctt

SEQ ID NO: 59916 - DNA, 20 bp, Human adenovirus
gatgtgcggcagctttttaa

SEQ ID NO: 59917 - DNA, 20 bp, Human adenovirus
atgtgcggcagctttttaag

SEQ ID NO: 59918 - DNA, 20 bp, Human adenovirus
gggtccccggagaatttcat

SEQ ID NO: 59919 - DNA, 20 bp, Human adenovirus
catgaccagcatgaagggga

SEQ ID NO: 59920 - DNA, 20 bp, Human adenovirus
atgaccagcatgaaggggac

SEQ ID NO: 59921 - DNA, 20 bp, Human adenovirus
ccgaaggaccccatccaggt

SEQ ID NO: 59922 - DNA, 20 bp, Human adenovirus
ggcaagcagcttgtcccctt

SEQ ID NO: 59923 - DNA, 20 bp, Human adenovirus
aggaggaacttcaggagtgg

SEQ ID NO: 59924 - DNA, 20 bp, Human adenovirus
aggagtggcggccctggctg

SEQ ID NO: 59925 - DNA, 20 bp, Human adenovirus
tcatgttcgcctgcgtagga

SEQ ID NO: 59926 - DNA, 20 bp, Human adenovirus
catgttcgcctgcgtaggac

SEQ ID NO: 59927 - DNA, 20 bp, Human adenovirus
atgttcgcctgcgtaggact

SEQ ID NO: 59928 - DNA, 20 bp, Human adenovirus
gaacctgaaagacagttcaa

SEQ ID NO: 59929 - DNA, 20 bp, Human adenovirus
aacctgaaagacagttcaac

SEQ ID NO: 59930 - DNA, 20 bp, Human adenovirus
aacagaatcaatctcggcgt

SEQ ID NO: 59931 - DNA, 20 bp, Human adenovirus
acggcggcctgccgcaggat

SEQ ID NO: 59932 - DNA, 20 bp, Human adenovirus
attctgttgaactgtctttc

SEQ ID NO: 59933 - DNA, 20 bp, Human adenovirus
agctccacgtgccgcgtaaa

SEQ ID NO: 59934 - DNA, 20 bp, Human adenovirus
cgcaggcgctgaaaaaggta

SEQ ID NO: 59935 - DNA, 20 bp, Human adenovirus
agggtggtggcgatgtgctc

SEQ ID NO: 59936 - DNA, 20 bp, Human adenovirus
tttgtcaccgagcacatcgc

SEQ ID NO: 59937 - DNA, 20 bp, Human adenovirus
gtcaccgagcacatcgccac

SEQ ID NO: 59938 - DNA, 20 bp, Human adenovirus
ttcctcttccatgacgacct

SEQ ID NO: 59939 - DNA, 20 bp, Human adenovirus
ctcttccatgacgacctctt

SEQ ID NO: 59940 - DNA, 20 bp, Human adenovirus
catgacgacctcttcttcta

SEQ ID NO: 59941 - DNA, 20 bp, Human adenovirus
ttctatttcctctgggggcg

SEQ ID NO: 59942 - DNA, 20 bp, Human adenovirus
tatttcctctgggggcggtg

SEQ ID NO: 59943 - DNA, 20 bp, Human adenovirus
tcaattgcggcgtaggggac

SEQ ID NO: 59944 - DNA, 20 bp, Human adenovirus
cggcgtaggggacgtaagcg

SEQ ID NO: 59945 - DNA, 20 bp, Human adenovirus
ggaggaaagcgtctagccaa

SEQ ID NO: 59946 - DNA, 20 bp, Human adenovirus
gaggaaagcgtctagccaat

SEQ ID NO: 59947 - DNA, 20 bp, Human adenovirus
aacacgtagcagccctgtgg

SEQ ID NO: 59948 - DNA, 20 bp, Human adenovirus
catgcgggtaaccccaacgc

SEQ ID NO: 59949 - DNA, 20 bp, Human adenovirus
cacgcgggtgagggtgtctt

SEQ ID NO: 59950 - DNA, 20 bp, Human adenovirus
caagacaccctcacccgcgt

SEQ ID NO: 59951 - DNA, 20 bp, Human adenovirus
ccgagcgcgtcgtcgccgac

SEQ ID NO: 59952 - DNA, 20 bp, Human adenovirus
gggttacccgcatggaagac

SEQ ID NO: 59953 - DNA, 20 bp, Human adenovirus
ccgcgcgcctccaccaccgc

SEQ ID NO: 59954 - DNA, 20 bp, Human adenovirus
cctggatgtcccgctacctc

SEQ ID NO: 59955 - DNA, 20 bp, Human adenovirus
ggccgcgcgtgtaccccggt

SEQ ID NO: 59956 - DNA, 20 bp, Human adenovirus
gagtcccctcgaatcaggct

SEQ ID NO: 59957 - DNA, 20 bp, Human adenovirus
gcactcccgtctcgacccaa

SEQ ID NO: 59958 - DNA, 20 bp, Human adenovirus
ggtcgagacgggagtgccaa

SEQ ID NO: 59959 - DNA, 20 bp, Human adenovirus
gtcgcggctttagcctgatt

SEQ ID NO: 59960 - DNA, 20 bp, Human adenovirus
gcagacggccgcggcgagcg

SEQ ID NO: 59961 - DNA, 20 bp, Human adenovirus
tttcttttgccagatgcatc

SEQ ID NO: 59962 - DNA, 20 bp, Human adenovirus
ttcttttgccagatgcatcc

SEQ ID NO: 59963 - DNA, 20 bp, Human adenovirus
tcttttgccagatgcatccc

SEQ ID NO: 59964 - DNA, 20 bp, Human adenovirus
cttttgccagatgcatcccg

SEQ ID NO: 59965 - DNA, 20 bp, Human adenovirus
caaaagagtttcaacaacca

SEQ ID NO: 59966 - DNA, 20 bp, Human adenovirus
caacaaccacgtgcgcaccc

SEQ ID NO: 59967 - DNA, 20 bp, Human adenovirus
aacaaccacgtgcgcaccct

SEQ ID NO: 59968 - DNA, 20 bp, Human adenovirus
cgcgcgaggaggtggccctg

SEQ ID NO: 59969 - DNA, 20 bp, Human adenovirus
ttgaaactcttttggaagtt

SEQ ID NO: 59970 - DNA, 20 bp, Human adenovirus
tacgcgcgcaagatttacaa

SEQ ID NO: 59971 - DNA, 20 bp, Human adenovirus
acgcgcgcaagatttacaag

SEQ ID NO: 59972 - DNA, 20 bp, Human adenovirus
cgcgcgcaagatttacaaga

SEQ ID NO: 59973 - DNA, 20 bp, Human adenovirus
acaagacgccgtacgtgccc

SEQ ID NO: 59974 - DNA, 20 bp, Human adenovirus
caagacgccgtacgtgccca

SEQ ID NO: 59975 - DNA, 20 bp, Human adenovirus
ttagatgtcccagcagcaag

SEQ ID NO: 59976 - DNA, 20 bp, Human adenovirus
tagatgtcccagcagcaagc

SEQ ID NO: 59977 - DNA, 20 bp, Human adenovirus
agatgtcccagcagcaagcc

SEQ ID NO: 59978 - DNA, 20 bp, Human adenovirus
gatgtcccagcagcaagccc

SEQ ID NO: 59979 - DNA, 20 bp, Human adenovirus
gcagcgccgcccttatggcg

SEQ ID NO: 59980 - DNA, 20 bp, Human adenovirus
gactgcacgttcgtgctgtt

SEQ ID NO: 59981 - DNA, 20 bp, Human adenovirus
gtgctgttgtagcggcccac

SEQ ID NO: 59982 - DNA, 20 bp, Human adenovirus
tagcggcccacgcgctccag

SEQ ID NO: 59983 - DNA, 20 bp, Human adenovirus
tacaccagcccggcctcgtc

SEQ ID NO: 59984 - DNA, 20 bp, Human adenovirus
caagaacctacgcgggctgt

SEQ ID NO: 59985 - DNA, 20 bp, Human adenovirus
aagaacctacgcgggctgtg

SEQ ID NO: 59986 - DNA, 20 bp, Human adenovirus
ttgacgcccaactcgcggct

SEQ ID NO: 59987 - DNA, 20 bp, Human adenovirus
acgcccaactcgcggctgct

SEQ ID NO: 59988 - DNA, 20 bp, Human adenovirus
ggcgtcaacaagctgctcac

SEQ ID NO: 59989 - DNA, 20 bp, Human adenovirus
ctgctgaccaatagacagca

SEQ ID NO: 59990 - DNA, 20 bp, Human adenovirus
cgccgcagtacgcactgtcg

SEQ ID NO: 59991 - DNA, 20 bp, Human adenovirus
tgagatatgtgcagcagagc

SEQ ID NO: 59992 - DNA, 20 bp, Human adenovirus
cttcctcggccgacagtgcg

SEQ ID NO: 59993 - DNA, 20 bp, Human adenovirus
ttcctcggccgacagtgcgt

SEQ ID NO: 59994 - DNA, 20 bp, Human adenovirus
accaatgccatcttgaaccc

SEQ ID NO: 59995 - DNA, 20 bp, Human adenovirus
ccaatgccatcttgaacccg

SEQ ID NO: 59996 - DNA, 20 bp, Human adenovirus
aacccgcattggctcccgcc

SEQ ID NO: 59997 - DNA, 20 bp, Human adenovirus
gctcccgccgccagggttct

SEQ ID NO: 59998 - DNA, 20 bp, Human adenovirus
tacacgggcgagtacgacat

SEQ ID NO: 59999 - DNA, 20 bp, Human adenovirus
cagcggtttagtttgtccac

SEQ ID NO: 60000 - DNA, 20 bp, Human adenovirus
agtttgtccaccagactttc

SEQ ID NO: 60001 - DNA, 20 bp, Human adenovirus
gtttgtccaccagactttct

SEQ ID NO: 60002 - DNA, 20 bp, Human adenovirus
gtccaccagactttctatcc

SEQ ID NO: 60003 - DNA, 20 bp, Human adenovirus
tccaccagactttctatccc

SEQ ID NO: 60004 - DNA, 20 bp, Human adenovirus
cgtttgtgcctccgcggtat

SEQ ID NO: 60005 - DNA, 20 bp, Human adenovirus
gtgcctccgcggtatatggc

SEQ ID NO: 60006 - DNA, 20 bp, Human adenovirus
tgcctccgcggtatatggct

SEQ ID NO: 60007 - DNA, 20 bp, Human adenovirus
cctgcgccatcacgctctcg

SEQ ID NO: 60008 - DNA, 20 bp, Human adenovirus
gagtcaagtttgacagcaga

SEQ ID NO: 60009 - DNA, 20 bp, Human adenovirus
gacagcagaaatttcaagct

SEQ ID NO: 60010 - DNA, 20 bp, Human adenovirus
acagcagaaatttcaagctg

SEQ ID NO: 60011 - DNA, 20 bp, Human adenovirus
caagctgggctgggacccgg

SEQ ID NO: 60012 - DNA, 20 bp, Human adenovirus
aagctgggctgggacccggt

SEQ ID NO: 60013 - DNA, 20 bp, Human adenovirus
atgctcctgcaagaggagat

SEQ ID NO: 60014 - DNA, 20 bp, Human adenovirus
tctacagctcttgggacact

SEQ ID NO: 60015 - DNA, 20 bp, Human adenovirus
ctacagctcttgggacactg

SEQ ID NO: 60016 - DNA, 20 bp, Human adenovirus
tacagctcttgggacactgc

SEQ ID NO: 60017 - DNA, 20 bp, Human adenovirus
ggacactgctatctcctctt

SEQ ID NO: 60018 - DNA, 20 bp, Human adenovirus
cgctccacccagcaagtcag

SEQ ID NO: 60019 - DNA, 20 bp, Human adenovirus
gctccacccagcaagtcagc

SEQ ID NO: 60020 - DNA, 20 bp, Human adenovirus
gcgccgagctcatgcccttc

SEQ ID NO: 60021 - DNA, 20 bp, Human adenovirus
tggcgcggaagggcatgagc

SEQ ID NO: 60022 - DNA, 20 bp, Human adenovirus
ggcgcggaagggcatgagct

SEQ ID NO: 60023 - DNA, 20 bp, Human adenovirus
tagaaaatgtccattctcat

SEQ ID NO: 60024 - DNA, 20 bp, Human adenovirus
tctagaaggtgcgactggag

SEQ ID NO: 60025 - DNA, 20 bp, Human adenovirus
ctagaaggtgcgactggaga

SEQ ID NO: 60026 - DNA, 20 bp, Human adenovirus
tagaaggtgcgactggagag

SEQ ID NO: 60027 - DNA, 20 bp, Human adenovirus
tagacgtagggacaggtgcg

SEQ ID NO: 60028 - DNA, 20 bp, Human adenovirus
actccgtagtcgctgacgcg

SEQ ID NO: 60029 - DNA, 20 bp, Human adenovirus
cgcgcgtcagcgactacgga

SEQ ID NO: 60030 - DNA, 20 bp, Human adenovirus
ccgccgccgcggccatctct

SEQ ID NO: 60031 - DNA, 20 bp, Human adenovirus
ccgcgcctgggtctggtcat

SEQ ID NO: 60032 - DNA, 20 bp, Human adenovirus
cgcgcctgggtctggtcatg

SEQ ID NO: 60033 - DNA, 20 bp, Human adenovirus
gaaggggcgcagggtgcagc

SEQ ID NO: 60034 - DNA, 20 bp, Human adenovirus
cggcccggcacggcggtggt

SEQ ID NO: 60035 - DNA, 20 bp, Human adenovirus
acgcccggcgagcggtcctc

SEQ ID NO: 60036 - DNA, 20 bp, Human adenovirus
cgcccggcgagcggtcctcg

SEQ ID NO: 60037 - DNA, 20 bp, Human adenovirus
caatttacgcgccgccgcgg

SEQ ID NO: 60038 - DNA, 20 bp, Human adenovirus
aggtgcgccccattaagcag

SEQ ID NO: 60039 - DNA, 20 bp, Human adenovirus
agcaggtggcgccgggcctg

SEQ ID NO: 60040 - DNA, 20 bp, Human adenovirus
atggggcgcaccttaacctc

SEQ ID NO: 60041 - DNA, 20 bp, Human adenovirus
acctcgggctccacatccat

SEQ ID NO: 60042 - DNA, 20 bp, Human adenovirus
tcacggtgtccagcacgtcc

SEQ ID NO: 60043 - DNA, 20 bp, Human adenovirus
acatccacggccaccgagcc

SEQ ID NO: 60044 - DNA, 20 bp, Human adenovirus
catccacggccaccgagcct

SEQ ID NO: 60045 - DNA, 20 bp, Human adenovirus
caggaggcgaagatggggcc

SEQ ID NO: 60046 - DNA, 20 bp, Human adenovirus
ggcatcagccggttggcagg

SEQ ID NO: 60047 - DNA, 20 bp, Human adenovirus
gcagggccccatcttcgcct

SEQ ID NO: 60048 - DNA, 20 bp, Human adenovirus
ccgcctgcgcattcccgtcc

SEQ ID NO: 60049 - DNA, 20 bp, Human adenovirus
ccgtcccgaattaccgagga

SEQ ID NO: 60050 - DNA, 20 bp, Human adenovirus
ccgaggaagatcccgccgca

SEQ ID NO: 60051 - DNA, 20 bp, Human adenovirus
aggccgctgcctgccatgcc

SEQ ID NO: 60052 - DNA, 20 bp, Human adenovirus
ggccgctgcctgccatgcct

SEQ ID NO: 60053 - DNA, 20 bp, Human adenovirus
atgggcacctggaacgagat

SEQ ID NO: 60054 - DNA, 20 bp, Human adenovirus
aattggagcagtgtctggag

SEQ ID NO: 60055 - DNA, 20 bp, Human adenovirus
gagcagtgtctggagcgggc

SEQ ID NO: 60056 - DNA, 20 bp, Human adenovirus
ttaagcccgctccagacact

SEQ ID NO: 60057 - DNA, 20 bp, Human adenovirus
taagcccgctccagacactg

SEQ ID NO: 60058 - DNA, 20 bp, Human adenovirus
tcgcccctgggcggaggagt

SEQ ID NO: 60059 - DNA, 20 bp, Human adenovirus
catcttccatctccaccacc

SEQ ID NO: 60060 - DNA, 20 bp, Human adenovirus
catctccaccaccgtgggcg

SEQ ID NO: 60061 - DNA, 20 bp, Human adenovirus
agacttttcactcccaggcc

SEQ ID NO: 60062 - DNA, 20 bp, Human adenovirus
tcactcccaggcccacgata

SEQ ID NO: 60063 - DNA, 20 bp, Human adenovirus
cactcccaggcccacgatac

SEQ ID NO: 60064 - DNA, 20 bp, Human adenovirus
actcccaggcccacgatact

SEQ ID NO: 60065 - DNA, 20 bp, Human adenovirus
tgggcctggcggcgggcggg

SEQ ID NO: 60066 - DNA, 20 bp, Human adenovirus
gcccgcgccaccgacacgta

SEQ ID NO: 60067 - DNA, 20 bp, Human adenovirus
cccgcgccaccgacacgtac

SEQ ID NO: 60068 - DNA, 20 bp, Human adenovirus
agcctgggcaacaagtttag

SEQ ID NO: 60069 - DNA, 20 bp, Human adenovirus
agaaaccccacggtggctcc

SEQ ID NO: 60070 - DNA, 20 bp, Human adenovirus
gaaaccccacggtggctccc

SEQ ID NO: 60071 - DNA, 20 bp, Human adenovirus
agggtctgcaaattggtgtt

SEQ ID NO: 60072 - DNA, 20 bp, Human adenovirus
gtgttgacaaaactgaaaac

SEQ ID NO: 60073 - DNA, 20 bp, Human adenovirus
acaaaactgaaaacaaaaat

SEQ ID NO: 60074 - DNA, 20 bp, Human adenovirus
ttgttttcagttttgtcaac

SEQ ID NO: 60075 - DNA, 20 bp, Human adenovirus
tgttttcagttttgtcaaca

SEQ ID NO: 60076 - DNA, 20 bp, Human adenovirus
ccagcttttgctagattctc

SEQ ID NO: 60077 - DNA, 20 bp, Human adenovirus
tgctagattctctgggtgac

SEQ ID NO: 60078 - DNA, 20 bp, Human adenovirus
gctagattctctgggtgaca

SEQ ID NO: 60079 - DNA, 20 bp, Human adenovirus
ctagattctctgggtgacag

SEQ ID NO: 60080 - DNA, 20 bp, Human adenovirus
tctgggtgacagaaccagat

SEQ ID NO: 60081 - DNA, 20 bp, Human adenovirus
aagtacacgccggccaacgt

SEQ ID NO: 60082 - DNA, 20 bp, Human adenovirus
agtacacgccggccaacgtc

SEQ ID NO: 60083 - DNA, 20 bp, Human adenovirus
atgtactcgtaggtgttggt

SEQ ID NO: 60084 - DNA, 20 bp, Human adenovirus
gtgttggtgggcagtgtgac

SEQ ID NO: 60085 - DNA, 20 bp, Human adenovirus
gtgggcagtgtgacgttggc

SEQ ID NO: 60086 - DNA, 20 bp, Human adenovirus
cgcaaggacgtcaacatgat

SEQ ID NO: 60087 - DNA, 20 bp, Human adenovirus
cctgggcaacgacctgcgcg

SEQ ID NO: 60088 - DNA, 20 bp, Human adenovirus
gacagtgtgaacctctacgc

SEQ ID NO: 60089 - DNA, 20 bp, Human adenovirus
acagtgtgaacctctacgcc

SEQ ID NO: 60090 - DNA, 20 bp, Human adenovirus
acactgtcaaagcggacgga

SEQ ID NO: 60091 - DNA, 20 bp, Human adenovirus
cgccgaacgagttcgagatt

SEQ ID NO: 60092 - DNA, 20 bp, Human adenovirus
gagattaagcgcagcgtcga

SEQ ID NO: 60093 - DNA, 20 bp, Human adenovirus
agcgcagcgtcgacggggag

SEQ ID NO: 60094 - DNA, 20 bp, Human adenovirus
cttatccagatgctttccca

SEQ ID NO: 60095 - DNA, 20 bp, Human adenovirus
tccagatgctttcccactac

SEQ ID NO: 60096 - DNA, 20 bp, Human adenovirus
accggctacctcgcacctac

SEQ ID NO: 60097 - DNA, 20 bp, Human adenovirus
ccctacccgcttattggaga

SEQ ID NO: 60098 - DNA, 20 bp, Human adenovirus
gcggggtagggctgcccctg

SEQ ID NO: 60099 - DNA, 20 bp, Human adenovirus
tccgccggcaacgccaccac

SEQ ID NO: 60100 - DNA, 20 bp, Human adenovirus
ttcgctggagccgctcatgc

SEQ ID NO: 60101 - DNA, 20 bp, Human adenovirus
gctggagccgctcatgctta

SEQ ID NO: 60102 - DNA, 20 bp, Human adenovirus
ggtggtggcgttgccggcgg

SEQ ID NO: 60103 - DNA, 20 bp, Human adenovirus
ccggcggagaagggcgtgcg

SEQ ID NO: 60104 - DNA, 20 bp, Human adenovirus
gacccctttgggttttcgga

SEQ ID NO: 60105 - DNA, 20 bp, Human adenovirus
acccctttgggttttcggac

SEQ ID NO: 60106 - DNA, 20 bp, Human adenovirus
gggttttcggaccgccggct

SEQ ID NO: 60107 - DNA, 20 bp, Human adenovirus
ggttttcggaccgccggctt

SEQ ID NO: 60108 - DNA, 20 bp, Human adenovirus
tcggaccgccggcttaagca

SEQ ID NO: 60109 - DNA, 20 bp, Human adenovirus
ctaacgggggtgcccaatgg

SEQ ID NO: 60110 - DNA, 20 bp, Human adenovirus
cgccggagggtgggcagcac

SEQ ID NO: 60111 - DNA, 20 bp, Human adenovirus
tagcatgccattgggcaccc

SEQ ID NO: 60112 - DNA, 20 bp, Human adenovirus
ggcacccccgttagcaagtt

SEQ ID NO: 60113 - DNA, 20 bp, Human adenovirus
aactcggggatcaccagttt

SEQ ID NO: 60114 - DNA, 20 bp, Human adenovirus
gggaacagcaatctcgggga

SEQ ID NO: 60115 - DNA, 20 bp, Human adenovirus
ggaacagcaatctcggggaa

SEQ ID NO: 60116 - DNA, 20 bp, Human adenovirus
taaaatttcagccccggaca

SEQ ID NO: 60117 - DNA, 20 bp, Human adenovirus
aaaatttcagccccggacat

SEQ ID NO: 60118 - DNA, 20 bp, Human adenovirus
cactcgcagtgcacgggcat

SEQ ID NO: 60119 - DNA, 20 bp, Human adenovirus
gcatcatccctgcgccgcgc

SEQ ID NO: 60120 - DNA, 20 bp, Human adenovirus
gggtacagggccttaataaa

SEQ ID NO: 60121 - DNA, 20 bp, Human adenovirus
ataaaggccataatctgctt

SEQ ID NO: 60122 - DNA, 20 bp, Human adenovirus
aaagcttgctgggccttggc

SEQ ID NO: 60123 - DNA, 20 bp, Human adenovirus
tggatcattaccgtcccgtg

SEQ ID NO: 60124 - DNA, 20 bp, Human adenovirus
ccgtcccgtgcagacacttg

SEQ ID NO: 60125 - DNA, 20 bp, Human adenovirus
agctggccttccacctcggc

SEQ ID NO: 60126 - DNA, 20 bp, Human adenovirus
cacctcggcacagccgtggt

SEQ ID NO: 60127 - DNA, 20 bp, Human adenovirus
taagcatcgcgcaggccgct

SEQ ID NO: 60128 - DNA, 20 bp, Human adenovirus
catcagcacgttcatggtat

SEQ ID NO: 60129 - DNA, 20 bp, Human adenovirus
atggtatccatgcccttctc

SEQ ID NO: 60130 - DNA, 20 bp, Human adenovirus
tcccaggacgaaaccaaagg

SEQ ID NO: 60131 - DNA, 20 bp, Human adenovirus
ggtttcgtcctgggagaagg

SEQ ID NO: 60132 - DNA, 20 bp, Human adenovirus
ttttttggagggctgtccag

SEQ ID NO: 60133 - DNA, 20 bp, Human adenovirus
tttggagggctgtccagtgg

SEQ ID NO: 60134 - DNA, 20 bp, Human adenovirus
ttggagggctgtccagtgga

SEQ ID NO: 60135 - DNA, 20 bp, Human adenovirus
tggagggctgtccagtggaa

SEQ ID NO: 60136 - DNA, 20 bp, Human adenovirus
ggagggctgtccagtggaac

SEQ ID NO: 60137 - DNA, 20 bp, Human adenovirus
gaagagccggctcgtctaga

SEQ ID NO: 60138 - DNA, 20 bp, Human adenovirus
gtttccttctgttcatcctg

SEQ ID NO: 60139 - DNA, 20 bp, Human adenovirus
ccttctgttcatcctgtggg

SEQ ID NO: 60140 - DNA, 20 bp, Human adenovirus
cttctgttcatcctgtgggg

SEQ ID NO: 60141 - DNA, 20 bp, Human adenovirus
tgttcatcctgtgggggttc

SEQ ID NO: 60142 - DNA, 20 bp, Human adenovirus
gaaggcgataacgccaggct

SEQ ID NO: 60143 - DNA, 20 bp, Human adenovirus
agcgcagcgtcgagctcacc

SEQ ID NO: 60144 - DNA, 20 bp, Human adenovirus
tgcctaccccgccgttaacc

SEQ ID NO: 60145 - DNA, 20 bp, Human adenovirus
gcctaccccgccgttaacct

SEQ ID NO: 60146 - DNA, 20 bp, Human adenovirus
cctaccccgccgttaacctc

SEQ ID NO: 60147 - DNA, 20 bp, Human adenovirus
tttagcgaccccgagaccct

SEQ ID NO: 60148 - DNA, 20 bp, Human adenovirus
ttagcgaccccgagaccctg

SEQ ID NO: 60149 - DNA, 20 bp, Human adenovirus
tagcgaccccgagaccctgc

SEQ ID NO: 60150 - DNA, 20 bp, Human adenovirus
agcgaccccgagaccctgcg

SEQ ID NO: 60151 - DNA, 20 bp, Human adenovirus
gcgaccccgagaccctgcgc

SEQ ID NO: 60152 - DNA, 20 bp, Human adenovirus
ttgctaaaaaccttaaaacg

SEQ ID NO: 60153 - DNA, 20 bp, Human adenovirus
ctaaaaaccttaaaacgttg

SEQ ID NO: 60154 - DNA, 20 bp, Human adenovirus
aaacgttgtggacgggcttt

SEQ ID NO: 60155 - DNA, 20 bp, Human adenovirus
tggacgggctttgacgagcg

SEQ ID NO: 60156 - DNA, 20 bp, Human adenovirus
gacgagcgcaccgtcgcctt

SEQ ID NO: 60157 - DNA, 20 bp, Human adenovirus
cctaccactcggacgtgatc

SEQ ID NO: 60158 - DNA, 20 bp, Human adenovirus
agtgccactgccgctgcaac

SEQ ID NO: 60159 - DNA, 20 bp, Human adenovirus
cagcggcagtggcactcaag

SEQ ID NO: 60160 - DNA, 20 bp, Human adenovirus
cgtcctcgatcacgtccgag

SEQ ID NO: 60161 - DNA, 20 bp, Human adenovirus
cggcctgcgtcatcacccag

SEQ ID NO: 60162 - DNA, 20 bp, Human adenovirus
cacgccatccaaaaatcccg

SEQ ID NO: 60163 - DNA, 20 bp, Human adenovirus
ttcagaagaaactcttggcg

SEQ ID NO: 60164 - DNA, 20 bp, Human adenovirus
tcagaagaaactcttggcgg

SEQ ID NO: 60165 - DNA, 20 bp, Human adenovirus
cagaagaaactcttggcggg

SEQ ID NO: 60166 - DNA, 20 bp, Human adenovirus
ccgtcaccctttactcgatc

SEQ ID NO: 60167 - DNA, 20 bp, Human adenovirus
actcgatcccatctacgagg

SEQ ID NO: 60168 - DNA, 20 bp, Human adenovirus
ctcgatcccatctacgagga

SEQ ID NO: 60169 - DNA, 20 bp, Human adenovirus
accggaggggctgccggcgc

SEQ ID NO: 60170 - DNA, 20 bp, Human adenovirus
cccactctttatgccatttt

SEQ ID NO: 60171 - DNA, 20 bp, Human adenovirus
atgccatttttcagcagagt

SEQ ID NO: 60172 - DNA, 20 bp, Human adenovirus
tgccatttttcagcagagtc

SEQ ID NO: 60173 - DNA, 20 bp, Human adenovirus
ttcagcagagtcgaggtcag

SEQ ID NO: 60174 - DNA, 20 bp, Human adenovirus
tcagcagagtcgaggtcagc

SEQ ID NO: 60175 - DNA, 20 bp, Human adenovirus
ccggtgtccgcccagacccg

SEQ ID NO: 60176 - DNA, 20 bp, Human adenovirus
ggtataaaaacactgctgat

SEQ ID NO: 60177 - DNA, 20 bp, Human adenovirus
ttatacctaagtcgggtctg

SEQ ID NO: 60178 - DNA, 20 bp, Human adenovirus
tatacctaagtcgggtctgg

SEQ ID NO: 60179 - DNA, 20 bp, Human adenovirus
atacctaagtcgggtctggg

SEQ ID NO: 60180 - DNA, 20 bp, Human adenovirus
tgccctcggtttactttaac

SEQ ID NO: 60181 - DNA, 20 bp, Human adenovirus
actttaaccccttttcaggc

SEQ ID NO: 60182 - DNA, 20 bp, Human adenovirus
ctttaaccccttttcaggct

SEQ ID NO: 60183 - DNA, 20 bp, Human adenovirus
aaccccttttcaggctcccc

SEQ ID NO: 60184 - DNA, 20 bp, Human adenovirus
accccttttcaggctcccca

SEQ ID NO: 60185 - DNA, 20 bp, Human adenovirus
ttgctgtactctttgtggtg

SEQ ID NO: 60186 - DNA, 20 bp, Human adenovirus
tgctgtactctttgtggtga

SEQ ID NO: 60187 - DNA, 20 bp, Human adenovirus
gctgtactctttgtggtgag

SEQ ID NO: 60188 - DNA, 20 bp, Human adenovirus
ctgtactctttgtggtgagt

SEQ ID NO: 60189 - DNA, 20 bp, Human adenovirus
gtggtgagtttaataaaagc

SEQ ID NO: 60190 - DNA, 20 bp, Human adenovirus
cggggaggaaccatgaaggg

SEQ ID NO: 60191 - DNA, 20 bp, Human adenovirus
tgctaattatcctttccctg

SEQ ID NO: 60192 - DNA, 20 bp, Human adenovirus
gctaattatcctttccctgg

SEQ ID NO: 60193 - DNA, 20 bp, Human adenovirus
ctaattatcctttccctggt

SEQ ID NO: 60194 - DNA, 20 bp, Human adenovirus
tcctttccctggtggggggt

SEQ ID NO: 60195 - DNA, 20 bp, Human adenovirus
ggttttctttggcttttgta

SEQ ID NO: 60196 - DNA, 20 bp, Human adenovirus
tctttggcttttgtaattat

SEQ ID NO: 60197 - DNA, 20 bp, Human adenovirus
ctttggcttttgtaattatg

SEQ ID NO: 60198 - DNA, 20 bp, Human adenovirus
tttggcttttgtaattatgg

SEQ ID NO: 60199 - DNA, 20 bp, Human adenovirus
ggcttttgtaattatggcct

SEQ ID NO: 60200 - DNA, 20 bp, Human adenovirus
tgtgatggaaatacaattaa

SEQ ID NO: 60201 - DNA, 20 bp, Human adenovirus
gtgatggaaatacaattaaa

SEQ ID NO: 60202 - DNA, 20 bp, Human adenovirus
tgatggaaatacaattaaaa

SEQ ID NO: 60203 - DNA, 20 bp, Human adenovirus
aaaacccacaaatcaagcat

SEQ ID NO: 60204 - DNA, 20 bp, Human adenovirus
acttaatgctgacaagtctc

SEQ ID NO: 60205 - DNA, 20 bp, Human adenovirus
caaaacggggctaaacaaag

SEQ ID NO: 60206 - DNA, 20 bp, Human adenovirus
aaaacggggctaaacaaagt

SEQ ID NO: 60207 - DNA, 20 bp, Human adenovirus
aacaaagtaatattggacaa

SEQ ID NO: 60208 - DNA, 20 bp, Human adenovirus
gacaaggtaatactgctcaa

SEQ ID NO: 60209 - DNA, 20 bp, Human adenovirus
agccaacacaattgtatgtt

SEQ ID NO: 60210 - DNA, 20 bp, Human adenovirus
aaattaagccacataccaaa

SEQ ID NO: 60211 - DNA, 20 bp, Human adenovirus
agccacataccaaagaacct

SEQ ID NO: 60212 - DNA, 20 bp, Human adenovirus
caattacaagttgcagaaac

SEQ ID NO: 60213 - DNA, 20 bp, Human adenovirus
aattacaagttgcagaaact

SEQ ID NO: 60214 - DNA, 20 bp, Human adenovirus
caagttgcagaaactgatca

SEQ ID NO: 60215 - DNA, 20 bp, Human adenovirus
cttttctggttatctgtggg

SEQ ID NO: 60216 - DNA, 20 bp, Human adenovirus
tctggttatctgtgggatct

SEQ ID NO: 60217 - DNA, 20 bp, Human adenovirus
ctggttatctgtgggatctt

SEQ ID NO: 60218 - DNA, 20 bp, Human adenovirus
tggttatctgtgggatcttt

SEQ ID NO: 60219 - DNA, 20 bp, Human adenovirus
tctgtgggatctttattctc

SEQ ID NO: 60220 - DNA, 20 bp, Human adenovirus
tctttgccctgctcacctgc

SEQ ID NO: 60221 - DNA, 20 bp, Human adenovirus
gccctgctcacctgcacctg

SEQ ID NO: 60222 - DNA, 20 bp, Human adenovirus
ccctgctcacctgcacctgc

SEQ ID NO: 60223 - DNA, 20 bp, Human adenovirus
tctgcctggtcattaccttc

SEQ ID NO: 60224 - DNA, 20 bp, Human adenovirus
ccttcctgcagcttatcgac

SEQ ID NO: 60225 - DNA, 20 bp, Human adenovirus
ctttgctattatgatctacc

SEQ ID NO: 60226 - DNA, 20 bp, Human adenovirus
tttgctattatgatctaccc

SEQ ID NO: 60227 - DNA, 20 bp, Human adenovirus
gctattatgatctacccctg

SEQ ID NO: 60228 - DNA, 20 bp, Human adenovirus
ctattatgatctacccctgt

SEQ ID NO: 60229 - DNA, 20 bp, Human adenovirus
tgatctacccctgttttgat

SEQ ID NO: 60230 - DNA, 20 bp, Human adenovirus
acctgcatggtgggcgtcaa

SEQ ID NO: 60231 - DNA, 20 bp, Human adenovirus
ctcctgcgaaagccccgagt

SEQ ID NO: 60232 - DNA, 20 bp, Human adenovirus
cgcaggagcaatggatacag

SEQ ID NO: 60233 - DNA, 20 bp, Human adenovirus
gcaggagcaatggatacagc

SEQ ID NO: 60234 - DNA, 20 bp, Human adenovirus
cgcccgtctgctgggtgatg

SEQ ID NO: 60235 - DNA, 20 bp, Human adenovirus
gtctcctccaatggattcca

SEQ ID NO: 60236 - DNA, 20 bp, Human adenovirus
tctcctccaatggattccaa

SEQ ID NO: 60237 - DNA, 20 bp, Human adenovirus
caaaacttcccccctggggt

SEQ ID NO: 60238 - DNA, 20 bp, Human adenovirus
ccccctggggttctgtcact

SEQ ID NO: 60239 - DNA, 20 bp, Human adenovirus
tgtcactcaaactggctaac

SEQ ID NO: 60240 - DNA, 20 bp, Human adenovirus
cagaaggcggtggcttatca

SEQ ID NO: 60241 - DNA, 20 bp, Human adenovirus
tcatttaatgataatggaga

SEQ ID NO: 60242 - DNA, 20 bp, Human adenovirus
aatgataatggagacttggt

SEQ ID NO: 60243 - DNA, 20 bp, Human adenovirus
atgataatggagacttggta

SEQ ID NO: 60244 - DNA, 20 bp, Human adenovirus
gtagcatttaataaaaaaga

SEQ ID NO: 60245 - DNA, 20 bp, Human adenovirus
atggaaacatctaccttggc

SEQ ID NO: 60246 - DNA, 20 bp, Human adenovirus
tggaaacatctaccttggcg

SEQ ID NO: 60247 - DNA, 20 bp, Human adenovirus
gcggaaagccacatcaacca

SEQ ID NO: 60248 - DNA, 20 bp, Human adenovirus
aaggtagttttaatggttgc

SEQ ID NO: 60249 - DNA, 20 bp, Human adenovirus
taatggttgctggttgatgt

SEQ ID NO: 60250 - DNA, 20 bp, Human adenovirus
tacagtgtaaacaattctct

SEQ ID NO: 60251 - DNA, 20 bp, Human adenovirus
acagtgtaaacaattctctc

SEQ ID NO: 60252 - DNA, 20 bp, Human adenovirus
cagtgtaaacaattctctca

SEQ ID NO: 60253 - DNA, 20 bp, Human adenovirus
tctcagtacgggtggcctta

SEQ ID NO: 60254 - DNA, 20 bp, Human adenovirus
aataggggaaagttctcatt

SEQ ID NO: 60255 - DNA, 20 bp, Human adenovirus
gctcatgttttcacagtaag

SEQ ID NO: 60256 - DNA, 20 bp, Human adenovirus
tcacagtaagtgcagcacat

SEQ ID NO: 60257 - DNA, 20 bp, Human adenovirus
cacagtaagtgcagcacata

SEQ ID NO: 60258 - DNA, 20 bp, Human adenovirus
acagtaagtgcagcacataa

SEQ ID NO: 60259 - DNA, 20 bp, Human adenovirus
tgttattcagcagcccataa

SEQ ID NO: 60260 - DNA, 20 bp, Human adenovirus
ttaaaatttttacttccttt

SEQ ID NO: 60261 - DNA, 20 bp, Human adenovirus
taaaatttttacttcctttg

SEQ ID NO: 60262 - DNA, 20 bp, Human adenovirus
aaaatttttacttcctttgt

SEQ ID NO: 60263 - DNA, 20 bp, Human adenovirus
aaatttttacttcctttgtg

SEQ ID NO: 60264 - DNA, 20 bp, Human adenovirus
ttacttcctttgtggtcagg

SEQ ID NO: 60265 - DNA, 20 bp, Human adenovirus
atgctgccttgtctatcatt

SEQ ID NO: 60266 - DNA, 20 bp, Human adenovirus
tctatcatttaaagggggcg

SEQ ID NO: 60267 - DNA, 20 bp, Human adenovirus
aaagggggcggaggcaggat

SEQ ID NO: 60268 - DNA, 20 bp, Human adenovirus
aagggggcggaggcaggatt

SEQ ID NO: 60269 - DNA, 20 bp, Human adenovirus
gaagaaccatttttattcca

SEQ ID NO: 60270 - DNA, 20 bp, Human adenovirus
tcatttttccagccttggat

SEQ ID NO: 60271 - DNA, 20 bp, Human adenovirus
ttccagccttggattatttc

SEQ ID NO: 60272 - DNA, 20 bp, Human adenovirus
tccagccttggattatttct

SEQ ID NO: 60273 - DNA, 20 bp, Human adenovirus
ccagccttggattatttcta

SEQ ID NO: 60274 - DNA, 20 bp, Human adenovirus
cagccttggattatttctac

SEQ ID NO: 60275 - DNA, 20 bp, Human adenovirus
gtgtctccggtaatgccttc

SEQ ID NO: 60276 - DNA, 20 bp, Human adenovirus
tgtctccggtaatgccttcc

SEQ ID NO: 60277 - DNA, 20 bp, Human adenovirus
caaaatgtaagtgataaagc

SEQ ID NO: 60278 - DNA, 20 bp, Human adenovirus
ttctttaatcattttagtaa

SEQ ID NO: 60279 - DNA, 20 bp, Human adenovirus
tctttaatcattttagtaat

SEQ ID NO: 60280 - DNA, 20 bp, Human adenovirus
ttccggcaaaaatcacatcg

SEQ ID NO: 60281 - DNA, 20 bp, Human adenovirus
cggcaaaaatcacatcggac

SEQ ID NO: 60282 - DNA, 20 bp, Human adenovirus
gtatgcccgtggcatggtag

SEQ ID NO: 60283 - DNA, 20 bp, Human adenovirus
aaagccataaatatgccctg

SEQ ID NO: 60284 - DNA, 20 bp, Human adenovirus
aagccataaatatgccctga

SEQ ID NO: 60285 - DNA, 20 bp, Human adenovirus
ctgacctagctgagtactta

SEQ ID NO: 60286 - DNA, 20 bp, Human adenovirus
aaggcaacttacactgacgt

SEQ ID NO: 60287 - DNA, 20 bp, Human adenovirus
cactgacgtaatgacggaag

SEQ ID NO: 60288 - DNA, 20 bp, Human adenovirus
ttttttggcggggtttttac

SEQ ID NO: 60289 - DNA, 20 bp, Human adenovirus
tttttggcggggtttttaca

SEQ ID NO: 60290 - DNA, 20 bp, Human parainfluenza virus 1
tgacacatttagttccagga

SEQ ID NO: 60291 - DNA, 20 bp, Human parainfluenza virus 1
gacacatttagttccaggag

SEQ ID NO: 60292 - DNA, 20 bp, Human parainfluenza virus 1
acacatttagttccaggaga

SEQ ID NO: 60293 - DNA, 20 bp, Human parainfluenza virus 1
agttccaggagaagtgagag

SEQ ID NO: 60294 - DNA, 20 bp, Human parainfluenza virus 1
gttccaggagaagtgagagc

SEQ ID NO: 60295 - DNA, 20 bp, Human parainfluenza virus 1
cttcagacatatggatatcc

SEQ ID NO: 60296 - DNA, 20 bp, Human parainfluenza virus 1
agacatatggatatcctgca

SEQ ID NO: 60297 - DNA, 20 bp, Human parainfluenza virus 1
aagtttggatagtgttggtt

SEQ ID NO: 60298 - DNA, 20 bp, Human parainfluenza virus 1
ggatagtgttggttaaagcc

SEQ ID NO: 60299 - DNA, 20 bp, Human parainfluenza virus 1
gatagtgttggttaaagcca

SEQ ID NO: 60300 - DNA, 20 bp, Human parainfluenza virus 1
atggagactttgcccctgga

SEQ ID NO: 60301 - DNA, 20 bp, Human parainfluenza virus 1
gcccctggaaactatccagc

SEQ ID NO: 60302 - DNA, 20 bp, Human parainfluenza virus 1
cccctggaaactatccagca

SEQ ID NO: 60303 - DNA, 20 bp, Human parainfluenza virus 1
ctgtggtacaaaacaaagct

SEQ ID NO: 60304 - DNA, 20 bp, Human parainfluenza virus 1
cagttacatactgttgcata

SEQ ID NO: 60305 - DNA, 20 bp, Human parainfluenza virus 1
gagtcgaggacactgctgat

SEQ ID NO: 60306 - DNA, 20 bp, Human parainfluenza virus 1
tgtggttgctgatcgagtga

SEQ ID NO: 60307 - DNA, 20 bp, Human parainfluenza virus 1
ctgatcgagtgattcatcca

SEQ ID NO: 60308 - DNA, 20 bp, Human parainfluenza virus 1
atccatctttcattgctgtc

SEQ ID NO: 60309 - DNA, 20 bp, Human parainfluenza virus 1
cattgctgtcatttgtccag

SEQ ID NO: 60310 - DNA, 20 bp, Human parainfluenza virus 1
aattcctcctatccctgcag

SEQ ID NO: 60311 - DNA, 20 bp, Human parainfluenza virus 1
ctcctatccctgcagccgct

SEQ ID NO: 60312 - DNA, 20 bp, Human parainfluenza virus 1
tcatagtcagcatcactgct

SEQ ID NO: 60313 - DNA, 20 bp, Human parainfluenza virus 1
attgtttgcctggcttagtc

SEQ ID NO: 60314 - DNA, 20 bp, Human parainfluenza virus 1
ttgtttgcctggcttagtct

SEQ ID NO: 60315 - DNA, 20 bp, Human parainfluenza virus 1
acgtcgtcttatcctacaag

SEQ ID NO: 60316 - DNA, 20 bp, Human parainfluenza virus 1
tcctacaagcccacagaaat

SEQ ID NO: 60317 - DNA, 20 bp, Human parainfluenza virus 1
gagaagacagaagctggctc

SEQ ID NO: 60318 - DNA, 20 bp, Human parainfluenza virus 1
ttttcttttgggttgtcgat

SEQ ID NO: 60319 - DNA, 20 bp, Human parainfluenza virus 1
tcttttgggttgtcgatgat

SEQ ID NO: 60320 - DNA, 20 bp, Human parainfluenza virus 1
atcaacaaggtatacacagg

SEQ ID NO: 60321 - DNA, 20 bp, Human parainfluenza virus 1
ggactagttcctcgcctaga

SEQ ID NO: 60322 - DNA, 20 bp, Human parainfluenza virus 1
gactagttcctcgcctagag

SEQ ID NO: 60323 - DNA, 20 bp, Human parainfluenza virus 1
ctcgcctagaggccctgtgt

SEQ ID NO: 60324 - DNA, 20 bp, Human parainfluenza virus 1
ttgatcaaggattctagcat

SEQ ID NO: 60325 - DNA, 20 bp, Human parainfluenza virus 1
ccaacccaagtccagagctt

SEQ ID NO: 60326 - DNA, 20 bp, Human parainfluenza virus 1
aagatgccgttctacaaagg

SEQ ID NO: 60327 - DNA, 20 bp, Human parainfluenza virus 1
tacaaaggaacaaaagacgg

SEQ ID NO: 60328 - DNA, 20 bp, Human parainfluenza virus 1
tgttcctttgtagaacggca

SEQ ID NO: 60329 - DNA, 20 bp, Human parainfluenza virus 1
gttcctttgtagaacggcat

SEQ ID NO: 60330 - DNA, 20 bp, Human parainfluenza virus 1
caccgtcaaagaacgaagag

SEQ ID NO: 60331 - DNA, 20 bp, Human parainfluenza virus 1
gcattgtttgttgtgtatct

SEQ ID NO: 60332 - DNA, 20 bp, Human parainfluenza virus 1
cattgtttgttgtgtatctt

SEQ ID NO: 60333 - DNA, 20 bp, Human parainfluenza virus 1
tttgttgtgtatcttgtttt

SEQ ID NO: 60334 - DNA, 20 bp, Human parainfluenza virus 1
gttgtgtatcttgtttttct

SEQ ID NO: 60335 - DNA, 20 bp, Human parainfluenza virus 1
acaaaagggaaagacaataa

SEQ ID NO: 60336 - DNA, 20 bp, Human parainfluenza virus 1
gacccctctatggaagctct

SEQ ID NO: 60337 - DNA, 20 bp, Human parainfluenza virus 1
acccctctatggaagctcta

SEQ ID NO: 60338 - DNA, 20 bp, Human parainfluenza virus 1
aactcttgacctcctagagc

SEQ ID NO: 60339 - DNA, 20 bp, Human parainfluenza virus 1
acctcctagagcttccatag

SEQ ID NO: 60340 - DNA, 20 bp, Human parainfluenza virus 1
cccagattctcacacgaaga

SEQ ID NO: 60341 - DNA, 20 bp, Human parainfluenza virus 1
tcacacgaagaaaatgggac

SEQ ID NO: 60342 - DNA, 20 bp, Human parainfluenza virus 1
cttttttgtcaggacctgtt

SEQ ID NO: 60343 - DNA, 20 bp, Human parainfluenza virus 1
tttgtcaggacctgttttga

SEQ ID NO: 60344 - DNA, 20 bp, Human parainfluenza virus 1
ttgtcaggacctgttttgag

SEQ ID NO: 60345 - DNA, 20 bp, Human parainfluenza virus 1
gatctggagaaatgatagta

SEQ ID NO: 60346 - DNA, 20 bp, Human parainfluenza virus 1
gatccatgctcctctactac

SEQ ID NO: 60347 - DNA, 20 bp, Human parainfluenza virus 1
tatatcatcccttgtctcag

SEQ ID NO: 60348 - DNA, 20 bp, Human parainfluenza virus 1
tctcagtcggctggaccatg

SEQ ID NO: 60349 - DNA, 20 bp, Human parainfluenza virus 1
ctccagatctaactgttctt

SEQ ID NO: 60350 - DNA, 20 bp, Human parainfluenza virus 1
caattgctaaggtcccaaaa

SEQ ID NO: 60351 - DNA, 20 bp, Human parainfluenza virus 1
ctaaggtcccaaaaactctt

SEQ ID NO: 60352 - DNA, 20 bp, Human parainfluenza virus 1
cagatcttgcattaccgaac

SEQ ID NO: 60353 - DNA, 20 bp, Human parainfluenza virus 1
cattaccgaactcaatatca

SEQ ID NO: 60354 - DNA, 20 bp, Human parainfluenza virus 1
ccgaactcaatatcagtgaa

SEQ ID NO: 60355 - DNA, 20 bp, Human parainfluenza virus 1
catggaaaaaagcagtttgc

SEQ ID NO: 60356 - DNA, 20 bp, Human parainfluenza virus 1
gctatcctttaatggatgta

SEQ ID NO: 60357 - DNA, 20 bp, Human parainfluenza virus 1
ctatcctttaatggatgtaa

SEQ ID NO: 60358 - DNA, 20 bp, Human parainfluenza virus 1
aatggatgtaaatccacata

SEQ ID NO: 60359 - DNA, 20 bp, Human parainfluenza virus 1
atggatgtaaatccacatat

SEQ ID NO: 60360 - DNA, 20 bp, Human parainfluenza virus 1
tccttttctttctttgtgtt

SEQ ID NO: 60361 - DNA, 20 bp, Human parainfluenza virus 1
tctttctttgtgttgttgtt

SEQ ID NO: 60362 - DNA, 20 bp, Human parainfluenza virus 1
ctttctttgtgttgttgttt

SEQ ID NO: 60363 - DNA, 20 bp, Human parainfluenza virus 1
tttctttgtgttgttgtttt

SEQ ID NO: 60364 - DNA, 20 bp, Human parainfluenza virus 1
ctttgtgttgttgtttttct

SEQ ID NO: 60365 - DNA, 20 bp, Human parainfluenza virus 1
tttggtgctgtcattggtac

SEQ ID NO: 60366 - DNA, 20 bp, Human parainfluenza virus 1
ggtgctgtcattggtaccat

SEQ ID NO: 60367 - DNA, 20 bp, Human parainfluenza virus 1
gtgctgtcattggtaccata

SEQ ID NO: 60368 - DNA, 20 bp, Human parainfluenza virus 1
gtaccatagcactaggagta

SEQ ID NO: 60369 - DNA, 20 bp, Human parainfluenza virus 1
tttgagcagctgtggctact

SEQ ID NO: 60370 - DNA, 20 bp, Human parainfluenza virus 1
taagtacaactaaaaaggat

SEQ ID NO: 60371 - DNA, 20 bp, Human parainfluenza virus 1
acactgaacaggttaaggga

SEQ ID NO: 60372 - DNA, 20 bp, Human parainfluenza virus 1
cactgaacaggttaagggaa

SEQ ID NO: 60373 - DNA, 20 bp, Human parainfluenza virus 1
agggaactgtgatagatgtt

SEQ ID NO: 60374 - DNA, 20 bp, Human parainfluenza virus 1
atttggaaaaatacatggtt

SEQ ID NO: 60375 - DNA, 20 bp, Human parainfluenza virus 1
cattcttgacctataccaat

SEQ ID NO: 60376 - DNA, 20 bp, Human parainfluenza virus 1
ttgacctataccaattgcgg

SEQ ID NO: 60377 - DNA, 20 bp, Human parainfluenza virus 1
acctataccaattgcggttt

SEQ ID NO: 60378 - DNA, 20 bp, Human parainfluenza virus 1
cggtttaataggtataaatg

SEQ ID NO: 60379 - DNA, 20 bp, Human parainfluenza virus 1
aataggtataaatggaatag

SEQ ID NO: 60380 - DNA, 20 bp, Human parainfluenza virus 1
accaatcaggtgtacaacaa

SEQ ID NO: 60381 - DNA, 20 bp, Human parainfluenza virus 1
gggttaaagacaatccagtc

SEQ ID NO: 60382 - DNA, 20 bp, Human parainfluenza virus 1
aagacaatccagtcaaccta

SEQ ID NO: 60383 - DNA, 20 bp, Human parainfluenza virus 1
tacaaacgatggctgaaaaa

SEQ ID NO: 60384 - DNA, 20 bp, Human parainfluenza virus 1
ttcagccatcgtttgtataa

SEQ ID NO: 60385 - DNA, 20 bp, Human parainfluenza virus 1
ctggagatgtcccgtagggg

SEQ ID NO: 60386 - DNA, 20 bp, Human parainfluenza virus 1
tggagatgtcccgtagggga

SEQ ID NO: 60387 - DNA, 20 bp, Human parainfluenza virus 1
ttacctggaccaagtctact

SEQ ID NO: 60388 - DNA, 20 bp, Human parainfluenza virus 1
cctggaccaagtctactttc

SEQ ID NO: 60389 - DNA, 20 bp, Human parainfluenza virus 1
ctggatccaccacaatttca

SEQ ID NO: 60390 - DNA, 20 bp, Human parainfluenza virus 1
tgtaatagctgcaggaacaa

SEQ ID NO: 60391 - DNA, 20 bp, Human parainfluenza virus 1
tcagttatgctccttgccca

SEQ ID NO: 60392 - DNA, 20 bp, Human parainfluenza virus 1
tgctccttgcccactgtgaa

SEQ ID NO: 60393 - DNA, 20 bp, Human parainfluenza virus 1
cccactgtgaatgagactac

SEQ ID NO: 60394 - DNA, 20 bp, Human parainfluenza virus 1
acagtgggcaaggagcataa

SEQ ID NO: 60395 - DNA, 20 bp, Human parainfluenza virus 1
aaaatacactcattttccta

SEQ ID NO: 60396 - DNA, 20 bp, Human parainfluenza virus 1
tcctagggtacggtggctta

SEQ ID NO: 60397 - DNA, 20 bp, Human parainfluenza virus 1
cctagggtacggtggcttaa

SEQ ID NO: 60398 - DNA, 20 bp, Human parainfluenza virus 1
ctagggtacggtggcttaac

SEQ ID NO: 60399 - DNA, 20 bp, Human parainfluenza virus 1
acaactccgctccaaggcga

SEQ ID NO: 60400 - DNA, 20 bp, Human parainfluenza virus 1
aggttggcactccaacctgc

SEQ ID NO: 60401 - DNA, 20 bp, Human parainfluenza virus 1
gcactccaacctgcaaatag

SEQ ID NO: 60402 - DNA, 20 bp, Human parainfluenza virus 1
gatatcaacaaccccatgac

SEQ ID NO: 60403 - DNA, 20 bp, Human parainfluenza virus 1
aatggtcatggggttgttga

SEQ ID NO: 60404 - DNA, 20 bp, Human parainfluenza virus 1
atggtcatggggttgttgat

SEQ ID NO: 60405 - DNA, 20 bp, Human parainfluenza virus 1
ctacaaccacactgtacgca

SEQ ID NO: 60406 - DNA, 20 bp, Human parainfluenza virus 1
atcccaccataatgtactca

SEQ ID NO: 60407 - DNA, 20 bp, Human parainfluenza virus 1
tcaacatgctaagactcaag

SEQ ID NO: 60408 - DNA, 20 bp, Human parainfluenza virus 1
tacattcttgagtcttagca

SEQ ID NO: 60409 - DNA, 20 bp, Human parainfluenza virus 1
ttgagtcttagcatgttgat

SEQ ID NO: 60410 - DNA, 20 bp, Human parainfluenza virus 1
aacaagaaattaaggatatt

SEQ ID NO: 60411 - DNA, 20 bp, Human parainfluenza virus 1
aggatattgatcgttacact

SEQ ID NO: 60412 - DNA, 20 bp, Human parainfluenza virus 1
atcgttacacttttgaacct

SEQ ID NO: 60413 - DNA, 20 bp, Human parainfluenza virus 1
cacttttgaaccttatccga

SEQ ID NO: 60414 - DNA, 20 bp, Human parainfluenza virus 1
tgaaccttatccgattttct

SEQ ID NO: 60415 - DNA, 20 bp, Human parainfluenza virus 1
agctggacgactcgataaaa

SEQ ID NO: 60416 - DNA, 20 bp, Human parainfluenza virus 1
tgggagcttatcgactcttt

SEQ ID NO: 60417 - DNA, 20 bp, Human parainfluenza virus 1
tcgactctttatttcccaat

SEQ ID NO: 60418 - DNA, 20 bp, Human parainfluenza virus 1
atttcccaatcttggtgagg

SEQ ID NO: 60419 - DNA, 20 bp, Human parainfluenza virus 1
tttcccaatcttggtgagga

SEQ ID NO: 60420 - DNA, 20 bp, Human parainfluenza virus 1
gcagaaacactactagcaaa

SEQ ID NO: 60421 - DNA, 20 bp, Human parainfluenza virus 1
ttcagtgaaaatgggatggt

SEQ ID NO: 60422 - DNA, 20 bp, Human parainfluenza virus 1
agtgaaaatgggatggtaaa

SEQ ID NO: 60423 - DNA, 20 bp, Human parainfluenza virus 1
acctactaaagagactgact

SEQ ID NO: 60424 - DNA, 20 bp, Human parainfluenza virus 1
agtaggtcaatttctccctt

SEQ ID NO: 60425 - DNA, 20 bp, Human parainfluenza virus 1
gtgtcagagtgtcagcaatg

SEQ ID NO: 60426 - DNA, 20 bp, Human parainfluenza virus 1
ctgtcacacaaacctataag

SEQ ID NO: 60427 - DNA, 20 bp, Human parainfluenza virus 1
ttttgcttataggtttgtgt

SEQ ID NO: 60428 - DNA, 20 bp, Human parainfluenza virus 1
tttgcttataggtttgtgtg

SEQ ID NO: 60429 - DNA, 20 bp, Human parainfluenza virus 1
ttgcttataggtttgtgtga

SEQ ID NO: 60430 - DNA, 20 bp, Human parainfluenza virus 1
atcccagctaacataggagg

SEQ ID NO: 60431 - DNA, 20 bp, Human parainfluenza virus 1
aactatatgtctacagctag

SEQ ID NO: 60432 - DNA, 20 bp, Human parainfluenza virus 1
tgtcagaaatataggtgatc

SEQ ID NO: 60433 - DNA, 20 bp, Human parainfluenza virus 1
gtcagaaatataggtgatcc

SEQ ID NO: 60434 - DNA, 20 bp, Human parainfluenza virus 1
tcagaaatataggtgatcca

SEQ ID NO: 60435 - DNA, 20 bp, Human parainfluenza virus 1
gcaataggattgaggcaaaa

SEQ ID NO: 60436 - DNA, 20 bp, Human parainfluenza virus 1
aggcaaaaaatgtggtttca

SEQ ID NO: 60437 - DNA, 20 bp, Human parainfluenza virus 1
catctaacttatggaagacc

SEQ ID NO: 60438 - DNA, 20 bp, Human parainfluenza virus 1
atctaacttatggaagacca

SEQ ID NO: 60439 - DNA, 20 bp, Human parainfluenza virus 1
tggaagaccaatccacggtt

SEQ ID NO: 60440 - DNA, 20 bp, Human parainfluenza virus 1
tagctcaaaccagggctaac

SEQ ID NO: 60441 - DNA, 20 bp, Human parainfluenza virus 1
agtttagagaatttgaagtt

SEQ ID NO: 60442 - DNA, 20 bp, Human parainfluenza virus 1
agagaatttgaagttactca

SEQ ID NO: 60443 - DNA, 20 bp, Human parainfluenza virus 1
gagaatttgaagttactcac

SEQ ID NO: 60444 - DNA, 20 bp, Human parainfluenza virus 1
gaagttactcacccctgtat

SEQ ID NO: 60445 - DNA, 20 bp, Human parainfluenza virus 1
gcatattcactttacgggtt

SEQ ID NO: 60446 - DNA, 20 bp, Human parainfluenza virus 1
catattcactttacgggtta

SEQ ID NO: 60447 - DNA, 20 bp, Human parainfluenza virus 1
actttacgggttaaacgtca

SEQ ID NO: 60448 - DNA, 20 bp, Human parainfluenza virus 1
acgggttaaacgtcagaggg

SEQ ID NO: 60449 - DNA, 20 bp, Human parainfluenza virus 1
cgggttaaacgtcagaggga

SEQ ID NO: 60450 - DNA, 20 bp, Human parainfluenza virus 1
gaggactgggatcctgatgc

SEQ ID NO: 60451 - DNA, 20 bp, Human parainfluenza virus 1
aacacaatatacctttaaag

SEQ ID NO: 60452 - DNA, 20 bp, Human parainfluenza virus 1
aaagaagaacgaaagaactc

SEQ ID NO: 60453 - DNA, 20 bp, Human parainfluenza virus 1
aagaagaacgaaagaactcc

SEQ ID NO: 60454 - DNA, 20 bp, Human parainfluenza virus 1
tttcgttcttctttaaaggt

SEQ ID NO: 60455 - DNA, 20 bp, Human parainfluenza virus 1
tcgggattaatagcaccagt

SEQ ID NO: 60456 - DNA, 20 bp, Human parainfluenza virus 1
cgggattaatagcaccagtt

SEQ ID NO: 60457 - DNA, 20 bp, Human parainfluenza virus 1
gggattaatagcaccagttg

SEQ ID NO: 60458 - DNA, 20 bp, Human parainfluenza virus 1
atagcaccagttgtttgaaa

SEQ ID NO: 60459 - DNA, 20 bp, Human parainfluenza virus 1
tttgaaagcattggaactta

SEQ ID NO: 60460 - DNA, 20 bp, Influenza A virus
cttttcttgaaagttccagc

SEQ ID NO: 60461 - DNA, 20 bp, Influenza A virus
tcttgaaagttccagcgcaa

SEQ ID NO: 60462 - DNA, 20 bp, Influenza A virus
cttgaaagttccagcgcaaa

SEQ ID NO: 60463 - DNA, 20 bp, Influenza A virus
ttgaaagttccagcgcaaaa

SEQ ID NO: 60464 - DNA, 20 bp, Influenza A virus
aaagttccagcgcaaaatgc

SEQ ID NO: 60465 - DNA, 20 bp, Influenza A virus
gaaaattcgtgtcttgaaac

SEQ ID NO: 60466 - DNA, 20 bp, Influenza A virus
aaaattcgtgtcttgaaacg

SEQ ID NO: 60467 - DNA, 20 bp, Influenza A virus
gtgtcttgaaacgatggaag

SEQ ID NO: 60468 - DNA, 20 bp, Influenza A virus
aaacgatggaagttattcaa

SEQ ID NO: 60469 - DNA, 20 bp, Influenza A virus
ttcaacaaacaagagtggac

SEQ ID NO: 60470 - DNA, 20 bp, Influenza A virus
caaagaaaaagaagagtaag

SEQ ID NO: 60471 - DNA, 20 bp, Influenza A virus
gcttcttctttcctattgtt

SEQ ID NO: 60472 - DNA, 20 bp, Influenza A virus
cttcttctttcctattgttc

SEQ ID NO: 60473 - DNA, 20 bp, Influenza A virus
ttctttcctattgttcgttg

SEQ ID NO: 60474 - DNA, 20 bp, Influenza A virus
tttcctattgttcgttgtgt

SEQ ID NO: 60475 - DNA, 20 bp, Influenza A virus
aacagtctgggcttccggtt

SEQ ID NO: 60476 - DNA, 20 bp, Influenza A virus
cggttggaggtaatgaaaag

SEQ ID NO: 60477 - DNA, 20 bp, Influenza A virus
gaggtaatgaaaagaaggct

SEQ ID NO: 60478 - DNA, 20 bp, Influenza A virus
ttagaaaaatgatgactaat

SEQ ID NO: 60479 - DNA, 20 bp, Influenza A virus
gaaaaatgatgactaattca

SEQ ID NO: 60480 - DNA, 20 bp, Influenza A virus
tcaaataaaatggctagact

SEQ ID NO: 60481 - DNA, 20 bp, Influenza A virus
catgttcgaaagcaagagca

SEQ ID NO: 60482 - DNA, 20 bp, Influenza A virus
gaaagcaagagcatgaagct

SEQ ID NO: 60483 - DNA, 20 bp, Influenza A virus
ctagcatttctgctggtatt

SEQ ID NO: 60484 - DNA, 20 bp, Influenza A virus
ctgctggtatttgtgttcgg

SEQ ID NO: 60485 - DNA, 20 bp, Influenza A virus
gctctcatagtgaatgcacc

SEQ ID NO: 60486 - DNA, 20 bp, Influenza A virus
ggtgcattcactatgagagc

SEQ ID NO: 60487 - DNA, 20 bp, Influenza A virus
gtgcattcactatgagagcg

SEQ ID NO: 60488 - DNA, 20 bp, Influenza A virus
actatgagagcgaagtcatc

SEQ ID NO: 60489 - DNA, 20 bp, Influenza A virus
gagtccgtcccaccagtatg

SEQ ID NO: 60490 - DNA, 20 bp, Influenza A virus
ggagtgtctggaattaatga

SEQ ID NO: 60491 - DNA, 20 bp, Influenza A virus
gagtgtctggaattaatgaa

SEQ ID NO: 60492 - DNA, 20 bp, Influenza A virus
atgaatcggctgatatgagc

SEQ ID NO: 60493 - DNA, 20 bp, Influenza A virus
gggtaacagtgataaagaac

SEQ ID NO: 60494 - DNA, 20 bp, Influenza A virus
ctggcccaaggtcattattt

SEQ ID NO: 60495 - DNA, 20 bp, Influenza A virus
aaatgggagctaatggatga

SEQ ID NO: 60496 - DNA, 20 bp, Influenza A virus
gtaatcccctgaatccattt

SEQ ID NO: 60497 - DNA, 20 bp, Influenza A virus
taatcccctgaatccatttg

SEQ ID NO: 60498 - DNA, 20 bp, Influenza A virus
gtcagtcataaggaaattga

SEQ ID NO: 60499 - DNA, 20 bp, Influenza A virus
tcagtcataaggaaattgag

SEQ ID NO: 60500 - DNA, 20 bp, Influenza A virus
caatctatttgagaaattct

SEQ ID NO: 60501 - DNA, 20 bp, Influenza A virus
gagaaattcttccctagcag

SEQ ID NO: 60502 - DNA, 20 bp, Influenza A virus
agaaattcttccctagcagt

SEQ ID NO: 60503 - DNA, 20 bp, Influenza A virus
ttccctagcagttcgtacag

SEQ ID NO: 60504 - DNA, 20 bp, Influenza A virus
cctagcagttcgtacaggag

SEQ ID NO: 60505 - DNA, 20 bp, Human papillomavirus 61
tcctgctctgcaaggactac

SEQ ID NO: 60506 - DNA, 20 bp, Human papillomavirus 61
cctgctctgcaaggactacg

SEQ ID NO: 60507 - DNA, 20 bp, Human papillomavirus 61
ctgctctgcaaggactacga

SEQ ID NO: 60508 - DNA, 20 bp, Human papillomavirus 61
gaggatttaaggctgacatg

SEQ ID NO: 60509 - DNA, 20 bp, Human papillomavirus 61
aggatttaaggctgacatgt

SEQ ID NO: 60510 - DNA, 20 bp, Human papillomavirus 61
ggaccattcctgttacggac

SEQ ID NO: 60511 - DNA, 20 bp, Human papillomavirus 61
ctgttacggacccactgtgg

SEQ ID NO: 60512 - DNA, 20 bp, Human papillomavirus 61
cggacccactgtggaacaga

SEQ ID NO: 60513 - DNA, 20 bp, Human papillomavirus 61
gctgaactatatatacggtg

SEQ ID NO: 60514 - DNA, 20 bp, Human papillomavirus 61
tcctgtatacttaacggttt

SEQ ID NO: 60515 - DNA, 20 bp, Human papillomavirus 61
ttagacagctcagagtcaga

SEQ ID NO: 60516 - DNA, 20 bp, Human papillomavirus 61
gacagctcagagtcagagga

SEQ ID NO: 60517 - DNA, 20 bp, Human papillomavirus 61
ttgaacaagcacagcaggcc

SEQ ID NO: 60518 - DNA, 20 bp, Human papillomavirus 61
aacaagcacagcaggcctac

SEQ ID NO: 60519 - DNA, 20 bp, Human papillomavirus 61
ctacctgtggcatttgtaag

SEQ ID NO: 60520 - DNA, 20 bp, Human papillomavirus 61
gtaatttaaaagcaaaatta

SEQ ID NO: 60521 - DNA, 20 bp, Human papillomavirus 61
aaaagcaaaattactgtaca

SEQ ID NO: 60522 - DNA, 20 bp, Human papillomavirus 61
aaagcaaaattactgtacaa

SEQ ID NO: 60523 - DNA, 20 bp, Human papillomavirus 61
ctgtacaaattcaaggacct

SEQ ID NO: 60524 - DNA, 20 bp, Human papillomavirus 61
aaggacctatttggactagc

SEQ ID NO: 60525 - DNA, 20 bp, Human papillomavirus 61
aacataccggaaagacagat

SEQ ID NO: 60526 - DNA, 20 bp, Human papillomavirus 61
aaccaccaaagattagaagc

SEQ ID NO: 60527 - DNA, 20 bp, Human papillomavirus 61
gaagcgcaccgtgcgcacta

SEQ ID NO: 60528 - DNA, 20 bp, Human papillomavirus 61
gtatagaacagccatgggaa

SEQ ID NO: 60529 - DNA, 20 bp, Human papillomavirus 61
cccatggctgttctatacca

SEQ ID NO: 60530 - DNA, 20 bp, Human papillomavirus 61
ctgggaaatgaggacccaaa

SEQ ID NO: 60531 - DNA, 20 bp, Human papillomavirus 61
ttggccagtaactgccaagc

SEQ ID NO: 60532 - DNA, 20 bp, Human papillomavirus 61
gccagtaactgccaagcaaa

SEQ ID NO: 60533 - DNA, 20 bp, Human papillomavirus 61
aatatactttgcttggcagt

SEQ ID NO: 60534 - DNA, 20 bp, Human papillomavirus 61
atatactttgcttggcagtt

SEQ ID NO: 60535 - DNA, 20 bp, Human papillomavirus 61
tacggaccaagcgacacagg

SEQ ID NO: 60536 - DNA, 20 bp, Human papillomavirus 61
acggaccaagcgacacaggg

SEQ ID NO: 60537 - DNA, 20 bp, Human papillomavirus 61
cggaccaagcgacacaggga

SEQ ID NO: 60538 - DNA, 20 bp, Human papillomavirus 61
tgcatgagcctactaaattt

SEQ ID NO: 60539 - DNA, 20 bp, Human papillomavirus 61
gcatgagcctactaaatttt

SEQ ID NO: 60540 - DNA, 20 bp, Human papillomavirus 61
agatgcgtgccaggagaaat

SEQ ID NO: 60541 - DNA, 20 bp, Human papillomavirus 61
gatgcgtgccaggagaaatt

SEQ ID NO: 60542 - DNA, 20 bp, Human papillomavirus 61
ctagacctctatgaaaaaga

SEQ ID NO: 60543 - DNA, 20 bp, Human papillomavirus 61
aggaccaaatattgcattgg

SEQ ID NO: 60544 - DNA, 20 bp, Human papillomavirus 61
ggtcctcaagcttgttgcta

SEQ ID NO: 60545 - DNA, 20 bp, Human papillomavirus 61
caaaccacctctttggaaat

SEQ ID NO: 60546 - DNA, 20 bp, Human papillomavirus 61
ggaaatgtggaatacgcagc

SEQ ID NO: 60547 - DNA, 20 bp, Human papillomavirus 61
gaaatgtggaatacgcagcc

SEQ ID NO: 60548 - DNA, 20 bp, Human papillomavirus 61
tttcttccagcatcgttgtg

SEQ ID NO: 60549 - DNA, 20 bp, Human papillomavirus 61
ttcttccagcatcgttgtgg

SEQ ID NO: 60550 - DNA, 20 bp, Human papillomavirus 61
ttggtgtttttctgtgccat

SEQ ID NO: 60551 - DNA, 20 bp, Human papillomavirus 61
tggtgtttttctgtgccata

SEQ ID NO: 60552 - DNA, 20 bp, Human papillomavirus 61
ggtgtttttctgtgccatat

SEQ ID NO: 60553 - DNA, 20 bp, Human papillomavirus 61
gtgtttttctgtgccatata

SEQ ID NO: 60554 - DNA, 20 bp, Human papillomavirus 61
ttctgtgccatatatgtagg

SEQ ID NO: 60555 - DNA, 20 bp, Human papillomavirus 61
gcacccggcctcctactgta

SEQ ID NO: 60556 - DNA, 20 bp, Human papillomavirus 61
gccctgtgtcccgcccccct

SEQ ID NO: 60557 - DNA, 20 bp, Human papillomavirus 61
tattaatcctttattcactg

SEQ ID NO: 60558 - DNA, 20 bp, Human papillomavirus 61
attaatcctttattcactga

SEQ ID NO: 60559 - DNA, 20 bp, Human papillomavirus 61
ttaatcctttattcactgag

SEQ ID NO: 60560 - DNA, 20 bp, Human papillomavirus 61
atcctttattcactgagcct

SEQ ID NO: 60561 - DNA, 20 bp, Human papillomavirus 61
attcactgagccttctatta

SEQ ID NO: 60562 - DNA, 20 bp, Human papillomavirus 61
accatgacattagtcccatt

SEQ ID NO: 60563 - DNA, 20 bp, Human papillomavirus 61
ccatgacattagtcccattc

SEQ ID NO: 60564 - DNA, 20 bp, Human papillomavirus 61
gtcccattccatcggatgct

SEQ ID NO: 60565 - DNA, 20 bp, Human papillomavirus 61
catcggatgctgtggagtta

SEQ ID NO: 60566 - DNA, 20 bp, Human papillomavirus 61
cagcctttggtgccgtcctc

SEQ ID NO: 60567 - DNA, 20 bp, Human papillomavirus 61
tatatatattcagggctctg

SEQ ID NO: 60568 - DNA, 20 bp, Human papillomavirus 61
agggctctgatttttatttg

SEQ ID NO: 60569 - DNA, 20 bp, Human papillomavirus 61
ttatttgttgcctgcttatg

SEQ ID NO: 60570 - DNA, 20 bp, Human papillomavirus 61
tatttgttgcctgcttatgt

SEQ ID NO: 60571 - DNA, 20 bp, Human papillomavirus 61
atttgttgcctgcttatgtg

SEQ ID NO: 60572 - DNA, 20 bp, Human papillomavirus 61
ctgtaggacatccctattgt

SEQ ID NO: 60573 - DNA, 20 bp, Human papillomavirus 61
tagtttgcagcttgatgggc

SEQ ID NO: 60574 - DNA, 20 bp, Human papillomavirus 61
gcagcttgatgggctgcagg

SEQ ID NO: 60575 - DNA, 20 bp, Human papillomavirus 61
cagcttgatgggctgcaggg

SEQ ID NO: 60576 - DNA, 20 bp, Human papillomavirus 61
atgggctgcagggcaagaaa

SEQ ID NO: 60577 - DNA, 20 bp, Human papillomavirus 61
gatatttgcaccactatatg

SEQ ID NO: 60578 - DNA, 20 bp, Human papillomavirus 61
gcaccactatatgcaagtat

SEQ ID NO: 60579 - DNA, 20 bp, Human papillomavirus 61
caccactatatgcaagtatc

SEQ ID NO: 60580 - DNA, 20 bp, Human papillomavirus 61
tttacaaatggctgctgaac

SEQ ID NO: 60581 - DNA, 20 bp, Human papillomavirus 61
acaaatggctgctgaaccat

SEQ ID NO: 60582 - DNA, 20 bp, Human papillomavirus 61
gctgcaacgtgcccagggcc

SEQ ID NO: 60583 - DNA, 20 bp, Human papillomavirus 61
gttggtttaatgaattgttt

SEQ ID NO: 60584 - DNA, 20 bp, Human papillomavirus 61
ttggtttaatgaattgtttg

SEQ ID NO: 60585 - DNA, 20 bp, Human papillomavirus 61
gtttaatgaattgtttgtaa

SEQ ID NO: 60586 - DNA, 20 bp, Human papillomavirus 61
aatgaattgtttgtaaccgt

SEQ ID NO: 60587 - DNA, 20 bp, Human papillomavirus 61
ggtgtggtaccaccaccctc

SEQ ID NO: 60588 - DNA, 20 bp, Human papillomavirus 61
gtgtggtaccaccaccctct

SEQ ID NO: 60589 - DNA, 20 bp, Human papillomavirus 61
agaagacacatataggtttt

SEQ ID NO: 60590 - DNA, 20 bp, Human papillomavirus 61
gaagacacatataggttttt

SEQ ID NO: 60591 - DNA, 20 bp, Human papillomavirus 61
ttgcagtccagagctattac

SEQ ID NO: 60592 - DNA, 20 bp, Human papillomavirus 61
gtctgtatgctgttgttgtg

SEQ ID NO: 60593 - DNA, 20 bp, Human papillomavirus 61
tctgtatgctgttgttgtgc

SEQ ID NO: 60594 - DNA, 20 bp, Human papillomavirus 61
ttgtgcatgtgttgttttgt

SEQ ID NO: 60595 - DNA, 20 bp, Human papillomavirus 61
tgcatgtgttgttttgtatt

SEQ ID NO: 60596 - DNA, 20 bp, Human papillomavirus 61
ttttgtattgtgctgtactg

SEQ ID NO: 60597 - DNA, 20 bp, Human papillomavirus 61
attgttgcacgccttatttt

SEQ ID NO: 60598 - DNA, 20 bp, Human papillomavirus 61
ttgttgcacgccttattttg

SEQ ID NO: 60599 - DNA, 20 bp, Human papillomavirus 61
ttgcacgccttattttgtgc

SEQ ID NO: 60600 - DNA, 20 bp, Human papillomavirus 61
cacgccttattttgtgcagc

SEQ ID NO: 60601 - DNA, 20 bp, Human papillomavirus 61
ttttgtgcagcttccccatt

SEQ ID NO: 60602 - DNA, 20 bp, Human papillomavirus 61
ctaacacacacagtttggaa

SEQ ID NO: 60603 - DNA, 20 bp, Human papillomavirus 61
ggaacaatgctccatctatc

SEQ ID NO: 60604 - DNA, 20 bp, Human papillomavirus 61
gaacaatgctccatctatct

SEQ ID NO: 60605 - DNA, 20 bp, Human papillomavirus 61
tttgacatgttgtgcaatta

SEQ ID NO: 60606 - DNA, 20 bp, Human papillomavirus 61
ttgacatgttgtgcaattac

SEQ ID NO: 60607 - DNA, 20 bp, Human herpesvirus
cgttgtagatctggatacac

SEQ ID NO: 60608 - DNA, 20 bp, Human herpesvirus
tagatctggatacactactt

SEQ ID NO: 60609 - DNA, 20 bp, Human herpesvirus
tgcccgcaatataacagcaa

SEQ ID NO: 60610 - DNA, 20 bp, Human herpesvirus
acaaggtgggacgtggtctg

SEQ ID NO: 60611 - DNA, 20 bp, Human herpesvirus
caaggtgggacgtggtctga

SEQ ID NO: 60612 - DNA, 20 bp, Human herpesvirus
caacgctcaaactatacaga

SEQ ID NO: 60613 - DNA, 20 bp, Human herpesvirus
aacgctcaaactatacagaa

SEQ ID NO: 60614 - DNA, 20 bp, Human herpesvirus
aggctttgttggaggttctg

SEQ ID NO: 60615 - DNA, 20 bp, Human herpesvirus
gttggaggttctgtatagtt

SEQ ID NO: 60616 - DNA, 20 bp, Human herpesvirus
ttggaggttctgtatagttt

SEQ ID NO: 60617 - DNA, 20 bp, Human herpesvirus
cacacaacaggcggactcta

SEQ ID NO: 60618 - DNA, 20 bp, Human herpesvirus
ggtctggcagcccatgtccg

SEQ ID NO: 60619 - DNA, 20 bp, Human herpesvirus
gtctggcagcccatgtccgc

SEQ ID NO: 60620 - DNA, 20 bp, Human herpesvirus
acctgactcacgctcagggc

SEQ ID NO: 60621 - DNA, 20 bp, Human herpesvirus
ccgctgtcgccctgagcgtg

SEQ ID NO: 60622 - DNA, 20 bp, Human herpesvirus
tccgagccgccattggccca

SEQ ID NO: 60623 - DNA, 20 bp, Human herpesvirus
ccgagccgccattggcccat

SEQ ID NO: 60624 - DNA, 20 bp, Human herpesvirus
cgagccgccattggcccatt

SEQ ID NO: 60625 - DNA, 20 bp, Human herpesvirus
gcccattcggccgaccaatc

SEQ ID NO: 60626 - DNA, 20 bp, Human herpesvirus
ggccgaccaatcccgttcga

SEQ ID NO: 60627 - DNA, 20 bp, Human herpesvirus
gtcgttgcacccatcccccc

SEQ ID NO: 60628 - DNA, 20 bp, Human herpesvirus
tcgttgcacccatcccccct

SEQ ID NO: 60629 - DNA, 20 bp, Human herpesvirus
cacccatcccccctttgctt

SEQ ID NO: 60630 - DNA, 20 bp, Human herpesvirus
gcttaatcacccgaaaacta

SEQ ID NO: 60631 - DNA, 20 bp, Human herpesvirus
cttaatcacccgaaaactag

SEQ ID NO: 60632 - DNA, 20 bp, Human herpesvirus
atttatagtggcgtatgcta

SEQ ID NO: 60633 - DNA, 20 bp, Human herpesvirus
tttatagtggcgtatgctaa

SEQ ID NO: 60634 - DNA, 20 bp, Human herpesvirus
atagtggcgtatgctaaccg

SEQ ID NO: 60635 - DNA, 20 bp, Human herpesvirus
tagtggcgtatgctaaccgc

SEQ ID NO: 60636 - DNA, 20 bp, Human herpesvirus
catgcgggataagttggcct

SEQ ID NO: 60637 - DNA, 20 bp, Human herpesvirus
ggcgtaggagcgtctttctc

SEQ ID NO: 60638 - DNA, 20 bp, Human herpesvirus
ctccaccgccgcgcatggtg

SEQ ID NO: 60639 - DNA, 20 bp, Human herpesvirus
tccaccgccgcgcatggtgt

SEQ ID NO: 60640 - DNA, 20 bp, Human herpesvirus
ttggatgctctgcgtgctgg

SEQ ID NO: 60641 - DNA, 20 bp, Human herpesvirus
gatgctctgcgtgctggagg

SEQ ID NO: 60642 - DNA, 20 bp, Human herpesvirus
ctggaactgaccgtgtggcg

SEQ ID NO: 60643 - DNA, 20 bp, Human herpesvirus
ctccgtgctccttcattgtc

SEQ ID NO: 60644 - DNA, 20 bp, Human herpesvirus
ccgacaatgaaggagcacgg

SEQ ID NO: 60645 - DNA, 20 bp, Human herpesvirus
acgtgcaggcgccacacggt

SEQ ID NO: 60646 - DNA, 20 bp, Human herpesvirus
cgtgcaggcgccacacggtc

SEQ ID NO: 60647 - DNA, 20 bp, Human herpesvirus
cctgctcttttgcgtgctgc

SEQ ID NO: 60648 - DNA, 20 bp, Human herpesvirus
tgcgtgctgctggaagcctg

SEQ ID NO: 60649 - DNA, 20 bp, Human herpesvirus
gcgtgctgctggaagcctgc

SEQ ID NO: 60650 - DNA, 20 bp, Human herpesvirus
cgtgctgctggaagcctgct

SEQ ID NO: 60651 - DNA, 20 bp, Human herpesvirus
cttaacctcggcctcggttg

SEQ ID NO: 60652 - DNA, 20 bp, Human herpesvirus
ttaaaaatccctttggggtc

SEQ ID NO: 60653 - DNA, 20 bp, Human herpesvirus
taaaaatccctttggggtcc

SEQ ID NO: 60654 - DNA, 20 bp, Human herpesvirus
aaaaatccctttggggtcct

SEQ ID NO: 60655 - DNA, 20 bp, Human herpesvirus
aaaatccctttggggtcctc

SEQ ID NO: 60656 - DNA, 20 bp, Human herpesvirus
ggggtcctcttgagtccctg

SEQ ID NO: 60657 - DNA, 20 bp, Human herpesvirus
tgttcggtctcccggattca

SEQ ID NO: 60658 - DNA, 20 bp, Human herpesvirus
ggtctcccggattcactgcc

SEQ ID NO: 60659 - DNA, 20 bp, Human herpesvirus
actgccatctctgaagggcc

SEQ ID NO: 60660 - DNA, 20 bp, Human herpesvirus
atcataggtggcatggccct

SEQ ID NO: 60661 - DNA, 20 bp, Human herpesvirus
agagatggcagtgaatccgg

SEQ ID NO: 60662 - DNA, 20 bp, Human herpesvirus
gagtgcaggtaaacgccaag

SEQ ID NO: 60663 - DNA, 20 bp, Human herpesvirus
gcctacgcacaagtggcttc

SEQ ID NO: 60664 - DNA, 20 bp, Human herpesvirus
ttaacgcgtaggggtgcggt

SEQ ID NO: 60665 - DNA, 20 bp, Human herpesvirus
agaagccacttgtgcgtagg

SEQ ID NO: 60666 - DNA, 20 bp, Human herpesvirus
tgcgtaggcgaagagaccgc

SEQ ID NO: 60667 - DNA, 20 bp, Human herpesvirus
tgtcagttccacggcgtgtt

SEQ ID NO: 60668 - DNA, 20 bp, Human herpesvirus
cacggcgtgttttgcctgta

SEQ ID NO: 60669 - DNA, 20 bp, Human herpesvirus
tgcctgtaccagtgtcgcca

SEQ ID NO: 60670 - DNA, 20 bp, Human herpesvirus
gcctgtaccagtgtcgccag

SEQ ID NO: 60671 - DNA, 20 bp, Human herpesvirus
cctgtaccagtgtcgccagt

SEQ ID NO: 60672 - DNA, 20 bp, Human herpesvirus
cgtaccagagtcccgagctc

SEQ ID NO: 60673 - DNA, 20 bp, Human herpesvirus
gcgcttcagtgcaccgtggg

SEQ ID NO: 60674 - DNA, 20 bp, Human herpesvirus
agtgcaccgtgggccctgac

SEQ ID NO: 60675 - DNA, 20 bp, Human herpesvirus
caggagaggtatttcccact

SEQ ID NO: 60676 - DNA, 20 bp, Human herpesvirus
cccactgggcggagttacat

SEQ ID NO: 60677 - DNA, 20 bp, Human herpesvirus
ccactgggcggagttacatg

SEQ ID NO: 60678 - DNA, 20 bp, Human herpesvirus
catgttatcagtgactggat

SEQ ID NO: 60679 - DNA, 20 bp, Human herpesvirus
tcagtgactggatgtgggca

SEQ ID NO: 60680 - DNA, 20 bp, Human herpesvirus
ctgaacacgcccgtgacctg

SEQ ID NO: 60681 - DNA, 20 bp, Human herpesvirus
gcgctgcgactgcagaatca

SEQ ID NO: 60682 - DNA, 20 bp, Human herpesvirus
acgatcgtctgattctgcag

SEQ ID NO: 60683 - DNA, 20 bp, Human herpesvirus
tgcagtcgcagcgccaactc

SEQ ID NO: 60684 - DNA, 20 bp, Human herpesvirus
agtaatagacgggacgcatt

SEQ ID NO: 60685 - DNA, 20 bp, Human herpesvirus
cgcaacatggtaaggcgacg

SEQ ID NO: 60686 - DNA, 20 bp, Human herpesvirus
ccatgttgcgcaattcaggc

SEQ ID NO: 60687 - DNA, 20 bp, Human herpesvirus
cgcaattcaggcatcggcag

SEQ ID NO: 60688 - DNA, 20 bp, Human herpesvirus
aggcatcggcagcctctacc

SEQ ID NO: 60689 - DNA, 20 bp, Human herpesvirus
ttctttgcggtccactctat

SEQ ID NO: 60690 - DNA, 20 bp, Human herpesvirus
ttaggatatccctaacttcg

SEQ ID NO: 60691 - DNA, 20 bp, Human herpesvirus
ggatatccctaacttcggag

SEQ ID NO: 60692 - DNA, 20 bp, Human herpesvirus
ggagcggagacggccggacg

SEQ ID NO: 60693 - DNA, 20 bp, Human herpesvirus
tgtgggagcgtccggccgtc

SEQ ID NO: 60694 - DNA, 20 bp, Human herpesvirus
gtgggagcgtccggccgtct

SEQ ID NO: 60695 - DNA, 20 bp, Human herpesvirus
ctcaaggggccgtgattact

SEQ ID NO: 60696 - DNA, 20 bp, Human herpesvirus
ctgcgacaacggtgccgcag

SEQ ID NO: 60697 - DNA, 20 bp, Human herpesvirus
caggcaactcccctccggta

SEQ ID NO: 60698 - DNA, 20 bp, Human herpesvirus
cctgcggcaccgttgtcgca

SEQ ID NO: 60699 - DNA, 20 bp, Human herpesvirus
tcgcagtaatcacggcccct

SEQ ID NO: 60700 - DNA, 20 bp, Human herpesvirus
ctcccggcgctcgcccaacc

SEQ ID NO: 60701 - DNA, 20 bp, Human herpesvirus
cgggcggtcatgacggagac

SEQ ID NO: 60702 - DNA, 20 bp, Human herpesvirus
gtctccgtcatgaccgcccg

SEQ ID NO: 60703 - DNA, 20 bp, Human herpesvirus
gcccgaggcttctggttggg

SEQ ID NO: 60704 - DNA, 20 bp, Human herpesvirus
tggttgggcgagcgccggga

SEQ ID NO: 60705 - DNA, 20 bp, Human herpesvirus
ggtgcagcgcgacactgtcc

SEQ ID NO: 60706 - DNA, 20 bp, Human herpesvirus
ttctgccgtattgtaggcgg

SEQ ID NO: 60707 - DNA, 20 bp, Human herpesvirus
tgccgtattgtaggcggtcg

SEQ ID NO: 60708 - DNA, 20 bp, Human herpesvirus
taggcggtcgcgtggtctgc

SEQ ID NO: 60709 - DNA, 20 bp, Human herpesvirus
taacatgatggtttcgcata

SEQ ID NO: 60710 - DNA, 20 bp, Human herpesvirus
cgcatacccgggcgcggggg

SEQ ID NO: 60711 - DNA, 20 bp, Human herpesvirus
gcatacccgggcgcgggggc

SEQ ID NO: 60712 - DNA, 20 bp, Human herpesvirus
aggttcgaagggatacaccc

SEQ ID NO: 60713 - DNA, 20 bp, Human herpesvirus
gaagggatacacccgctcac

SEQ ID NO: 60714 - DNA, 20 bp, Human herpesvirus
gccgctttgggggagcaatc

SEQ ID NO: 60715 - DNA, 20 bp, Human herpesvirus
gggggagcaatccctgtggc

SEQ ID NO: 60716 - DNA, 20 bp, Human herpesvirus
ggggagcaatccctgtggcg

SEQ ID NO: 60717 - DNA, 20 bp, Human herpesvirus
ccgcttgggcgtgcggcgga

SEQ ID NO: 60718 - DNA, 20 bp, Human herpesvirus
gtcggtgagttcagccaggg

SEQ ID NO: 60719 - DNA, 20 bp, Human herpesvirus
gcggatgcactttctccggg

SEQ ID NO: 60720 - DNA, 20 bp, Human herpesvirus
ctccgggagaccagacgcgc

SEQ ID NO: 60721 - DNA, 20 bp, Human herpesvirus
tccgggagaccagacgcgcc

SEQ ID NO: 60722 - DNA, 20 bp, Human herpesvirus
tccatggggagatcttcctg

SEQ ID NO: 60723 - DNA, 20 bp, Human herpesvirus
ccatggggagatcttcctgt

SEQ ID NO: 60724 - DNA, 20 bp, Human herpesvirus
tcgcgtcccagaggacccca

SEQ ID NO: 60725 - DNA, 20 bp, Human herpesvirus
actggtatccacacggagca

SEQ ID NO: 60726 - DNA, 20 bp, Human herpesvirus
tgttcagtcgttatatcgcc

SEQ ID NO: 60727 - DNA, 20 bp, Human herpesvirus
tccccctctcacaccagttg

SEQ ID NO: 60728 - DNA, 20 bp, Human herpesvirus
gtccctttgggccgctggag

SEQ ID NO: 60729 - DNA, 20 bp, Human herpesvirus
gggccgctggaggacgcctc

SEQ ID NO: 60730 - DNA, 20 bp, Human herpesvirus
ggccgctggaggacgcctct

SEQ ID NO: 60731 - DNA, 20 bp, Human herpesvirus
cgcggtgatgtgtgggggct

SEQ ID NO: 60732 - DNA, 20 bp, Human herpesvirus
atttccgccacgtcccgtct

SEQ ID NO: 60733 - DNA, 20 bp, Human herpesvirus
ccgccacgtcccgtctttcc

SEQ ID NO: 60734 - DNA, 20 bp, Human herpesvirus
cgccacgtcccgtctttccg

SEQ ID NO: 60735 - DNA, 20 bp, Human herpesvirus
aaggagcccacgttctcccg

SEQ ID NO: 60736 - DNA, 20 bp, Human herpesvirus
tcccgccacattataagcaa

SEQ ID NO: 60737 - DNA, 20 bp, Human herpesvirus
cttataatgtggcgggagaa

SEQ ID NO: 60738 - DNA, 20 bp, Human herpesvirus
taatgtggcgggagaacgtg

SEQ ID NO: 60739 - DNA, 20 bp, Human herpesvirus
aaccggccctgttggacgat

SEQ ID NO: 60740 - DNA, 20 bp, Human herpesvirus
tatcacccccagcacatcgc

SEQ ID NO: 60741 - DNA, 20 bp, Human herpesvirus
ggctccgttacctgcggtgc

SEQ ID NO: 60742 - DNA, 20 bp, Human herpesvirus
cctgcggtgctggcagatgc

SEQ ID NO: 60743 - DNA, 20 bp, Human herpesvirus
gcccaccacagacacctccc

SEQ ID NO: 60744 - DNA, 20 bp, Human herpesvirus
tctgcgggggggcttgtgtc

SEQ ID NO: 60745 - DNA, 20 bp, Human herpesvirus
ctgcgggggggcttgtgtct

SEQ ID NO: 60746 - DNA, 20 bp, Human herpesvirus
tgcgggggggcttgtgtctc

SEQ ID NO: 60747 - DNA, 20 bp, Human herpesvirus
tgtctctcgcgtgaggtgag

SEQ ID NO: 60748 - DNA, 20 bp, Human herpesvirus
aacgctcgaatcacgccgtg

SEQ ID NO: 60749 - DNA, 20 bp, Human herpesvirus
ccccaaggcgcaccgtagcc

SEQ ID NO: 60750 - DNA, 20 bp, Human herpesvirus
atctccggcgggatcctgat

SEQ ID NO: 60751 - DNA, 20 bp, Human herpesvirus
tctccggcgggatcctgatt

SEQ ID NO: 60752 - DNA, 20 bp, Human herpesvirus
cgcgggctacggtgcgcctt

SEQ ID NO: 60753 - DNA, 20 bp, Human herpesvirus
cgcacgagaccaggtccctc

SEQ ID NO: 60754 - DNA, 20 bp, Human herpesvirus
ataaggctcaaaaaacacag

SEQ ID NO: 60755 - DNA, 20 bp, Human herpesvirus
tttgagccttattaagtccc

SEQ ID NO: 60756 - DNA, 20 bp, Human herpesvirus
ttgagccttattaagtcccg

SEQ ID NO: 60757 - DNA, 20 bp, Human herpesvirus
tgagccttattaagtcccgc

SEQ ID NO: 60758 - DNA, 20 bp, Human herpesvirus
cgcctgcccagggagcagga

SEQ ID NO: 60759 - DNA, 20 bp, Human herpesvirus
gcatcgaggagctgtccggc

SEQ ID NO: 60760 - DNA, 20 bp, Human herpesvirus
ttatactcctgctccctggg

SEQ ID NO: 60761 - DNA, 20 bp, Human herpesvirus
tatactcctgctccctgggc

SEQ ID NO: 60762 - DNA, 20 bp, Human herpesvirus
atactcctgctccctgggca

SEQ ID NO: 60763 - DNA, 20 bp, Human herpesvirus
gggaggaagacgtggttacg

SEQ ID NO: 60764 - DNA, 20 bp, Human herpesvirus
cggggggtaagagtgccggt

SEQ ID NO: 60765 - DNA, 20 bp, Human herpesvirus
cgggagcgggtgaaggaatg

SEQ ID NO: 60766 - DNA, 20 bp, Human herpesvirus
cttcacccgctcccgcaaca

SEQ ID NO: 60767 - DNA, 20 bp, Human herpesvirus
acccgctcccgcaacacctt

SEQ ID NO: 60768 - DNA, 20 bp, Human herpesvirus
cagagacccctggggcactg

SEQ ID NO: 60769 - DNA, 20 bp, Human herpesvirus
agagacccctggggcactgg

SEQ ID NO: 60770 - DNA, 20 bp, Human herpesvirus
aggtgccccaggtacacttg

SEQ ID NO: 60771 - DNA, 20 bp, Human herpesvirus
tcagaggtgctgcgggcggc

SEQ ID NO: 60772 - DNA, 20 bp, Human herpesvirus
ccttcgacctttacgtccgg

SEQ ID NO: 60773 - DNA, 20 bp, Human herpesvirus
gacctttacgtccggggtga

SEQ ID NO: 60774 - DNA, 20 bp, Human herpesvirus
acgtccggggtgaccctgta

SEQ ID NO: 60775 - DNA, 20 bp, Human herpesvirus
cgtccggggtgaccctgtat

SEQ ID NO: 60776 - DNA, 20 bp, Human herpesvirus
acctcggcccagctggtaaa

SEQ ID NO: 60777 - DNA, 20 bp, Human herpesvirus
cttgcaggcgaagaggcact

SEQ ID NO: 60778 - DNA, 20 bp, Human herpesvirus
caggcgaagaggcactcctg

SEQ ID NO: 60779 - DNA, 20 bp, Human herpesvirus
gtggtcctccggactccacg

SEQ ID NO: 60780 - DNA, 20 bp, Human herpesvirus
gcctgcaaggaattctgccg

SEQ ID NO: 60781 - DNA, 20 bp, Human herpesvirus
tgccgggagctgggagtggc

SEQ ID NO: 60782 - DNA, 20 bp, Human herpesvirus
cagactaccacctggtgctg

SEQ ID NO: 60783 - DNA, 20 bp, Human herpesvirus
agactaccacctggtgctgc

SEQ ID NO: 60784 - DNA, 20 bp, Human herpesvirus
gcaagccgctgaaccagctt

SEQ ID NO: 60785 - DNA, 20 bp, Human herpesvirus
agggtctccaagatgcgcac

SEQ ID NO: 60786 - DNA, 20 bp, Human herpesvirus
tcggagctgtcgcgatagag

SEQ ID NO: 60787 - DNA, 20 bp, Human herpesvirus
gagaccctgaagctggttca

SEQ ID NO: 60788 - DNA, 20 bp, Human papillomavirus
ttgctttgcaaagagtatgg

SEQ ID NO: 60789 - DNA, 20 bp, Human papillomavirus
tgctttgcaaagagtatggt

SEQ ID NO: 60790 - DNA, 20 bp, Human papillomavirus
gctttgcaaagagtatggtt

SEQ ID NO: 60791 - DNA, 20 bp, Human papillomavirus
ctttgcaaagagtatggttt

SEQ ID NO: 60792 - DNA, 20 bp, Human papillomavirus
gcaaagagtatggtttggag

SEQ ID NO: 60793 - DNA, 20 bp, Human papillomavirus
agtgcggacaagcagaccta

SEQ ID NO: 60794 - DNA, 20 bp, Human papillomavirus
ttgaagacgctgactctagt

SEQ ID NO: 60795 - DNA, 20 bp, Human papillomavirus
aagacgctgactctagtgtg

SEQ ID NO: 60796 - DNA, 20 bp, Human papillomavirus
tggaggattccgaaggtacc

SEQ ID NO: 60797 - DNA, 20 bp, Human papillomavirus
ggaatcctccataacgctag

SEQ ID NO: 60798 - DNA, 20 bp, Human papillomavirus
ttggaacgccagaggaggta

SEQ ID NO: 60799 - DNA, 20 bp, Human papillomavirus
gaacgccagaggaggtaacg

SEQ ID NO: 60800 - DNA, 20 bp, Human papillomavirus
gatctgcctctccgtctccc

SEQ ID NO: 60801 - DNA, 20 bp, Human papillomavirus
acgctcctcctcctgatcct

SEQ ID NO: 60802 - DNA, 20 bp, Human papillomavirus
gctttcctcatcccccgtta

SEQ ID NO: 60803 - DNA, 20 bp, Human papillomavirus
tactggtacaagacggccat

SEQ ID NO: 60804 - DNA, 20 bp, Human papillomavirus
ttagacagacgttggtagga

SEQ ID NO: 60805 - DNA, 20 bp, Human papillomavirus
gacagacgttggtaggacat

SEQ ID NO: 60806 - DNA, 20 bp, Human papillomavirus
gtaggacatagcatggaaga

SEQ ID NO: 60807 - DNA, 20 bp, Human papillomavirus
gtcttccatgctatgtccta

SEQ ID NO: 60808 - DNA, 20 bp, Human papillomavirus
gtgtcgttcctagctgcctt

SEQ ID NO: 60809 - DNA, 20 bp, Human papillomavirus
tgtcgttcctagctgccttt

SEQ ID NO: 60810 - DNA, 20 bp, Human papillomavirus
ctagctgcctttaaattgtt

SEQ ID NO: 60811 - DNA, 20 bp, Human papillomavirus
aaattgttcctaaaaggcgt

SEQ ID NO: 60812 - DNA, 20 bp, Human papillomavirus
aattgttcctaaaaggcgtg

SEQ ID NO: 60813 - DNA, 20 bp, Human papillomavirus
gctgcagcttaagtgtccac

SEQ ID NO: 60814 - DNA, 20 bp, Human papillomavirus
ctgcagcttaagtgtccacc

SEQ ID NO: 60815 - DNA, 20 bp, Human papillomavirus
agtgtccacccctaatgata

SEQ ID NO: 60816 - DNA, 20 bp, Human papillomavirus
gcgcagcaggctgacagtgt

SEQ ID NO: 60817 - DNA, 20 bp, Human papillomavirus
cgcagcaggctgacagtgtt

SEQ ID NO: 60818 - DNA, 20 bp, Human papillomavirus
cagacattgatgcagagtgc

SEQ ID NO: 60819 - DNA, 20 bp, Human papillomavirus
gcttttgacacggtgagggc

SEQ ID NO: 60820 - DNA, 20 bp, Human papillomavirus
tgacacggtgagggcaggca

SEQ ID NO: 60821 - DNA, 20 bp, Human papillomavirus
gacacggtgagggcaggcac

SEQ ID NO: 60822 - DNA, 20 bp, Human papillomavirus
acacggtgagggcaggcaca

SEQ ID NO: 60823 - DNA, 20 bp, Human papillomavirus
gaactgctgtatccccagtc

SEQ ID NO: 60824 - DNA, 20 bp, Human papillomavirus
ctgctcctgttgattctgct

SEQ ID NO: 60825 - DNA, 20 bp, Human papillomavirus
attctgctgaggctgcgact

SEQ ID NO: 60826 - DNA, 20 bp, Human papillomavirus
tgctgaggctgcgactgggg

SEQ ID NO: 60827 - DNA, 20 bp, Human papillomavirus
taataggggatagtggttcg

SEQ ID NO: 60828 - DNA, 20 bp, Human papillomavirus
aacagcgtacagagttcctg

SEQ ID NO: 60829 - DNA, 20 bp, Human papillomavirus
ctgacaagagtcagtatacc

SEQ ID NO: 60830 - DNA, 20 bp, Human papillomavirus
atagcattgccagggtatat

SEQ ID NO: 60831 - DNA, 20 bp, Human papillomavirus
ccagggtatatgtctgcatt

SEQ ID NO: 60832 - DNA, 20 bp, Human papillomavirus
gtataatcctacatgcttgt

SEQ ID NO: 60833 - DNA, 20 bp, Human papillomavirus
aatgtctgttggtgattctt

SEQ ID NO: 60834 - DNA, 20 bp, Human papillomavirus
gtgattcttatcctaatcgc

SEQ ID NO: 60835 - DNA, 20 bp, Human papillomavirus
ttatcctaatcgccttttta

SEQ ID NO: 60836 - DNA, 20 bp, Human papillomavirus
tcctaatcgcctttttattg

SEQ ID NO: 60837 - DNA, 20 bp, Human papillomavirus
ttattgttgatgttttatgt

SEQ ID NO: 60838 - DNA, 20 bp, Human papillomavirus
actggtactggtggcttcga

SEQ ID NO: 60839 - DNA, 20 bp, Human papillomavirus
ctggtactggtggcttcgaa

SEQ ID NO: 60840 - DNA, 20 bp, Human papillomavirus
gaagtgacaacctccaccgt

SEQ ID NO: 60841 - DNA, 20 bp, Human papillomavirus
cagaccccgccgtcttggat

SEQ ID NO: 60842 - DNA, 20 bp, Human papillomavirus
gatatcaccccctcaggtac

SEQ ID NO: 60843 - DNA, 20 bp, Human papillomavirus
tatgatgtttatgctgattc

SEQ ID NO: 60844 - DNA, 20 bp, Human papillomavirus
atgctgattcggatgtcctt

SEQ ID NO: 60845 - DNA, 20 bp, Human papillomavirus
tgctgattcggatgtccttc

SEQ ID NO: 60846 - DNA, 20 bp, Human papillomavirus
ggatgtccttcagccattgc

SEQ ID NO: 60847 - DNA, 20 bp, Human papillomavirus
agccattgcttgatgagtta

SEQ ID NO: 60848 - DNA, 20 bp, Human papillomavirus
caaaggtgatcagtacggat

SEQ ID NO: 60849 - DNA, 20 bp, Human papillomavirus
aaaggtgatcagtacggatg

SEQ ID NO: 60850 - DNA, 20 bp, Human papillomavirus
gtccgcgtgacatagacatc

SEQ ID NO: 60851 - DNA, 20 bp, Human papillomavirus
gaaacaggtgttggaggtag

SEQ ID NO: 60852 - DNA, 20 bp, Human papillomavirus
aaacaggtgttggaggtagg

SEQ ID NO: 60853 - DNA, 20 bp, Human papillomavirus
aaacagggttcggtgccttg

SEQ ID NO: 60854 - DNA, 20 bp, Human papillomavirus
ggtgccttggattttgccac

SEQ ID NO: 60855 - DNA, 20 bp, Human papillomavirus
gattttgccactctgcagtc

SEQ ID NO: 60856 - DNA, 20 bp, Human papillomavirus
tgccactctgcagtcaaata

SEQ ID NO: 60857 - DNA, 20 bp, Human papillomavirus
gccactctgcagtcaaataa

SEQ ID NO: 60858 - DNA, 20 bp, Human papillomavirus
gcagttcatcttccaactgt

SEQ ID NO: 60859 - DNA, 20 bp, Human papillomavirus
cagttcatcttccaactgtg

SEQ ID NO: 60860 - DNA, 20 bp, Human papillomavirus
atcttccaactgtgcaagat

SEQ ID NO: 60861 - DNA, 20 bp, Human papillomavirus
caactgtgcaagataaccct

SEQ ID NO: 60862 - DNA, 20 bp, Human papillomavirus
ctcctgaaattatggcctat

SEQ ID NO: 60863 - DNA, 20 bp, Human papillomavirus
tgtgttctgtaactgtacgt

SEQ ID NO: 60864 - DNA, 20 bp, Human papillomavirus
tgtaactgtacgttctggtg

SEQ ID NO: 60865 - DNA, 20 bp, Human papillomavirus
tggtgcacagatttctgcac

SEQ ID NO: 60866 - DNA, 20 bp, Human papillomavirus
ctgcaccccatcgccttgtg

SEQ ID NO: 60867 - DNA, 20 bp, Human papillomavirus
tgcaccccatcgccttgtgt

SEQ ID NO: 60868 - DNA, 20 bp, Human papillomavirus type 134
cctggaactgcttaatgagc

SEQ ID NO: 60869 - DNA, 20 bp, Human papillomavirus type 134
atgagcagctgctgcaagaa

SEQ ID NO: 60870 - DNA, 20 bp, Human papillomavirus type 134
aattggcagatctaaaacga

SEQ ID NO: 60871 - DNA, 20 bp, Human papillomavirus type 134
gcagatctaaaacgaaagta

SEQ ID NO: 60872 - DNA, 20 bp, Human papillomavirus type 134
ctctggactcaaatactttc

SEQ ID NO: 60873 - DNA, 20 bp, Human papillomavirus type 134
tattggggttacacaggtag

SEQ ID NO: 60874 - DNA, 20 bp, Human papillomavirus type 134
gggttacacaggtagagtct

SEQ ID NO: 60875 - DNA, 20 bp, Human papillomavirus type 134
cacaggtagagtctgtctct

SEQ ID NO: 60876 - DNA, 20 bp, Human papillomavirus type 134
ccagacagtagacgatggcg

SEQ ID NO: 60877 - DNA, 20 bp, Human papillomavirus type 134
ttgcaaagtaaaaatagacg

SEQ ID NO: 60878 - DNA, 20 bp, Human papillomavirus type 134
tggttacagcctttaacaga

SEQ ID NO: 60879 - DNA, 20 bp, Human papillomavirus type 134
ggttacagcctttaacagac

SEQ ID NO: 60880 - DNA, 20 bp, Human papillomavirus type 134
gttacagcctttaacagaca

SEQ ID NO: 60881 - DNA, 20 bp, Human papillomavirus type 134
cagcctttaacagacagtaa

SEQ ID NO: 60882 - DNA, 20 bp, Human papillomavirus type 134
aacagacagtaaatttgggc

SEQ ID NO: 60883 - DNA, 20 bp, Human papillomavirus type 134
tattatgcaaggcagaaagg

SEQ ID NO: 60884 - DNA, 20 bp, Human papillomavirus type 134
tgcaaggcagaaaggaatat

SEQ ID NO: 60885 - DNA, 20 bp, Human papillomavirus type 134
catctttagctgtaagtgaa

SEQ ID NO: 60886 - DNA, 20 bp, Human papillomavirus type 134
agctgtaagtgaatttaaag

SEQ ID NO: 60887 - DNA, 20 bp, Human papillomavirus type 134
gctgtaagtgaatttaaagc

SEQ ID NO: 60888 - DNA, 20 bp, Human papillomavirus type 134
gttgcacaaaccggagaaac

SEQ ID NO: 60889 - DNA, 20 bp, Human papillomavirus type 134
cacaaaccggagaaacctcc

SEQ ID NO: 60890 - DNA, 20 bp, Human papillomavirus type 134
cctctgggtgttgatgagga

SEQ ID NO: 60891 - DNA, 20 bp, Human papillomavirus type 134
atgaggatgtccttcgactt

SEQ ID NO: 60892 - DNA, 20 bp, Human papillomavirus type 134
gacttccccctcgtcgcccc

SEQ ID NO: 60893 - DNA, 20 bp, Human papillomavirus type 134
ctgatcgtttgttgaagata

SEQ ID NO: 60894 - DNA, 20 bp, Human papillomavirus type 134
gttgaagatattcagtagtt

SEQ ID NO: 60895 - DNA, 20 bp, Human papillomavirus type 134
ttgaagatattcagtagttt

SEQ ID NO: 60896 - DNA, 20 bp, Human papillomavirus type 134
aagatattcagtagtttagt

SEQ ID NO: 60897 - DNA, 20 bp, Human papillomavirus type 134
agtagtttagtatactttgg

SEQ ID NO: 60898 - DNA, 20 bp, Human papillomavirus type 134
gacataactacagaaccaga

SEQ ID NO: 60899 - DNA, 20 bp, Human papillomavirus type 134
acataactacagaaccagac

SEQ ID NO: 60900 - DNA, 20 bp, Human papillomavirus type 134
tagacactgcaggagtatta

SEQ ID NO: 60901 - DNA, 20 bp, Human papillomavirus type 134
ctaccactacttatttctat

SEQ ID NO: 60902 - DNA, 20 bp, Human papillomavirus type 134
tttctattatgtctggttct

SEQ ID NO: 60903 - DNA, 20 bp, Human papillomavirus type 134
gaacaggatttaaatcagat

SEQ ID NO: 60904 - DNA, 20 bp, Human papillomavirus type 134
aacaggatttaaatcagata

SEQ ID NO: 60905 - DNA, 20 bp, Human papillomavirus type 134
aaatcagatagcaactgctg

SEQ ID NO: 60906 - DNA, 20 bp, Human papillomavirus type 134
aatcagatagcaactgctgc

SEQ ID NO: 60907 - DNA, 20 bp, Human papillomavirus type 134
tgctgacataataaaactag

SEQ ID NO: 60908 - DNA, 20 bp, Human papillomavirus type 134
tggtgaaggactctttgtgt

SEQ ID NO: 60909 - DNA, 20 bp, Human papillomavirus type 134
gtgtctcaccctcagggacg

SEQ ID NO: 60910 - DNA, 20 bp, Human papillomavirus type 134
tgtctcaccctcagggacga

SEQ ID NO: 60911 - DNA, 20 bp, Human papillomavirus type 134
ccagcaataataacaccagg

SEQ ID NO: 60912 - DNA, 20 bp, Human papillomavirus type 134
atatgctaggtctgcctgca

SEQ ID NO: 60913 - DNA, 20 bp, Human papillomavirus type 134
tgtgcaagaaacagaaatat

SEQ ID NO: 60914 - DNA, 20 bp, Human papillomavirus type 134
cacggcagtagtgatcgcct

SEQ ID NO: 60915 - DNA, 20 bp, Human papillomavirus type 134
taacagttggacatccatat

SEQ ID NO: 60916 - DNA, 20 bp, Human papillomavirus type 134
gacatccatattttccaata

SEQ ID NO: 60917 - DNA, 20 bp, Human papillomavirus type 134
ttggaaaatatggatgtcca

SEQ ID NO: 60918 - DNA, 20 bp, Human papillomavirus type 134
aggaattggaacaacaggtc

SEQ ID NO: 60919 - DNA, 20 bp, Human papillomavirus type 134
ggaattggaacaacaggtca

SEQ ID NO: 60920 - DNA, 20 bp, Human papillomavirus type 134
gaacaacaggtcaccccttg

SEQ ID NO: 60921 - DNA, 20 bp, Human papillomavirus type 134
ctaaataagttaaacgatac

SEQ ID NO: 60922 - DNA, 20 bp, Human papillomavirus type 134
aacgatacagagaatccaaa

SEQ ID NO: 60923 - DNA, 20 bp, Human papillomavirus type 134
gttaattcttacattgagga

SEQ ID NO: 60924 - DNA, 20 bp, Human papillomavirus type 134
attcttacattgaggatgga

SEQ ID NO: 60925 - DNA, 20 bp, Human papillomavirus type 134
ttacattgaggatggagaca

SEQ ID NO: 60926 - DNA, 20 bp, Human papillomavirus type 134
cattgaggatggagacatgt

SEQ ID NO: 60927 - DNA, 20 bp, Human papillomavirus type 134
aggatggagacatgtgtgat

SEQ ID NO: 60928 - DNA, 20 bp, Human papillomavirus type 134
atatgtgttacctggtcaag

SEQ ID NO: 60929 - DNA, 20 bp, Human papillomavirus type 134
tatgtgttacctggtcaagg

SEQ ID NO: 60930 - DNA, 20 bp, Human papillomavirus type 134
cctggtcaaggtactcaggc

SEQ ID NO: 60931 - DNA, 20 bp, Human papillomavirus type 134
cttcatcagtttactttcct

SEQ ID NO: 60932 - DNA, 20 bp, Human papillomavirus type 134
ttcatcagtttactttccta

SEQ ID NO: 60933 - DNA, 20 bp, Human papillomavirus type 134
gctaagtataacttttggga

SEQ ID NO: 60934 - DNA, 20 bp, Human papillomavirus type 134
ctaagtataacttttgggat

SEQ ID NO: 60935 - DNA, 20 bp, Human papillomavirus type 134
tgggatgtggatctatcaga

SEQ ID NO: 60936 - DNA, 20 bp, Human papillomavirus type 134
gggatgtggatctatcagac

SEQ ID NO: 60937 - DNA, 20 bp, Human papillomavirus type 134
ggatgtggatctatcagaca

SEQ ID NO: 60938 - DNA, 20 bp, Human papillomavirus type 134
taaactgtgaataataaatg

SEQ ID NO: 60939 - DNA, 20 bp, Human papillomavirus type 134
aaactgtgaataataaatgg

SEQ ID NO: 60940 - DNA, 20 bp, Human papillomavirus type 134
aactgtgaataataaatggt

SEQ ID NO: 60941 - DNA, 20 bp, Human papillomavirus type 134
tgtgttactgactcacaggg

SEQ ID NO: 60942 - DNA, 20 bp, Human papillomavirus type 134
ctgactcacagggtctttgg

SEQ ID NO: 60943 - DNA, 20 bp, Human papillomavirus type 137
ttattactgtttacgtgttt

SEQ ID NO: 60944 - DNA, 20 bp, Human papillomavirus type 137
ttactgtttacgtgttttaa

SEQ ID NO: 60945 - DNA, 20 bp, Human papillomavirus type 137
ctgtttacgtgttttaacat

SEQ ID NO: 60946 - DNA, 20 bp, Human papillomavirus type 137
acgtgttttaacattggtgg

SEQ ID NO: 60947 - DNA, 20 bp, Human papillomavirus type 137
cgtgttttaacattggtgga

SEQ ID NO: 60948 - DNA, 20 bp, Human papillomavirus type 137
ggaggaattatttgacgaaa

SEQ ID NO: 60949 - DNA, 20 bp, Human papillomavirus type 137
gaggaattatttgacgaaag

SEQ ID NO: 60950 - DNA, 20 bp, Human papillomavirus type 137
tttgacgaaagtactgatgg

SEQ ID NO: 60951 - DNA, 20 bp, Human papillomavirus type 137
gacgaaagtactgatgggtc

SEQ ID NO: 60952 - DNA, 20 bp, Human papillomavirus type 137
acgaaagtactgatgggtcc

SEQ ID NO: 60953 - DNA, 20 bp, Human papillomavirus type 137
caggacagtggcatagcaga

SEQ ID NO: 60954 - DNA, 20 bp, Human papillomavirus type 137
aggacagtggcatagcagaa

SEQ ID NO: 60955 - DNA, 20 bp, Human papillomavirus type 137
ttctgaacaggtagaaacta

SEQ ID NO: 60956 - DNA, 20 bp, Human papillomavirus type 137
tgaacaggtagaaactatag

SEQ ID NO: 60957 - DNA, 20 bp, Human papillomavirus type 137
tgaaaatggcgcagatgatg

SEQ ID NO: 60958 - DNA, 20 bp, Human papillomavirus type 137
ccagattgggttactaaaca

SEQ ID NO: 60959 - DNA, 20 bp, Human papillomavirus type 137
ggttactaaacaaacaatgg

SEQ ID NO: 60960 - DNA, 20 bp, Human papillomavirus type 137
ctaaacaaacaatggtgaat

SEQ ID NO: 60961 - DNA, 20 bp, Human papillomavirus type 137
gatctatcacaaatggtaca

SEQ ID NO: 60962 - DNA, 20 bp, Human papillomavirus type 137
atctatcacaaatggtacaa

SEQ ID NO: 60963 - DNA, 20 bp, Human papillomavirus type 137
caactgctgcagaagttgga

SEQ ID NO: 60964 - DNA, 20 bp, Human papillomavirus type 137
gaagcaatcatagaacagtt

SEQ ID NO: 60965 - DNA, 20 bp, Human papillomavirus type 137
aaggaactgttctatgattg

SEQ ID NO: 60966 - DNA, 20 bp, Human papillomavirus type 137
tatgattgcttccaacttct

SEQ ID NO: 60967 - DNA, 20 bp, Human papillomavirus type 137
cttccaacttctgcagcagt

SEQ ID NO: 60968 - DNA, 20 bp, Human papillomavirus type 137
tagtagcatttgacagcgat

SEQ ID NO: 60969 - DNA, 20 bp, Human papillomavirus type 137
agtagcatttgacagcgata

SEQ ID NO: 60970 - DNA, 20 bp, Human papillomavirus type 137
gtagcatttgacagcgataa

SEQ ID NO: 60971 - DNA, 20 bp, Human papillomavirus type 137
gacagcgataaacaaagaga

SEQ ID NO: 60972 - DNA, 20 bp, Human papillomavirus type 137
acagcgataaacaaagagat

SEQ ID NO: 60973 - DNA, 20 bp, Human papillomavirus type 137
ttactaaaagtgtttggaag

SEQ ID NO: 60974 - DNA, 20 bp, Human papillomavirus type 137
tactaaaagtgtttggaagt

SEQ ID NO: 60975 - DNA, 20 bp, Human papillomavirus type 137
actaaaagtgtttggaagtg

SEQ ID NO: 60976 - DNA, 20 bp, Human papillomavirus type 137
ctaaaagtgtttggaagtgt

SEQ ID NO: 60977 - DNA, 20 bp, Human papillomavirus type 137
ggaagtgtggtctattttgg

SEQ ID NO: 60978 - DNA, 20 bp, Human papillomavirus type 137
ccctgggttagcagcagata

SEQ ID NO: 60979 - DNA, 20 bp, Human papillomavirus type 137
cctgggttagcagcagataa

SEQ ID NO: 60980 - DNA, 20 bp, Human papillomavirus type 137
gcagcagataatgaaaatat

SEQ ID NO: 60981 - DNA, 20 bp, Human papillomavirus type 137
gtgaacacccaaatattatt

SEQ ID NO: 60982 - DNA, 20 bp, Human papillomavirus type 137
gggtgttcaccaacccctgt

SEQ ID NO: 60983 - DNA, 20 bp, Human papillomavirus type 137
ccatgtagatgcaaatctga

SEQ ID NO: 60984 - DNA, 20 bp, Human papillomavirus type 137
gtagatgcacagtcttttgg

SEQ ID NO: 60985 - DNA, 20 bp, Human papillomavirus type 137
tagatgcacagtcttttggt

SEQ ID NO: 60986 - DNA, 20 bp, Human papillomavirus type 137
tggtactcatgtgggttata

SEQ ID NO: 60987 - DNA, 20 bp, Human papillomavirus type 137
ggtactcatgtgggttatac

SEQ ID NO: 60988 - DNA, 20 bp, Human papillomavirus type 137
gaatttgaaaatcccgcctt

SEQ ID NO: 60989 - DNA, 20 bp, Human papillomavirus type 137
aatttgaaaatcccgccttt

SEQ ID NO: 60990 - DNA, 20 bp, Human papillomavirus type 137
gaaaatcccgcctttgagga

SEQ ID NO: 60991 - DNA, 20 bp, Human papillomavirus type 137
aaaatcccgcctttgaggag

SEQ ID NO: 60992 - DNA, 20 bp, Human papillomavirus type 137
gaggaggacgtcactatgga

SEQ ID NO: 60993 - DNA, 20 bp, Human papillomavirus type 137
tggtgccagatacaccttat

SEQ ID NO: 60994 - DNA, 20 bp, Human papillomavirus type 137
tattcctgtgcaacctcctg

SEQ ID NO: 60995 - DNA, 20 bp, Human papillomavirus type 137
ctgtgcaacctcctgatgga

SEQ ID NO: 60996 - DNA, 20 bp, Human papillomavirus type 137
tggtagatgacaatgattat

SEQ ID NO: 60997 - DNA, 20 bp, Human papillomavirus type 137
tcatctaccagaactccatc

SEQ ID NO: 60998 - DNA, 20 bp, Human papillomavirus type 137
cattcgagtactgaccgcct

SEQ ID NO: 60999 - DNA, 20 bp, Human papillomavirus type 137
gagtactgaccgccttttaa

SEQ ID NO: 61000 - DNA, 20 bp, Human papillomavirus type 137
taacagttggacatcctttc

SEQ ID NO: 61001 - DNA, 20 bp, Human papillomavirus type 137
aacagttggacatcctttct

SEQ ID NO: 61002 - DNA, 20 bp, Human papillomavirus type 137
acagttggacatcctttctt

SEQ ID NO: 61003 - DNA, 20 bp, Human papillomavirus type 137
gtataggtagtactggtcat

SEQ ID NO: 61004 - DNA, 20 bp, Human papillomavirus type 137
aacaaattgcaggatacaga

SEQ ID NO: 61005 - DNA, 20 bp, Human papillomavirus type 137
acaaattgcaggatacagaa

SEQ ID NO: 61006 - DNA, 20 bp, Human papillomavirus type 137
caggatacagaaaatccttc

SEQ ID NO: 61007 - DNA, 20 bp, Human papillomavirus type 137
tgtatataatggattaatca

SEQ ID NO: 61008 - DNA, 20 bp, Human papillomavirus type 137
gctcttctatttactttaca

SEQ ID NO: 61009 - DNA, 20 bp, Human papillomavirus type 137
tatttactttacaattccga

SEQ ID NO: 61010 - DNA, 20 bp, Human papillomavirus type 137
actttacaattccgagtggt

SEQ ID NO: 61011 - DNA, 20 bp, Human papillomavirus type 137
ctttacaattccgagtggtt

SEQ ID NO: 61012 - DNA, 20 bp, Human papillomavirus type 137
acaattccgagtggttcgtt

SEQ ID NO: 61013 - DNA, 20 bp, Human papillomavirus type 137
agatgagtgtgcaataaatg

SEQ ID NO: 61014 - DNA, 20 bp, Human papillomavirus type 137
acttgactcatgtggtctgc

SEQ ID NO: 61015 - DNA, 20 bp, Human papillomavirus type 137
actcatgtggtctgcatttt

SEQ ID NO: 61016 - DNA, 20 bp, Human papillomavirus type 137
ttgttaccccacccgacaat

SEQ ID NO: 61017 - DNA, 20 bp, Human papillomavirus type 137
tgttaccccacccgacaatt

SEQ ID NO: 61018 - DNA, 20 bp, Influenza B virus
aactgtacaaacattaaccc

SEQ ID NO: 61019 - DNA, 20 bp, Influenza B virus
accctattactcacatcagg

SEQ ID NO: 61020 - DNA, 20 bp, Influenza B virus
ctcacatcagggggagtatt

SEQ ID NO: 61021 - DNA, 20 bp, Influenza B virus
ttatcactatatgtgtcagc

SEQ ID NO: 61022 - DNA, 20 bp, Influenza B virus
tcactatatgtgtcagcctc

SEQ ID NO: 61023 - DNA, 20 bp, Influenza B virus
gccctcataggttcggagag

SEQ ID NO: 61024 - DNA, 20 bp, Influenza B virus
ggagagatcaaaggaaactc

SEQ ID NO: 61025 - DNA, 20 bp, Influenza B virus
ataataagagaaccttttgt

SEQ ID NO: 61026 - DNA, 20 bp, Influenza B virus
tgttgcttgtggaccaaaag

SEQ ID NO: 61027 - DNA, 20 bp, Influenza B virus
gttgcttgtggaccaaaaga

SEQ ID NO: 61028 - DNA, 20 bp, Influenza B virus
tccacatggcagcttggagc

SEQ ID NO: 61029 - DNA, 20 bp, Influenza B virus
ccacatggcagcttggagcg

SEQ ID NO: 61030 - DNA, 20 bp, Influenza B virus
cacatggcagcttggagcgg

SEQ ID NO: 61031 - DNA, 20 bp, Influenza B virus
gagcggatccgcatgccatg

SEQ ID NO: 61032 - DNA, 20 bp, Influenza B virus
atggtcctgacaatgatgca

SEQ ID NO: 61033 - DNA, 20 bp, Influenza B virus
caacaggaagagtggagcac

SEQ ID NO: 61034 - DNA, 20 bp, Influenza B virus
gccagcaataaaaccataga

SEQ ID NO: 61035 - DNA, 20 bp, Influenza B virus
tatggttttattgctggcga

SEQ ID NO: 61036 - DNA, 20 bp, Influenza B virus
tattgctggcgaacccgcat

SEQ ID NO: 61037 - DNA, 20 bp, Influenza B virus
attgctggcgaacccgcatg

SEQ ID NO: 61038 - DNA, 20 bp, Influenza B virus
cgaatctaatggagacaagt

SEQ ID NO: 61039 - DNA, 20 bp, Influenza B virus
gaggcatcaaaggaggattc

SEQ ID NO: 61040 - DNA, 20 bp, Influenza B virus
gtccatcaaagaatggcatc

SEQ ID NO: 61041 - DNA, 20 bp, Influenza B virus
caatcttagatgccattctt

SEQ ID NO: 61042 - DNA, 20 bp, Influenza B virus
gatgccattctttgatggac

SEQ ID NO: 61043 - DNA, 20 bp, Influenza B virus
tattgggatagagatggtac

SEQ ID NO: 61044 - DNA, 20 bp, Influenza B virus
ggatagagatggtacacgat

SEQ ID NO: 61045 - DNA, 20 bp, Influenza B virus
gcattcagctgcaacagcca

SEQ ID NO: 61046 - DNA, 20 bp, Influenza B virus
agctgcaacagccatttact

SEQ ID NO: 61047 - DNA, 20 bp, Influenza B virus
actgtttgatgggctcagga

SEQ ID NO: 61048 - DNA, 20 bp, Human papillomavirus type 49
ggcagcaacaccagaacgat

SEQ ID NO: 61049 - DNA, 20 bp, Human papillomavirus type 49
gcagcaacaccagaacgata

SEQ ID NO: 61050 - DNA, 20 bp, Human papillomavirus type 49
caatcgggcgcggtcacatt

SEQ ID NO: 61051 - DNA, 20 bp, Human papillomavirus type 49
aatcgggcgcggtcacatta

SEQ ID NO: 61052 - DNA, 20 bp, Human papillomavirus type 49
tacttagtcatctcttgtgg

SEQ ID NO: 61053 - DNA, 20 bp, Human papillomavirus type 49
cagagttatagaatgattgg

SEQ ID NO: 61054 - DNA, 20 bp, Human papillomavirus type 49
tagaatgattgggaaagaag

SEQ ID NO: 61055 - DNA, 20 bp, Human papillomavirus type 49
ggaaagaagttacaatacca

SEQ ID NO: 61056 - DNA, 20 bp, Human papillomavirus type 49
caataccagatataatacta

SEQ ID NO: 61057 - DNA, 20 bp, Human papillomavirus type 49
ggccagcccattgacctgca

SEQ ID NO: 61058 - DNA, 20 bp, Human papillomavirus type 49
ccaagaactgcttctggagg

SEQ ID NO: 61059 - DNA, 20 bp, Human papillomavirus type 49
caagaactgcttctggagga

SEQ ID NO: 61060 - DNA, 20 bp, Human papillomavirus type 49
tggaggaactgcaattcttg

SEQ ID NO: 61061 - DNA, 20 bp, Human papillomavirus type 49
ttgtgtcctcagtgtcgtga

SEQ ID NO: 61062 - DNA, 20 bp, Human papillomavirus type 49
tgtcctcagtgtcgtgaaga

SEQ ID NO: 61063 - DNA, 20 bp, Human papillomavirus type 49
gcgagatctgcttcgccagc

SEQ ID NO: 61064 - DNA, 20 bp, Human papillomavirus type 49
gccagcaggaatttgaggag

SEQ ID NO: 61065 - DNA, 20 bp, Human papillomavirus type 49
gaggagagcgcggagcaagt

SEQ ID NO: 61066 - DNA, 20 bp, Human papillomavirus type 49
aggagagcgcggagcaagta

SEQ ID NO: 61067 - DNA, 20 bp, Human papillomavirus type 49
aaacgaaagtatttcagtcc

SEQ ID NO: 61068 - DNA, 20 bp, Human papillomavirus type 49
gacctttctgaaatgataca

SEQ ID NO: 61069 - DNA, 20 bp, Human papillomavirus type 49
acctttctgaaatgatacaa

SEQ ID NO: 61070 - DNA, 20 bp, Human papillomavirus type 49
ctgaaatgatacaatgggcc

SEQ ID NO: 61071 - DNA, 20 bp, Human papillomavirus type 49
tgaaatgatacaatgggcct

SEQ ID NO: 61072 - DNA, 20 bp, Human papillomavirus type 49
atctgtgagatcgctatcat

SEQ ID NO: 61073 - DNA, 20 bp, Human papillomavirus type 49
ctgaccaaagctggaaatct

SEQ ID NO: 61074 - DNA, 20 bp, Human papillomavirus type 49
ttttgaaaggctttggacac

SEQ ID NO: 61075 - DNA, 20 bp, Human papillomavirus type 49
tttgaaaggctttggacaca

SEQ ID NO: 61076 - DNA, 20 bp, Human papillomavirus type 49
ttgaaaggctttggacacaa

SEQ ID NO: 61077 - DNA, 20 bp, Human papillomavirus type 49
tgaaaggctttggacacaat

SEQ ID NO: 61078 - DNA, 20 bp, Human papillomavirus type 49
gcatgatgctaactttgcaa

SEQ ID NO: 61079 - DNA, 20 bp, Human papillomavirus type 49
gcaaagttagcatcatgcca

SEQ ID NO: 61080 - DNA, 20 bp, Human papillomavirus type 49
caaagttagcatcatgccaa

SEQ ID NO: 61081 - DNA, 20 bp, Human papillomavirus type 49
gcatcatgccaatagcttgt

SEQ ID NO: 61082 - DNA, 20 bp, Human papillomavirus type 49
tttggctttggtttcagata

SEQ ID NO: 61083 - DNA, 20 bp, Human papillomavirus type 49
tgcaggtgcatattataagg

SEQ ID NO: 61084 - DNA, 20 bp, Human papillomavirus type 49
taaggatggaactatcaaac

SEQ ID NO: 61085 - DNA, 20 bp, Human papillomavirus type 49
tgttaccttcgctgatgatg

SEQ ID NO: 61086 - DNA, 20 bp, Human papillomavirus type 49
ccttcgctgatgatgctgtt

SEQ ID NO: 61087 - DNA, 20 bp, Human papillomavirus type 49
gctgatgatgctgttagata

SEQ ID NO: 61088 - DNA, 20 bp, Human papillomavirus type 49
acgacaccgtcgacgagaca

SEQ ID NO: 61089 - DNA, 20 bp, Human papillomavirus type 49
ctgtggtgctggtgggtgtc

SEQ ID NO: 61090 - DNA, 20 bp, Human papillomavirus type 49
cagatccagatccagatcca

SEQ ID NO: 61091 - DNA, 20 bp, Human papillomavirus type 49
cagaggatccagagggtccg

SEQ ID NO: 61092 - DNA, 20 bp, Human papillomavirus type 49
cagccccaagagaacccgca

SEQ ID NO: 61093 - DNA, 20 bp, Human papillomavirus type 49
tcttggggctggaatctctg

SEQ ID NO: 61094 - DNA, 20 bp, Human papillomavirus type 49
gggctggaatctctggaggt

SEQ ID NO: 61095 - DNA, 20 bp, Human papillomavirus type 49
gacgacttggaaggttactg

SEQ ID NO: 61096 - DNA, 20 bp, Human papillomavirus type 49
gaaggttactggaggaggct

SEQ ID NO: 61097 - DNA, 20 bp, Human papillomavirus type 49
ctggaggaggctagcgatcc

SEQ ID NO: 61098 - DNA, 20 bp, Human papillomavirus type 49
tgcgaggagacccaaatatt

SEQ ID NO: 61099 - DNA, 20 bp, Human papillomavirus type 49
gcgaggagacccaaatattt

SEQ ID NO: 61100 - DNA, 20 bp, Human papillomavirus type 49
ttgttactagtggttctggt

SEQ ID NO: 61101 - DNA, 20 bp, Human papillomavirus type 49
ttactagtggttctggtggt

SEQ ID NO: 61102 - DNA, 20 bp, Human papillomavirus type 49
ctagtggttctggtggtcaa

SEQ ID NO: 61103 - DNA, 20 bp, Human papillomavirus type 49
tggtggtcaaccaataggtg

SEQ ID NO: 61104 - DNA, 20 bp, Human papillomavirus type 49
caccagttgaaatagaatta

SEQ ID NO: 61105 - DNA, 20 bp, Human papillomavirus type 49
gctttgcctttgataatcct

SEQ ID NO: 61106 - DNA, 20 bp, Human papillomavirus type 49
gcctttgataatcctgtgtt

SEQ ID NO: 61107 - DNA, 20 bp, Human papillomavirus type 49
cctttgataatcctgtgttt

SEQ ID NO: 61108 - DNA, 20 bp, Human papillomavirus type 49
gataatcctgtgtttgaaga

SEQ ID NO: 61109 - DNA, 20 bp, Human papillomavirus type 49
ataatcctgtgtttgaagaa

SEQ ID NO: 61110 - DNA, 20 bp, Human papillomavirus type 49
tcactattaggggaacattc

SEQ ID NO: 61111 - DNA, 20 bp, Human papillomavirus type 49
ggggaacattctggtgatgc

SEQ ID NO: 61112 - DNA, 20 bp, Human papillomavirus type 49
tggtgatgctactattgtcc

SEQ ID NO: 61113 - DNA, 20 bp, Human papillomavirus type 49
tccaaggcccagtagaaagc

SEQ ID NO: 61114 - DNA, 20 bp, Human papillomavirus type 49
ctactgggccttggacaata

SEQ ID NO: 61115 - DNA, 20 bp, Human papillomavirus type 49
tctactcccagatctgatac

SEQ ID NO: 61116 - DNA, 20 bp, Human papillomavirus type 49
tatgtacaagatttggaagg

SEQ ID NO: 61117 - DNA, 20 bp, Human papillomavirus type 49
atgtacaagatttggaaggt

SEQ ID NO: 61118 - DNA, 20 bp, Human papillomavirus type 49
tgtacaagatttggaaggtt

SEQ ID NO: 61119 - DNA, 20 bp, Human papillomavirus type 49
ggaaggttatgctgtgtcat

SEQ ID NO: 61120 - DNA, 20 bp, Human papillomavirus type 49
aacacctgtggcaagggtac

SEQ ID NO: 61121 - DNA, 20 bp, Human papillomavirus type 49
agaggacagacatctactat

SEQ ID NO: 61122 - DNA, 20 bp, Human papillomavirus type 49
acaatcgatcactattagca

SEQ ID NO: 61123 - DNA, 20 bp, Human papillomavirus type 49
gcatgatagtagatgtctgt

SEQ ID NO: 61124 - DNA, 20 bp, Human papillomavirus type 49
atccgtgctttgtacccttg

SEQ ID NO: 61125 - DNA, 20 bp, Human papillomavirus type 49
gaaattggtcgtggccagcc

SEQ ID NO: 61126 - DNA, 20 bp, Human papillomavirus type 49
gtcgtggccagcctttaggt

SEQ ID NO: 61127 - DNA, 20 bp, Human papillomavirus type 49
aggtgttggtacaacaggac

SEQ ID NO: 61128 - DNA, 20 bp, Human papillomavirus type 49
ggtgttggtacaacaggaca

SEQ ID NO: 61129 - DNA, 20 bp, Human papillomavirus type 49
gtacaacaggacatccattg

SEQ ID NO: 61130 - DNA, 20 bp, Human papillomavirus type 49
tttgttagaggtggtaatgt

SEQ ID NO: 61131 - DNA, 20 bp, Human papillomavirus type 49
gttagaggtggtaatgtagg

SEQ ID NO: 61132 - DNA, 20 bp, Human papillomavirus type 49
ttagaggtggtaatgtaggg

SEQ ID NO: 61133 - DNA, 20 bp, Human papillomavirus type 49
gaggtggtaatgtaggggat

SEQ ID NO: 61134 - DNA, 20 bp, Human papillomavirus type 49
catattacctgcagcaagtc

SEQ ID NO: 61135 - DNA, 20 bp, Human papillomavirus type 49
tggactgtagatttaacaga

SEQ ID NO: 61136 - DNA, 20 bp, Human papillomavirus type 49
ggactgtagatttaacagaa

SEQ ID NO: 61137 - DNA, 20 bp, Human papillomavirus type 49
gactgtagatttaacagaaa

SEQ ID NO: 61138 - DNA, 20 bp, Human papillomavirus type 49
aacagaaaaactgtctttgg

SEQ ID NO: 61139 - DNA, 20 bp, Human papillomavirus type 49
acagaaaaactgtctttgga

SEQ ID NO: 61140 - DNA, 20 bp, Influenza A virus
gaatggaccaagcaatagtg

SEQ ID NO: 61141 - DNA, 20 bp, Influenza A virus
aaagcaaatttcagtgtgat

SEQ ID NO: 61142 - DNA, 20 bp, Influenza A virus
cagtgtgattttcaatcggc

SEQ ID NO: 61143 - DNA, 20 bp, Influenza A virus
agtgtgattttcaatcggct

SEQ ID NO: 61144 - DNA, 20 bp, Influenza A virus
tcaatcggcttgaagccctg

SEQ ID NO: 61145 - DNA, 20 bp, Influenza C virus
cgcaagagaaatggggaaat

SEQ ID NO: 61146 - DNA, 20 bp, Influenza C virus
ttactgttggggcactaatg

SEQ ID NO: 61147 - DNA, 20 bp, Influenza C virus
ctgttggggcactaatgact

SEQ ID NO: 61148 - DNA, 20 bp, Influenza C virus
gggcactaatgactgaatgt

SEQ ID NO: 61149 - DNA, 20 bp, Influenza C virus
cctgggaaaataaaagtggt

SEQ ID NO: 61150 - DNA, 20 bp, Influenza C virus
ggaagaaaaatggagagtta

SEQ ID NO: 61151 - DNA, 20 bp, Influenza C virus
attgctcaacctttaagaga

SEQ ID NO: 61152 - DNA, 20 bp, Influenza C virus
ctcaacctttaagagaagct

SEQ ID NO: 61153 - DNA, 20 bp, Influenza C virus
aagagaagctttaagagtac

SEQ ID NO: 61154 - DNA, 20 bp, Influenza C virus
agagaagctttaagagtaca

SEQ ID NO: 61155 - DNA, 20 bp, Human papillomavirus type 126
ttttgcctgcacctttgctt

SEQ ID NO: 61156 - DNA, 20 bp, Human papillomavirus type 126
tgcctgcacctttgctttgt

SEQ ID NO: 61157 - DNA, 20 bp, Human papillomavirus type 126
gcctgcacctttgctttgtg

SEQ ID NO: 61158 - DNA, 20 bp, Human papillomavirus type 126
cctgcacctttgctttgtga

SEQ ID NO: 61159 - DNA, 20 bp, Human papillomavirus type 126
gctttgtgaggagtcatcat

SEQ ID NO: 61160 - DNA, 20 bp, Human papillomavirus type 126
ctgagttaaaacgaaagtac

SEQ ID NO: 61161 - DNA, 20 bp, Human papillomavirus type 126
aaacgaaagtacaaaaaaag

SEQ ID NO: 61162 - DNA, 20 bp, Human papillomavirus type 126
tacggaacctacagttgctg

SEQ ID NO: 61163 - DNA, 20 bp, Human papillomavirus type 126
ctgctcttagtcctcgtttg

SEQ ID NO: 61164 - DNA, 20 bp, Human papillomavirus type 126
gtcctcgtttggaagcaata

SEQ ID NO: 61165 - DNA, 20 bp, Human papillomavirus type 126
atattggaaagtttggctaa

SEQ ID NO: 61166 - DNA, 20 bp, Human papillomavirus type 126
gaaagtttggctaaatccaa

SEQ ID NO: 61167 - DNA, 20 bp, Human papillomavirus type 126
ggctaaatccaagtatgcat

SEQ ID NO: 61168 - DNA, 20 bp, Human papillomavirus type 126
gctaaatccaagtatgcatc

SEQ ID NO: 61169 - DNA, 20 bp, Human papillomavirus type 126
gccgattgcagcgcagatcg

SEQ ID NO: 61170 - DNA, 20 bp, Human papillomavirus type 126
tatattatttgaaaaagatg

SEQ ID NO: 61171 - DNA, 20 bp, Human papillomavirus type 126
atattatttgaaaaagatgc

SEQ ID NO: 61172 - DNA, 20 bp, Human papillomavirus type 126
tattatttgaaaaagatgct

SEQ ID NO: 61173 - DNA, 20 bp, Human papillomavirus type 126
tttgaaaaagatgcttttag

SEQ ID NO: 61174 - DNA, 20 bp, Human papillomavirus type 126
gaaaaagatgcttttagata

SEQ ID NO: 61175 - DNA, 20 bp, Human papillomavirus type 126
cttgacactagcgtcactca

SEQ ID NO: 61176 - DNA, 20 bp, Human papillomavirus type 126
acactagcgtcactcacacc

SEQ ID NO: 61177 - DNA, 20 bp, Human papillomavirus type 126
gtctagggcatcacacacag

SEQ ID NO: 61178 - DNA, 20 bp, Human papillomavirus type 126
tctagggcatcacacacaga

SEQ ID NO: 61179 - DNA, 20 bp, Human papillomavirus type 126
ttggtctatctctccgccct

SEQ ID NO: 61180 - DNA, 20 bp, Human papillomavirus type 126
gtctatctctccgcccttca

SEQ ID NO: 61181 - DNA, 20 bp, Human papillomavirus type 126
agtgtcccagtttgaaaatc

SEQ ID NO: 61182 - DNA, 20 bp, Human papillomavirus type 126
gaaaatcccgcctttgatgc

SEQ ID NO: 61183 - DNA, 20 bp, Human papillomavirus type 126
aaaatcccgcctttgatgct

SEQ ID NO: 61184 - DNA, 20 bp, Human papillomavirus type 126
accatctggcataacattta

SEQ ID NO: 61185 - DNA, 20 bp, Human papillomavirus type 126
ccatctggcataacatttaa

SEQ ID NO: 61186 - DNA, 20 bp, Human papillomavirus type 126
aatgttatttctaacactga

SEQ ID NO: 61187 - DNA, 20 bp, Human papillomavirus type 126
atgttatttctaacactgac

SEQ ID NO: 61188 - DNA, 20 bp, Human papillomavirus type 126
tttctaacactgacaaagta

SEQ ID NO: 61189 - DNA, 20 bp, Human papillomavirus type 126
tacattcgcctatacaagat

SEQ ID NO: 61190 - DNA, 20 bp, Human papillomavirus type 126
gcctatacaagatggcgata

SEQ ID NO: 61191 - DNA, 20 bp, Human papillomavirus type 126
tataggcgaatgtataagtt

SEQ ID NO: 61192 - DNA, 20 bp, Human papillomavirus type 126
gataggagggcacgtaccct

SEQ ID NO: 61193 - DNA, 20 bp, Human papillomavirus type 126
ataggagggcacgtaccctt

SEQ ID NO: 61194 - DNA, 20 bp, Human papillomavirus type 126
tgtaaagatggagctgttgg

SEQ ID NO: 61195 - DNA, 20 bp, Human papillomavirus type 126
gtaaagatggagctgttggc

SEQ ID NO: 61196 - DNA, 20 bp, Human papillomavirus type 126
taaagatggagctgttggcg

SEQ ID NO: 61197 - DNA, 20 bp, Human papillomavirus type 126
gcgacagtatccctgaggat

SEQ ID NO: 61198 - DNA, 20 bp, Human papillomavirus type 126
atagtacatccagacacagg

SEQ ID NO: 61199 - DNA, 20 bp, Human papillomavirus type 126
ataaaatcactagctactat

SEQ ID NO: 61200 - DNA, 20 bp, Human papillomavirus type 126
taaaatcactagctactatc

SEQ ID NO: 61201 - DNA, 20 bp, Human papillomavirus type 126
aaatgggtctgcaggtggct

SEQ ID NO: 61202 - DNA, 20 bp, Human papillomavirus type 126
aatgggtctgcaggtggctt

SEQ ID NO: 61203 - DNA, 20 bp, Human papillomavirus type 126
tgttgagcgtctttaggaca

SEQ ID NO: 61204 - DNA, 20 bp, Human papillomavirus type 128
agtgtagacacatgctgtga

SEQ ID NO: 61205 - DNA, 20 bp, Human papillomavirus type 128
taaccgtcgagttagattag

SEQ ID NO: 61206 - DNA, 20 bp, Human papillomavirus type 128
gattagtagtatctgcaact

SEQ ID NO: 61207 - DNA, 20 bp, Human papillomavirus type 128
gtagtatctgcaactagcac

SEQ ID NO: 61208 - DNA, 20 bp, Human papillomavirus type 128
ttagatttcagcaactattg

SEQ ID NO: 61209 - DNA, 20 bp, Human papillomavirus type 128
cctggcactcttcaatgccc

SEQ ID NO: 61210 - DNA, 20 bp, Human papillomavirus type 128
aatgcccaagttacagagga

SEQ ID NO: 61211 - DNA, 20 bp, Human papillomavirus type 128
cagaggattcagatcgtgca

SEQ ID NO: 61212 - DNA, 20 bp, Human papillomavirus type 128
agatcgtgcagttttatttc

SEQ ID NO: 61213 - DNA, 20 bp, Human papillomavirus type 128
agaaataaaactgcacgatc

SEQ ID NO: 61214 - DNA, 20 bp, Human papillomavirus type 128
taatgaactatcacaggtag

SEQ ID NO: 61215 - DNA, 20 bp, Human papillomavirus type 128
aaaatggcgccgctattaat

SEQ ID NO: 61216 - DNA, 20 bp, Human papillomavirus type 128
atgacatacttaattgtaat

SEQ ID NO: 61217 - DNA, 20 bp, Human papillomavirus type 128
tgttattacaattaagtatg

SEQ ID NO: 61218 - DNA, 20 bp, Human papillomavirus type 128
gttattacaattaagtatgt

SEQ ID NO: 61219 - DNA, 20 bp, Human papillomavirus type 128
gattttaaaacattgtattg

SEQ ID NO: 61220 - DNA, 20 bp, Human papillomavirus type 128
taaaacattgtattgttaat

SEQ ID NO: 61221 - DNA, 20 bp, Human papillomavirus type 128
aaaacattgtattgttaatc

SEQ ID NO: 61222 - DNA, 20 bp, Human papillomavirus type 128
aaacattgtattgttaatca

SEQ ID NO: 61223 - DNA, 20 bp, Human papillomavirus type 128
tattgttaatcatcaaatgg

SEQ ID NO: 61224 - DNA, 20 bp, Human papillomavirus type 128
tctccagtctctgctgaaga

SEQ ID NO: 61225 - DNA, 20 bp, Human papillomavirus type 128
cgcgacatggtttatcgcga

SEQ ID NO: 61226 - DNA, 20 bp, Human papillomavirus type 128
atcgcgacttggaaggcttg

SEQ ID NO: 61227 - DNA, 20 bp, Human papillomavirus type 128
tcgcgacttggaaggcttga

SEQ ID NO: 61228 - DNA, 20 bp, Human papillomavirus type 128
gaaggcttgaagcagaagct

SEQ ID NO: 61229 - DNA, 20 bp, Human papillomavirus type 128
ggtctggtaaaggtactggt

SEQ ID NO: 61230 - DNA, 20 bp, Human papillomavirus type 128
ggtggtggaggaacagtttc

SEQ ID NO: 61231 - DNA, 20 bp, Human papillomavirus type 128
gtggtggaggaacagtttct

SEQ ID NO: 61232 - DNA, 20 bp, Human papillomavirus type 128
ctaggccaagtatacgtatt

SEQ ID NO: 61233 - DNA, 20 bp, Human papillomavirus type 128
taggccaagtatacgtattc

SEQ ID NO: 61234 - DNA, 20 bp, Human papillomavirus type 128
ttagctctggtactgggcct

SEQ ID NO: 61235 - DNA, 20 bp, Human papillomavirus type 128
gctctggtactgggcctaca

SEQ ID NO: 61236 - DNA, 20 bp, Human papillomavirus type 128
gatgttactacacagataga

SEQ ID NO: 61237 - DNA, 20 bp, Human papillomavirus type 128
ctacacagatagatttaaac

SEQ ID NO: 61238 - DNA, 20 bp, Human papillomavirus type 128
aaacacatttaataatataa

SEQ ID NO: 61239 - DNA, 20 bp, Human papillomavirus type 128
cagaggtgaccgccactcca

SEQ ID NO: 61240 - DNA, 20 bp, Human papillomavirus type 128
tagagatatcaattacctga

SEQ ID NO: 61241 - DNA, 20 bp, Human papillomavirus type 128
agagatatcaattacctgag

SEQ ID NO: 61242 - DNA, 20 bp, Human papillomavirus type 128
gagatatcaattacctgagt

SEQ ID NO: 61243 - DNA, 20 bp, Human papillomavirus type 128
cctgagtaggcctttttaca

SEQ ID NO: 61244 - DNA, 20 bp, Human papillomavirus type 128
aggtattggagctgttgggc

SEQ ID NO: 61245 - DNA, 20 bp, Human papillomavirus type 128
ggtattggagctgttgggca

SEQ ID NO: 61246 - DNA, 20 bp, Human papillomavirus type 128
gagctgttgggcatccgtta

SEQ ID NO: 61247 - DNA, 20 bp, Human papillomavirus type 128
ggcatccgttaatgaataaa

SEQ ID NO: 61248 - DNA, 20 bp, Human papillomavirus type 128
atgaataaatatggagattc

SEQ ID NO: 61249 - DNA, 20 bp, Human papillomavirus type 128
tggtgctgttaattttaaaa

SEQ ID NO: 61250 - DNA, 20 bp, Human papillomavirus type 128
ggtgctgttaattttaaaac

SEQ ID NO: 61251 - DNA, 20 bp, Human papillomavirus type 128
gtgctgttaattttaaaaca

SEQ ID NO: 61252 - DNA, 20 bp, Human papillomavirus type 128
attttaaaacattttctcaa

SEQ ID NO: 61253 - DNA, 20 bp, Human papillomavirus type 128
taaaacattttctcaagaca

SEQ ID NO: 61254 - DNA, 20 bp, Human papillomavirus type 128
gaagtcgaattagtctttcg

SEQ ID NO: 61255 - DNA, 20 bp, Human papillomavirus type 128
aagtcgaattagtctttcgt

SEQ ID NO: 61256 - DNA, 20 bp, Human papillomavirus type 128
gtctttcgtctttgtaaagt

SEQ ID NO: 61257 - DNA, 20 bp, Human papillomavirus type 128
cgtctttgtaaagtaccatt

SEQ ID NO: 61258 - DNA, 20 bp, Human papillomavirus type 128
gtctttgtaaagtaccatta

SEQ ID NO: 61259 - DNA, 20 bp, Human papillomavirus type 128
ccaggtgctatgccaaacca

SEQ ID NO: 61260 - DNA, 20 bp, Human papillomavirus type 128
caggtgctatgccaaaccat

SEQ ID NO: 61261 - DNA, 20 bp, Human papillomavirus type 128
aaataaaatgcagtgtttgc

SEQ ID NO: 61262 - DNA, 20 bp, Human papillomavirus type 128
gcaaaatactgactcatgtg

SEQ ID NO: 61263 - DNA, 20 bp, Human papillomavirus type 128
caaaatactgactcatgtgg

SEQ ID NO: 61264 - DNA, 20 bp, Human papillomavirus type 128
tcggtcgaggcaaggtgagt

SEQ ID NO: 61265 - DNA, 20 bp, Human papillomavirus type 128
cggtcgaggcaaggtgagta

SEQ ID NO: 61266 - DNA, 20 bp, Human papillomavirus type 128
ggtcgaggcaaggtgagtac

SEQ ID NO: 61267 - DNA, 20 bp, Human papillomavirus type 128
aaacaaactttgactgactc

SEQ ID NO: 61268 - DNA, 20 bp, Human papillomavirus type 128
gactgactcaaaatttggcg

SEQ ID NO: 61269 - DNA, 20 bp, Human papillomavirus type 144
tatatgtctggatttgttgg

SEQ ID NO: 61270 - DNA, 20 bp, Human papillomavirus type 144
gttggatgcagcagaaaagc

SEQ ID NO: 61271 - DNA, 20 bp, Human papillomavirus type 144
ttggatgcagcagaaaagca

SEQ ID NO: 61272 - DNA, 20 bp, Human papillomavirus type 144
gatgcagcagaaaagcaaga

SEQ ID NO: 61273 - DNA, 20 bp, Human papillomavirus type 144
ctagaggcaaaaggtttata

SEQ ID NO: 61274 - DNA, 20 bp, Human papillomavirus type 144
tacactccaccgactctgga

SEQ ID NO: 61275 - DNA, 20 bp, Human papillomavirus type 144
ttcgatttattgctcgaaga

SEQ ID NO: 61276 - DNA, 20 bp, Human papillomavirus type 144
gatttattgctcgaagaatt

SEQ ID NO: 61277 - DNA, 20 bp, Human papillomavirus type 144
attgctcgaagaattatcat

SEQ ID NO: 61278 - DNA, 20 bp, Human papillomavirus type 144
ttgctcgaagaattatcatt

SEQ ID NO: 61279 - DNA, 20 bp, Human papillomavirus type 144
ggagacagtggcatagagga

SEQ ID NO: 61280 - DNA, 20 bp, Human papillomavirus type 144
gagacagtggcatagaggaa

SEQ ID NO: 61281 - DNA, 20 bp, Human papillomavirus type 144
ttacacaggtagacactaac

SEQ ID NO: 61282 - DNA, 20 bp, Human papillomavirus type 144
cacaggtagacactaactca

SEQ ID NO: 61283 - DNA, 20 bp, Human papillomavirus type 144
acccagctcactactatttg

SEQ ID NO: 61284 - DNA, 20 bp, Human papillomavirus type 144
ctgaatggttagcaaagcaa

SEQ ID NO: 61285 - DNA, 20 bp, Human papillomavirus type 144
gcaaagcaagtattggtaga

SEQ ID NO: 61286 - DNA, 20 bp, Human papillomavirus type 144
gtagaacatcaatcagctgc

SEQ ID NO: 61287 - DNA, 20 bp, Human papillomavirus type 144
gaattagctacaatggtaca

SEQ ID NO: 61288 - DNA, 20 bp, Human papillomavirus type 144
aattagctacaatggtacag

SEQ ID NO: 61289 - DNA, 20 bp, Human papillomavirus type 144
catccggaggacttcaaacc

SEQ ID NO: 61290 - DNA, 20 bp, Human papillomavirus type 144
gaagtcctccggatggaact

SEQ ID NO: 61291 - DNA, 20 bp, Human papillomavirus type 144
aagtcctccggatggaactt

SEQ ID NO: 61292 - DNA, 20 bp, Human papillomavirus type 144
ctgctgggcctcggtgtcgg

SEQ ID NO: 61293 - DNA, 20 bp, Human papillomavirus type 144
tgctgggcctcggtgtcggt

SEQ ID NO: 61294 - DNA, 20 bp, Human papillomavirus type 144
gacgactacaagaagaagct

SEQ ID NO: 61295 - DNA, 20 bp, Human papillomavirus type 144
ctccagcatttaaggggatt

SEQ ID NO: 61296 - DNA, 20 bp, Human papillomavirus type 144
tccagcatttaaggggattt

SEQ ID NO: 61297 - DNA, 20 bp, Human papillomavirus type 144
aaggggatttgcaggacctt

SEQ ID NO: 61298 - DNA, 20 bp, Human papillomavirus type 144
aggggatttgcaggaccttt

SEQ ID NO: 61299 - DNA, 20 bp, Human papillomavirus type 144
ggtatagaccattgacacca

SEQ ID NO: 61300 - DNA, 20 bp, Human papillomavirus type 144
acaccatctacaccacgcgt

SEQ ID NO: 61301 - DNA, 20 bp, Human papillomavirus type 144
cctgaagggacaatagtaag

SEQ ID NO: 61302 - DNA, 20 bp, Human papillomavirus type 144
ctattgtcccttcaggtaat

SEQ ID NO: 61303 - DNA, 20 bp, Human papillomavirus type 144
tcccttcaggtaatacgcgt

SEQ ID NO: 61304 - DNA, 20 bp, Human papillomavirus type 144
gcttaccagaaagtacacct

SEQ ID NO: 61305 - DNA, 20 bp, Human papillomavirus type 144
ccagaaagtacacctactgt

SEQ ID NO: 61306 - DNA, 20 bp, Human papillomavirus type 144
gatatatctcctgcacaacc

SEQ ID NO: 61307 - DNA, 20 bp, Human papillomavirus type 144
aacacgaccctccaccacta

SEQ ID NO: 61308 - DNA, 20 bp, Human papillomavirus type 144
acacgaccctccaccactat

SEQ ID NO: 61309 - DNA, 20 bp, Human papillomavirus type 144
gaggatataagctctattaa

SEQ ID NO: 61310 - DNA, 20 bp, Human papillomavirus type 144
acccaccaaaaacaagcact

SEQ ID NO: 61311 - DNA, 20 bp, Human papillomavirus type 144
cacccgtcgaccgtaaaagt

SEQ ID NO: 61312 - DNA, 20 bp, Human papillomavirus type 144
cttgctctttgtgttagccg

SEQ ID NO: 61313 - DNA, 20 bp, Human papillomavirus type 144
ctctttgtgttagccgtggc

SEQ ID NO: 61314 - DNA, 20 bp, Human papillomavirus type 144
tgatcccaaacaaacacagc

SEQ ID NO: 61315 - DNA, 20 bp, Human papillomavirus type 144
gatcccaaacaaacacagct

SEQ ID NO: 61316 - DNA, 20 bp, Human papillomavirus type 144
atcccaaacaaacacagcta

SEQ ID NO: 61317 - DNA, 20 bp, Human papillomavirus type 144
atagtaggttgtacaccttc

SEQ ID NO: 61318 - DNA, 20 bp, Human papillomavirus type 144
tagtaggttgtacaccttca

SEQ ID NO: 61319 - DNA, 20 bp, Human papillomavirus type 144
ttcacagtacttgcaaatgg

SEQ ID NO: 61320 - DNA, 20 bp, Human papillomavirus type 144
acagtacttgcaaatggcct

SEQ ID NO: 61321 - DNA, 20 bp, Human papillomavirus type 144
caaatggcctgatttcttaa

SEQ ID NO: 61322 - DNA, 20 bp, Human papillomavirus type 144
cttaaaaatgactaaagata

SEQ ID NO: 61323 - DNA, 20 bp, Human papillomavirus type 144
ttaaaaatgactaaagatat

SEQ ID NO: 61324 - DNA, 20 bp, Human papillomavirus type 144
gaaaattgatatgactgagc

SEQ ID NO: 61325 - DNA, 20 bp, Human papillomavirus type 144
atatgactgagcgtttttct

SEQ ID NO: 61326 - DNA, 20 bp, Human papillomavirus type 144
ttctactgaattatcacagt

SEQ ID NO: 61327 - DNA, 20 bp, Human papillomavirus type 144
tctactgaattatcacagtt

SEQ ID NO: 61328 - DNA, 20 bp, Human papillomavirus type 144
ctactgaattatcacagttt

SEQ ID NO: 61329 - DNA, 20 bp, Human papillomavirus type 144
gtcaatatttaaaataccgc

SEQ ID NO: 61330 - DNA, 20 bp, Human papillomavirus type 144
aaaataccgcacccctgttt

SEQ ID NO: 61331 - DNA, 20 bp, Human papillomavirus type 144
aaataccgcacccctgttta

SEQ ID NO: 61332 - DNA, 20 bp, Human papillomavirus type 144
acctatgaacatccggacct

SEQ ID NO: 61333 - DNA, 20 bp, Human papillomavirus type 144
cctatgaacatccggacctc

SEQ ID NO: 61334 - DNA, 20 bp, Human papillomavirus type 144
tcggtacacggactgtgcca

SEQ ID NO: 61335 - DNA, 20 bp, Human papillomavirus type 144
taacaagaggtgactgactc

SEQ ID NO: 61336 - DNA, 20 bp, Human papillomavirus type 144
aacaagaggtgactgactca

SEQ ID NO: 61337 - DNA, 20 bp, Human papillomavirus type 144
acaagaggtgactgactcaa

SEQ ID NO: 61338 - DNA, 20 bp, Human papillomavirus type 144
ttggacagattgtgtatctg

SEQ ID NO: 61339 - DNA, 20 bp, Influenza A virus
tgaacagatggaaactgatg

SEQ ID NO: 61340 - DNA, 20 bp, Influenza A virus
gggcatccgtcgggaagatg

SEQ ID NO: 61341 - DNA, 20 bp, Influenza A virus
ccgacggatgccctaatctc

SEQ ID NO: 61342 - DNA, 20 bp, Influenza A virus
cattctggcgatccccatca

SEQ ID NO: 61343 - DNA, 20 bp, Influenza A virus
tggcgatccccatcagtttc

SEQ ID NO: 61344 - DNA, 20 bp, Influenza A virus
ttggcaagatctgcattgat

SEQ ID NO: 61345 - DNA, 20 bp, Influenza A virus
tggcaagatctgcattgata

SEQ ID NO: 61346 - DNA, 20 bp, Influenza A virus
ggcaagatctgcattgatat

SEQ ID NO: 61347 - DNA, 20 bp, Influenza A virus
gcaagatctgcattgatatt

SEQ ID NO: 61348 - DNA, 20 bp, Influenza A virus
atattgagagggtcagttgc

SEQ ID NO: 61349 - DNA, 20 bp, Influenza A virus
tgctgcatttgaagatttaa

SEQ ID NO: 61350 - DNA, 20 bp, Influenza A virus
gaagatttaagattgttaag

SEQ ID NO: 61351 - DNA, 20 bp, Influenza A virus
aagatttaagattgttaagc

SEQ ID NO: 61352 - DNA, 20 bp, Influenza A virus
aagattgttaagcttcatca

SEQ ID NO: 61353 - DNA, 20 bp, Influenza A virus
agattgttaagcttcatcag

SEQ ID NO: 61354 - DNA, 20 bp, Influenza A virus
gaaaagtcaaccatcatggc

SEQ ID NO: 61355 - DNA, 20 bp, Influenza A virus
aaaagtcaaccatcatggca

SEQ ID NO: 61356 - DNA, 20 bp, Influenza A virus
actggaaatacggagggaag

SEQ ID NO: 61357 - DNA, 20 bp, Influenza A virus
agacatgagggcagaaatca

SEQ ID NO: 61358 - DNA, 20 bp, Influenza A virus
ttatgatttctgccctcatg

SEQ ID NO: 61359 - DNA, 20 bp, Human papillomavirus type 30
caaatttgaaaatacaggcg

SEQ ID NO: 61360 - DNA, 20 bp, Human papillomavirus type 30
aaatttgaaaatacaggcga

SEQ ID NO: 61361 - DNA, 20 bp, Human papillomavirus type 30
gaaaatacaggcgagcgccc

SEQ ID NO: 61362 - DNA, 20 bp, Human papillomavirus type 30
aaaatacaggcgagcgccca

SEQ ID NO: 61363 - DNA, 20 bp, Human papillomavirus type 30
tcaaatttgaaagccatggg

SEQ ID NO: 61364 - DNA, 20 bp, Human papillomavirus type 30
tggaccttgtaccgcaaact

SEQ ID NO: 61365 - DNA, 20 bp, Human papillomavirus type 30
ggaccttgtaccgcaaactg

SEQ ID NO: 61366 - DNA, 20 bp, Human papillomavirus type 30
gaccttgtaccgcaaactga

SEQ ID NO: 61367 - DNA, 20 bp, Human papillomavirus type 30
taccgcaaactgaaattgac

SEQ ID NO: 61368 - DNA, 20 bp, Human papillomavirus type 30
acctgcattgctatgagcaa

SEQ ID NO: 61369 - DNA, 20 bp, Human papillomavirus type 30
ttgcatgcccaaaacacata

SEQ ID NO: 61370 - DNA, 20 bp, Human papillomavirus type 30
catgcccaaaacacatatgc

SEQ ID NO: 61371 - DNA, 20 bp, Human papillomavirus type 30
aaaacgaaagtatttaggca

SEQ ID NO: 61372 - DNA, 20 bp, Human papillomavirus type 30
aaacgaaagtatttaggcag

SEQ ID NO: 61373 - DNA, 20 bp, Human papillomavirus type 30
aggcagtccgttgggagaca

SEQ ID NO: 61374 - DNA, 20 bp, Human papillomavirus type 30
ctagattttaataattcttg

SEQ ID NO: 61375 - DNA, 20 bp, Human papillomavirus type 30
taataattcttgtatttgct

SEQ ID NO: 61376 - DNA, 20 bp, Human papillomavirus type 30
aataattcttgtatttgctg

SEQ ID NO: 61377 - DNA, 20 bp, Human papillomavirus type 30
ataattcttgtatttgctgt

SEQ ID NO: 61378 - DNA, 20 bp, Human papillomavirus type 30
ttgtatttgctgtggtggcg

SEQ ID NO: 61379 - DNA, 20 bp, Human papillomavirus type 30
gaactgtcgaaaatggtgca

SEQ ID NO: 61380 - DNA, 20 bp, Human papillomavirus type 30
aactgtcgaaaatggtgcaa

SEQ ID NO: 61381 - DNA, 20 bp, Human papillomavirus type 30
gataatgacgtaacagatga

SEQ ID NO: 61382 - DNA, 20 bp, Human papillomavirus type 30
ataatgacgtaacagatgac

SEQ ID NO: 61383 - DNA, 20 bp, Human papillomavirus type 30
cattttactatgcacagtta

SEQ ID NO: 61384 - DNA, 20 bp, Human papillomavirus type 30
tacagtttttaagatatcaa

SEQ ID NO: 61385 - DNA, 20 bp, Human papillomavirus type 30
ttaagatatcaaggggtcga

SEQ ID NO: 61386 - DNA, 20 bp, Human papillomavirus type 30
taagatatcaaggggtcgac

SEQ ID NO: 61387 - DNA, 20 bp, Human papillomavirus type 30
aagatatcaaggggtcgact

SEQ ID NO: 61388 - DNA, 20 bp, Human papillomavirus type 30
agatatcaaggggtcgactt

SEQ ID NO: 61389 - DNA, 20 bp, Human papillomavirus type 30
attgtcccgactctgtgtct

SEQ ID NO: 61390 - DNA, 20 bp, Human papillomavirus type 30
ttgtcccgactctgtgtcta

SEQ ID NO: 61391 - DNA, 20 bp, Human papillomavirus type 30
tcccgactctgtgtctagta

SEQ ID NO: 61392 - DNA, 20 bp, Human papillomavirus type 30
gatctgagggtactagacac

SEQ ID NO: 61393 - DNA, 20 bp, Human papillomavirus type 30
catttcccatatgcacttcc

SEQ ID NO: 61394 - DNA, 20 bp, Human papillomavirus type 30
tatattgcaaccattgtttt

SEQ ID NO: 61395 - DNA, 20 bp, Human papillomavirus type 30
caaccattgttttatttgtt

SEQ ID NO: 61396 - DNA, 20 bp, Human papillomavirus type 30
ttttatttgttagttttgtg

SEQ ID NO: 61397 - DNA, 20 bp, Human papillomavirus type 30
tatttgttagttttgtgttt

SEQ ID NO: 61398 - DNA, 20 bp, Human papillomavirus type 30
atttgttagttttgtgtttt

SEQ ID NO: 61399 - DNA, 20 bp, Human papillomavirus type 30
ttttgtaacatattacactt

SEQ ID NO: 61400 - DNA, 20 bp, Human papillomavirus type 30
tgtaacatattacacttttg

SEQ ID NO: 61401 - DNA, 20 bp, Human papillomavirus type 30
gtaacatattacacttttgc

SEQ ID NO: 61402 - DNA, 20 bp, Human papillomavirus type 30
taacatattacacttttgct

SEQ ID NO: 61403 - DNA, 20 bp, Human papillomavirus type 30
cacttttgctttgtgtaggg

SEQ ID NO: 61404 - DNA, 20 bp, Human papillomavirus type 30
taccaatccctcctttgttg

SEQ ID NO: 61405 - DNA, 20 bp, Human papillomavirus type 30
accaatccctcctttgttga

SEQ ID NO: 61406 - DNA, 20 bp, Human papillomavirus type 30
ccaatccctcctttgttgaa

SEQ ID NO: 61407 - DNA, 20 bp, Human papillomavirus type 30
gttgaacccccagttattga

SEQ ID NO: 61408 - DNA, 20 bp, Human papillomavirus type 30
ttgaacccccagttattgag

SEQ ID NO: 61409 - DNA, 20 bp, Human papillomavirus type 30
aaccttttcaccatcgggtg

SEQ ID NO: 61410 - DNA, 20 bp, Human papillomavirus type 30
accttttcaccatcgggtgt

SEQ ID NO: 61411 - DNA, 20 bp, Human papillomavirus type 30
tcaccatcgggtgtggcacc

SEQ ID NO: 61412 - DNA, 20 bp, Human papillomavirus type 30
caccatcgggtgtggcacct

SEQ ID NO: 61413 - DNA, 20 bp, Human papillomavirus type 30
accatcgggtgtggcacctg

SEQ ID NO: 61414 - DNA, 20 bp, Human papillomavirus type 30
gctttatggcctgtatactt

SEQ ID NO: 61415 - DNA, 20 bp, Human papillomavirus type 30
ctttatggcctgtatacttt

SEQ ID NO: 61416 - DNA, 20 bp, Human papillomavirus type 30
atggcctgtatactttttaa

SEQ ID NO: 61417 - DNA, 20 bp, Human papillomavirus type 30
tggcctgtatactttttaag

SEQ ID NO: 61418 - DNA, 20 bp, Human papillomavirus type 30
ttaaggcgtaggcgtcgtaa

SEQ ID NO: 61419 - DNA, 20 bp, Human papillomavirus type 30
gacatccatattattctatt

SEQ ID NO: 61420 - DNA, 20 bp, Human papillomavirus type 30
ttctatttctaaggctggta

SEQ ID NO: 61421 - DNA, 20 bp, Human papillomavirus type 30
tatttctaaggctggtaatt

SEQ ID NO: 61422 - DNA, 20 bp, Human papillomavirus type 30
ctaaggctggtaattccaaa

SEQ ID NO: 61423 - DNA, 20 bp, Human papillomavirus type 30
taaggctggtaattccaaaa

SEQ ID NO: 61424 - DNA, 20 bp, Human papillomavirus type 30
gttggggcaaccaggtattt

SEQ ID NO: 61425 - DNA, 20 bp, Human papillomavirus type 30
ttggggcaaccaggtatttg

SEQ ID NO: 61426 - DNA, 20 bp, Human papillomavirus type 30
gggcaaccaggtatttgtta

SEQ ID NO: 61427 - DNA, 20 bp, Human papillomavirus type 30
gttactgttgtggacaccac

SEQ ID NO: 61428 - DNA, 20 bp, Human papillomavirus type 30
ttactgttgtggacaccact

SEQ ID NO: 61429 - DNA, 20 bp, Human papillomavirus type 30
agggctggaatattggattg

SEQ ID NO: 61430 - DNA, 20 bp, Human papillomavirus type 30
gattgtcacccccagctgcc

SEQ ID NO: 61431 - DNA, 20 bp, Human papillomavirus type 30
tcacccccagctgccacaag

SEQ ID NO: 61432 - DNA, 20 bp, Human papillomavirus type 30
gaggacaaatacagatatgt

SEQ ID NO: 61433 - DNA, 20 bp, Human papillomavirus type 30
aaagccttgctataacctgt

SEQ ID NO: 61434 - DNA, 20 bp, Human papillomavirus type 30
ctctacctctacaccatcag

SEQ ID NO: 61435 - DNA, 20 bp, Human papillomavirus type 30
tttgtgtctgtgtatgtttc

SEQ ID NO: 61436 - DNA, 20 bp, Human papillomavirus type 30
gtgtctgtgtatgtttcctt

SEQ ID NO: 61437 - DNA, 20 bp, Human papillomavirus type 30
tgtctgtgtatgtttcctta

SEQ ID NO: 61438 - DNA, 20 bp, Human papillomavirus type 30
cgtttggctgatggtgtaga

SEQ ID NO: 61439 - DNA, 20 bp, Human papillomavirus type 30
aggtagcaatttaggtggcg

SEQ ID NO: 61440 - DNA, 20 bp, Human papillomavirus type 30
ggtagcaatttaggtggcgt

SEQ ID NO: 61441 - DNA, 20 bp, Human papillomavirus type 30
aggtggcgtccctatgtcct

SEQ ID NO: 61442 - DNA, 20 bp, Human papillomavirus type 30
ggtggcgtccctatgtcctc

SEQ ID NO: 61443 - DNA, 20 bp, Human papillomavirus type 30
ttggttgttgcacaccactg

SEQ ID NO: 61444 - DNA, 20 bp, Human papillomavirus type 30
ttagtcatatatgtatgctg

SEQ ID NO: 61445 - DNA, 20 bp, Human papillomavirus type 30
gtcatatatgtatgctgcca

SEQ ID NO: 61446 - DNA, 20 bp, Human papillomavirus type 30
tatcagcatactttactgct

SEQ ID NO: 61447 - DNA, 20 bp, Human papillomavirus type 30
atcagcatactttactgctg

SEQ ID NO: 61448 - DNA, 20 bp, Human papillomavirus type 30
tcagcatactttactgctgt

SEQ ID NO: 61449 - DNA, 20 bp, Human papillomavirus type 34
ggaaatgttttttcccaatc

SEQ ID NO: 61450 - DNA, 20 bp, Human papillomavirus type 34
tttcccaatcctgaggaacg

SEQ ID NO: 61451 - DNA, 20 bp, Human papillomavirus type 34
ttcccaatcctgaggaacgg

SEQ ID NO: 61452 - DNA, 20 bp, Human papillomavirus type 34
tcccaatcctgaggaacggc

SEQ ID NO: 61453 - DNA, 20 bp, Human papillomavirus type 34
cccaatcctgaggaacggcc

SEQ ID NO: 61454 - DNA, 20 bp, Human papillomavirus type 34
tgttagatctgaaaccaacg

SEQ ID NO: 61455 - DNA, 20 bp, Human papillomavirus type 34
gatctgaaaccaacgaccga

SEQ ID NO: 61456 - DNA, 20 bp, Human papillomavirus type 34
catgttacgagtcattagac

SEQ ID NO: 61457 - DNA, 20 bp, Human papillomavirus type 34
cgagtcattagacaactcag

SEQ ID NO: 61458 - DNA, 20 bp, Human papillomavirus type 34
gacaactcagaggatgagga

SEQ ID NO: 61459 - DNA, 20 bp, Human papillomavirus type 34
cagacgcctataacagaaga

SEQ ID NO: 61460 - DNA, 20 bp, Human papillomavirus type 34
aggtaattgggaagggaggt

SEQ ID NO: 61461 - DNA, 20 bp, Human papillomavirus type 34
ggaagggaggtgttcgggat

SEQ ID NO: 61462 - DNA, 20 bp, Human papillomavirus type 34
gggatggtttaatgtagaag

SEQ ID NO: 61463 - DNA, 20 bp, Human papillomavirus type 34
aatgtagaagccattgtaga

SEQ ID NO: 61464 - DNA, 20 bp, Human papillomavirus type 34
gaggactgtcaatttgacct

SEQ ID NO: 61465 - DNA, 20 bp, Human papillomavirus type 34
gacctatctcaaatggtaca

SEQ ID NO: 61466 - DNA, 20 bp, Human papillomavirus type 34
acctatctcaaatggtacag

SEQ ID NO: 61467 - DNA, 20 bp, Human papillomavirus type 34
gataatgacataacaaatga

SEQ ID NO: 61468 - DNA, 20 bp, Human papillomavirus type 34
ataatgacataacaaatgac

SEQ ID NO: 61469 - DNA, 20 bp, Human papillomavirus type 34
gctgatgcaaaaatggcatt

SEQ ID NO: 61470 - DNA, 20 bp, Human papillomavirus type 34
ttagatgatgcaacacctgc

SEQ ID NO: 61471 - DNA, 20 bp, Human papillomavirus type 34
gatgatgcaacacctgcatg

SEQ ID NO: 61472 - DNA, 20 bp, Human papillomavirus type 34
atagatatttaagaaatgca

SEQ ID NO: 61473 - DNA, 20 bp, Human papillomavirus type 34
aagaaatgcattagatggca

SEQ ID NO: 61474 - DNA, 20 bp, Human papillomavirus type 34
ccatttgacagtaatggaaa

SEQ ID NO: 61475 - DNA, 20 bp, Human papillomavirus type 34
catttgacagtaatggaaat

SEQ ID NO: 61476 - DNA, 20 bp, Human papillomavirus type 34
gacagtaatggaaatccact

SEQ ID NO: 61477 - DNA, 20 bp, Human papillomavirus type 34
acagtaatggaaatccacta

SEQ ID NO: 61478 - DNA, 20 bp, Human papillomavirus type 34
ctaatgaaaactggaaggca

SEQ ID NO: 61479 - DNA, 20 bp, Human papillomavirus type 34
accaacaagcggtgccaagc

SEQ ID NO: 61480 - DNA, 20 bp, Human papillomavirus type 34
cagtatcacgatccaaaggg

SEQ ID NO: 61481 - DNA, 20 bp, Human papillomavirus type 34
aactacaattagccctagaa

SEQ ID NO: 61482 - DNA, 20 bp, Human papillomavirus type 34
gccctagaaagtttaaatga

SEQ ID NO: 61483 - DNA, 20 bp, Human papillomavirus type 34
aaactttctagggctaattg

SEQ ID NO: 61484 - DNA, 20 bp, Human papillomavirus type 34
caaaggttgagggcaatact

SEQ ID NO: 61485 - DNA, 20 bp, Human papillomavirus type 34
agggcaatactttagctgac

SEQ ID NO: 61486 - DNA, 20 bp, Human papillomavirus type 34
agctgaccaaatattaaaat

SEQ ID NO: 61487 - DNA, 20 bp, Human papillomavirus type 34
gctgaccaaatattaaaata

SEQ ID NO: 61488 - DNA, 20 bp, Human papillomavirus type 34
aaatatggtagcattggggt

SEQ ID NO: 61489 - DNA, 20 bp, Human papillomavirus type 34
tattgaagctggtgtgccag

SEQ ID NO: 61490 - DNA, 20 bp, Human papillomavirus type 34
attgaagctggtgtgccagg

SEQ ID NO: 61491 - DNA, 20 bp, Human papillomavirus type 34
ttgaagctggtgtgccaggt

SEQ ID NO: 61492 - DNA, 20 bp, Human papillomavirus type 34
aagctggtgtgccaggtcct

SEQ ID NO: 61493 - DNA, 20 bp, Human papillomavirus type 34
tagttctggatttaatgtaa

SEQ ID NO: 61494 - DNA, 20 bp, Human papillomavirus type 34
cataatgctcctgactctga

SEQ ID NO: 61495 - DNA, 20 bp, Human papillomavirus type 34
tttagatattgtaaagttac

SEQ ID NO: 61496 - DNA, 20 bp, Human papillomavirus type 34
ttagatattgtaaagttaca

SEQ ID NO: 61497 - DNA, 20 bp, Human papillomavirus type 34
tagatattgtaaagttacat

SEQ ID NO: 61498 - DNA, 20 bp, Human papillomavirus type 34
agatattgtaaagttacata

SEQ ID NO: 61499 - DNA, 20 bp, Human papillomavirus type 34
catcctagcttgtatgtcat

SEQ ID NO: 61500 - DNA, 20 bp, Human papillomavirus type 34
tatgtcattccacgcaaacg

SEQ ID NO: 61501 - DNA, 20 bp, Human papillomavirus type 34
cacgcaaacgtaaacgtttg

SEQ ID NO: 61502 - DNA, 20 bp, Human papillomavirus type 34
gtcatatttttttgcagatg

SEQ ID NO: 61503 - DNA, 20 bp, Human papillomavirus type 34
tcatatttttttgcagatgt

SEQ ID NO: 61504 - DNA, 20 bp, Human papillomavirus type 34
tgtattgtaggctgtaagcc

SEQ ID NO: 61505 - DNA, 20 bp, Human papillomavirus type 34
taggctgtaagcctccctta

SEQ ID NO: 61506 - DNA, 20 bp, Human papillomavirus type 34
ggggaacattggggtacagg

SEQ ID NO: 61507 - DNA, 20 bp, Human papillomavirus type 34
gggtacaggcacaccatgtg

SEQ ID NO: 61508 - DNA, 20 bp, Human papillomavirus type 34
cccagcattttgggtaccac

SEQ ID NO: 61509 - DNA, 20 bp, Human papillomavirus type 34
tatgtggttttatattcgta

SEQ ID NO: 61510 - DNA, 20 bp, Human papillomavirus type 34
tatattcgtagggaacaaat

SEQ ID NO: 61511 - DNA, 20 bp, Human papillomavirus type 34
atattcgtagggaacaaatg

SEQ ID NO: 61512 - DNA, 20 bp, Human papillomavirus type 34
tattcgtagggaacaaatgt

SEQ ID NO: 61513 - DNA, 20 bp, Human papillomavirus type 34
gtagggaacaaatgtttgtt

SEQ ID NO: 61514 - DNA, 20 bp, Human papillomavirus type 34
tgttcattcgccattttata

SEQ ID NO: 61515 - DNA, 20 bp, Human papillomavirus type 34
gttcattcgccattttatat

SEQ ID NO: 61516 - DNA, 20 bp, Human papillomavirus type 34
ttcattcgccattttatata

SEQ ID NO: 61517 - DNA, 20 bp, Human papillomavirus type 34
attcgccattttatatattt

SEQ ID NO: 61518 - DNA, 20 bp, Human papillomavirus type 34
gccattttatatattttaaa

SEQ ID NO: 61519 - DNA, 20 bp, Influenza A virus
gttaccatgcaaacaactcg

SEQ ID NO: 61520 - DNA, 20 bp, Influenza A virus
ccatgcaaacaactcgacag

SEQ ID NO: 61521 - DNA, 20 bp, Influenza A virus
acacaataatggaaaagaac

SEQ ID NO: 61522 - DNA, 20 bp, Influenza A virus
ctgttacacatgcccaagac

SEQ ID NO: 61523 - DNA, 20 bp, Influenza A virus
cacatgcccaagacatactg

SEQ ID NO: 61524 - DNA, 20 bp, Influenza A virus
catagtggagaaggccagtc

SEQ ID NO: 61525 - DNA, 20 bp, Influenza A virus
cccaggggatttcaacgact

SEQ ID NO: 61526 - DNA, 20 bp, Influenza A virus
caacgactatgaagaactga

SEQ ID NO: 61527 - DNA, 20 bp, Influenza A virus
aacgactatgaagaactgaa

SEQ ID NO: 61528 - DNA, 20 bp, Influenza A virus
cagttcttcatagtcgttga

SEQ ID NO: 61529 - DNA, 20 bp, Influenza A virus
tagtactgtgggggattcac

SEQ ID NO: 61530 - DNA, 20 bp, Influenza A virus
agtactgtgggggattcacc

SEQ ID NO: 61531 - DNA, 20 bp, Influenza A virus
gtactgtgggggattcacca

SEQ ID NO: 61532 - DNA, 20 bp, Influenza A virus
accatcctaatgatgcggca

SEQ ID NO: 61533 - DNA, 20 bp, Influenza A virus
ggttttgatagagctttgtc

SEQ ID NO: 61534 - DNA, 20 bp, Influenza A virus
cattgctccagaatatgcat

SEQ ID NO: 61535 - DNA, 20 bp, Influenza A virus
attgctccagaatatgcata

SEQ ID NO: 61536 - DNA, 20 bp, Influenza A virus
ctccagaatatgcatacaaa

SEQ ID NO: 61537 - DNA, 20 bp, Influenza A virus
tcaagaaaggggactcagca

SEQ ID NO: 61538 - DNA, 20 bp, Influenza A virus
tgaaaagtgaattggaatat

SEQ ID NO: 61539 - DNA, 20 bp, Influenza A virus
ggagctatagcaggttttat

SEQ ID NO: 61540 - DNA, 20 bp, Influenza A virus
gagctatagcaggttttata

SEQ ID NO: 61541 - DNA, 20 bp, Influenza A virus
tatagagggaggatggcagg

SEQ ID NO: 61542 - DNA, 20 bp, Influenza A virus
atagagggaggatggcaggg

SEQ ID NO: 61543 - DNA, 20 bp, Influenza A virus
tagagggaggatggcaggga

SEQ ID NO: 61544 - DNA, 20 bp, Influenza A virus
ctagatgtctggacttataa

SEQ ID NO: 61545 - DNA, 20 bp, Influenza A virus
taatgctgaacttctggttc

SEQ ID NO: 61546 - DNA, 20 bp, Influenza A virus
tggttctcatggaaaatgag

SEQ ID NO: 61547 - DNA, 20 bp, Influenza A virus
tcatggaaaatgagagaact

SEQ ID NO: 61548 - DNA, 20 bp, Influenza A virus
catgactcaaatgtcaagaa

SEQ ID NO: 61549 - DNA, 20 bp, Influenza A virus
agaagaagcaagactaaaca

SEQ ID NO: 61550 - DNA, 20 bp, Influenza A virus
gaatcaatgggaacttacca

SEQ ID NO: 61551 - DNA, 20 bp, Influenza A virus
ccaaatactgtcaatttatt

SEQ ID NO: 61552 - DNA, 20 bp, Influenza A virus
attcaacagtggcgagttcc

SEQ ID NO: 61553 - DNA, 20 bp, Influenza A virus
ttcaacagtggcgagttccc

SEQ ID NO: 61554 - DNA, 20 bp, Influenza A virus
cgaacagatggagactgatg

SEQ ID NO: 61555 - DNA, 20 bp, Influenza A virus
ttccgacggatgctctgatt

SEQ ID NO: 61556 - DNA, 20 bp, Influenza A virus
tccgacggatgctctgattt

SEQ ID NO: 61557 - DNA, 20 bp, Influenza A virus
ccgacggatgctctgatttc

SEQ ID NO: 61558 - DNA, 20 bp, Influenza A virus
cgacggatgctctgatttca

SEQ ID NO: 61559 - DNA, 20 bp, Influenza A virus
atgacaaagaagaaataagg

SEQ ID NO: 61560 - DNA, 20 bp, Influenza A virus
tgacaaagaagaaataaggc

SEQ ID NO: 61561 - DNA, 20 bp, Influenza A virus
gccttatttcttctttgtca

SEQ ID NO: 61562 - DNA, 20 bp, Influenza A virus
tttcttctttgtcataaagg

SEQ ID NO: 61563 - DNA, 20 bp, Influenza A virus
cttctttgtcataaaggatg

SEQ ID NO: 61564 - DNA, 20 bp, Influenza A virus
gaacaatggtgatggaattg

SEQ ID NO: 61565 - DNA, 20 bp, Influenza A virus
gtcaggatgatcaaacgtgg

SEQ ID NO: 61566 - DNA, 20 bp, Influenza A virus
tcacccctccagaagttccg

SEQ ID NO: 61567 - DNA, 20 bp, Influenza A virus
cgatcattgatcccacgttt

SEQ ID NO: 61568 - DNA, 20 bp, Influenza A virus
atcccacgtttgatcatcct

SEQ ID NO: 61569 - DNA, 20 bp, Influenza A virus
tgccgcatttgaagatctaa

SEQ ID NO: 61570 - DNA, 20 bp, Influenza A virus
gaagatctaagagtattgag

SEQ ID NO: 61571 - DNA, 20 bp, Influenza A virus
aagatctaagagtattgagc

SEQ ID NO: 61572 - DNA, 20 bp, Influenza A virus
agcttcatcaaagggacgaa

SEQ ID NO: 61573 - DNA, 20 bp, Influenza A virus
atcaaagggacgaaggtggt

SEQ ID NO: 61574 - DNA, 20 bp, Human papillomavirus type 101
gccctttagtgctacctgca

SEQ ID NO: 61575 - DNA, 20 bp, Human papillomavirus type 101
agtgctacctgcaaacttat

SEQ ID NO: 61576 - DNA, 20 bp, Human papillomavirus type 101
gtgctacctgcaaacttatt

SEQ ID NO: 61577 - DNA, 20 bp, Human papillomavirus type 101
ttatgtgatgaattagtaac

SEQ ID NO: 61578 - DNA, 20 bp, Human papillomavirus type 101
tgtgatgaattagtaaccga

SEQ ID NO: 61579 - DNA, 20 bp, Human papillomavirus type 101
gagcccaagactgcaacagt

SEQ ID NO: 61580 - DNA, 20 bp, Human papillomavirus type 101
agcccaagactgcaacagtt

SEQ ID NO: 61581 - DNA, 20 bp, Human papillomavirus type 101
cgtgtatcgtcccaaggatc

SEQ ID NO: 61582 - DNA, 20 bp, Human papillomavirus type 101
tactggatccttgggacgat

SEQ ID NO: 61583 - DNA, 20 bp, Human papillomavirus type 101
actggatccttgggacgata

SEQ ID NO: 61584 - DNA, 20 bp, Human papillomavirus type 101
tgaatacctgcaaattataa

SEQ ID NO: 61585 - DNA, 20 bp, Human papillomavirus type 101
taaatccaagcatggggacg

SEQ ID NO: 61586 - DNA, 20 bp, Human papillomavirus type 101
cagtaatgatgttgtttcag

SEQ ID NO: 61587 - DNA, 20 bp, Human papillomavirus type 101
tttcagttttatgctgcaaa

SEQ ID NO: 61588 - DNA, 20 bp, Human papillomavirus type 101
cagttttatgctgcaaaatg

SEQ ID NO: 61589 - DNA, 20 bp, Human papillomavirus type 101
gtaaatagcagaagccaatt

SEQ ID NO: 61590 - DNA, 20 bp, Human papillomavirus type 101
taaatagcagaagccaattt

SEQ ID NO: 61591 - DNA, 20 bp, Human papillomavirus type 101
tggttgcaaccactagtaga

SEQ ID NO: 61592 - DNA, 20 bp, Human papillomavirus type 101
ggttgcaaccactagtagat

SEQ ID NO: 61593 - DNA, 20 bp, Human papillomavirus type 101
gttgcaaccactagtagatg

SEQ ID NO: 61594 - DNA, 20 bp, Human papillomavirus type 101
gacctgggcgatccagacga

SEQ ID NO: 61595 - DNA, 20 bp, Human papillomavirus type 101
cgatgctgtgcaagacaggc

SEQ ID NO: 61596 - DNA, 20 bp, Human papillomavirus type 101
gatgctgtgcaagacaggct

SEQ ID NO: 61597 - DNA, 20 bp, Human papillomavirus type 101
ataaatccccagtagcctgt

SEQ ID NO: 61598 - DNA, 20 bp, Human papillomavirus type 101
cacagcatcgaaacggtcga

SEQ ID NO: 61599 - DNA, 20 bp, Human papillomavirus type 101
tggaccgctatttattacca

SEQ ID NO: 61600 - DNA, 20 bp, Human papillomavirus type 101
attaccaagacgcacaggac

SEQ ID NO: 61601 - DNA, 20 bp, Human papillomavirus type 101
ttaccaagacgcacaggaca

SEQ ID NO: 61602 - DNA, 20 bp, Human papillomavirus type 101
ccaagacgcacaggacaatt

SEQ ID NO: 61603 - DNA, 20 bp, Human papillomavirus type 101
taccaattgtcctgtgcgtc

SEQ ID NO: 61604 - DNA, 20 bp, Human papillomavirus type 101
atcagtggggcaaggacatc

SEQ ID NO: 61605 - DNA, 20 bp, Human papillomavirus type 101
gcgacttgcaagattacaag

SEQ ID NO: 61606 - DNA, 20 bp, Human papillomavirus type 101
caagattacaagacgaggct

SEQ ID NO: 61607 - DNA, 20 bp, Human papillomavirus type 101
caagacgaggctagggatcc

SEQ ID NO: 61608 - DNA, 20 bp, Human papillomavirus type 101
ttaaagggcctgcaaatact

SEQ ID NO: 61609 - DNA, 20 bp, Human papillomavirus type 101
cagtaacaagcacacggcat

SEQ ID NO: 61610 - DNA, 20 bp, Human papillomavirus type 101
agtaacaagcacacggcatg

SEQ ID NO: 61611 - DNA, 20 bp, Human papillomavirus type 101
atccttcttacatatcggta

SEQ ID NO: 61612 - DNA, 20 bp, Human papillomavirus type 101
ttacatatcggtatatggcc

SEQ ID NO: 61613 - DNA, 20 bp, Human papillomavirus type 101
catatcggtatatggccatc

SEQ ID NO: 61614 - DNA, 20 bp, Human papillomavirus type 101
gtcagcaatctggggtggcc

SEQ ID NO: 61615 - DNA, 20 bp, Human papillomavirus type 101
ttgatggcttagcatctgct

SEQ ID NO: 61616 - DNA, 20 bp, Human papillomavirus type 101
atggcttagcatctgctaac

SEQ ID NO: 61617 - DNA, 20 bp, Human papillomavirus type 101
gcatctgctaacattaatgg

SEQ ID NO: 61618 - DNA, 20 bp, Human papillomavirus type 101
atggcagtgctgaaacatct

SEQ ID NO: 61619 - DNA, 20 bp, Human papillomavirus type 101
ccagatgtgtctgaacctcc

SEQ ID NO: 61620 - DNA, 20 bp, Human papillomavirus type 101
cagatgtgtctgaacctcct

SEQ ID NO: 61621 - DNA, 20 bp, Human papillomavirus type 101
ttgtggatggttttgatgca

SEQ ID NO: 61622 - DNA, 20 bp, Human papillomavirus type 101
tggatggttttgatgcattt

SEQ ID NO: 61623 - DNA, 20 bp, Human papillomavirus type 101
tgatgcatttgatacatttt

SEQ ID NO: 61624 - DNA, 20 bp, Human papillomavirus type 101
ctatggatcctaaacaaaca

SEQ ID NO: 61625 - DNA, 20 bp, Human papillomavirus type 101
tatggatcctaaacaaacac

SEQ ID NO: 61626 - DNA, 20 bp, Human papillomavirus type 101
tttgttgttggttgcacccc

SEQ ID NO: 61627 - DNA, 20 bp, Human papillomavirus type 101
gttgttggttgcaccccttg

SEQ ID NO: 61628 - DNA, 20 bp, Human papillomavirus type 101
ttgttggttgcaccccttgt

SEQ ID NO: 61629 - DNA, 20 bp, Human papillomavirus type 101
tattggtgctgagcaaggcc

SEQ ID NO: 61630 - DNA, 20 bp, Human papillomavirus type 101
attggtgctgagcaaggcca

SEQ ID NO: 61631 - DNA, 20 bp, Human papillomavirus type 101
ttggtgctgagcaaggccag

SEQ ID NO: 61632 - DNA, 20 bp, Human papillomavirus type 101
gtgctgagcaaggccaggac

SEQ ID NO: 61633 - DNA, 20 bp, Human papillomavirus type 101
atattttgctacacctagtg

SEQ ID NO: 61634 - DNA, 20 bp, Human papillomavirus type 101
ctacaatgtgtcccacagca

SEQ ID NO: 61635 - DNA, 20 bp, Human papillomavirus type 101
ttgggtggttgatttatcag

SEQ ID NO: 61636 - DNA, 20 bp, Human papillomavirus type 101
tgggtggttgatttatcaga

SEQ ID NO: 61637 - DNA, 20 bp, Human papillomavirus type 101
gggtggttgatttatcagac

SEQ ID NO: 61638 - DNA, 20 bp, Human papillomavirus type 101
ggtggttgatttatcagaca

SEQ ID NO: 61639 - DNA, 20 bp, Human papillomavirus type 101
ctggtacatttgctgccaat

SEQ ID NO: 61640 - DNA, 20 bp, Human papillomavirus type 101
gctgccaattttgccagcag

SEQ ID NO: 61641 - DNA, 20 bp, Human papillomavirus type 101
ctgccaattttgccagcagg

SEQ ID NO: 61642 - DNA, 20 bp, Human papillomavirus type 101
tgccagcaggtatgttcatg

SEQ ID NO: 61643 - DNA, 20 bp, Human papillomavirus type 101
gccagcaggtatgttcatgt

SEQ ID NO: 61644 - protein, 1442 aa, Unknown
  Microbial Source - Accession No. Ga0109381_1004188
MANQAAVTQRAYTLRLRGVDPQDQSWRDALWATHEAVNKGAKAFGDWLLTLRGGLDHALADAKVKGGKRKPDRDPTDEERKGRRILLALSWLSVESEKGAPDRHVVPHDLNKQSGSRSWKTVDALREILKGRGLDESEIESWVQDCSASLSAAIRDDAVWVNRSKAFDDAVKSIDCSLTRDEVWDMLDRFLGSRDAYLAPAKGAEDESAEAEQEDKAKDLVQKAGQWLSSRFGTGKGADFSRMAAVYEKIADWAGKARAGMTGDAAVAGLAAALSEFSPASNDLQGVFRLISGPGYKSATRKLLKQLPARPSVAQEDLENLRDSACDDAEKCKANTGSKRQRAYADAILKDVESVCGFTYLQEGGPARHSEFAVMLDHAARRVSLAHTWIKRAEAERRRFEEDARRMDKLPARVKQWLDAFCFERSERLKASGEKKTYRIRRRAVDGWKELVAAWSNADCKTAEDRIAAARALQDDPEIEKFGDIQLFEALADDEALCVWHKDGDLAKSPDPQPLIDYVLATDAEFKKRQFKVPAYRHPDALLHPVFCDFGNSRWDISFDVHKAVKTSERNRKNMMAQDPHALSMTLWTGSTVEPQRLRWQSKRLARDLALKGRQDANARPVTRADRLGRAAAGVFAHSAVRIAGIFAQEDWNGRLQAPRAQLDAIAARVARHGWDAKARQMRDHLRWLITFSAKLQLSGPWAGPEPSPWVEYTKTFPDDAPAKPFVSRKGDYAVRHQGNDARNGHAKLILSRLPGLRVLSVDLGHRYAAACAVWETLSAEQLKAACQAAGHEPPKDSDLYLYLKKKVKKQKKGKALEVEETTVYRRIGADVLPDGKPHPAPWARLDRQFLIKLQGEDTEARKASSAEVGAVQELERAVGREPPDQRSLRVDDLMSETVRTVRLALQRHGRRARIAFNLTASKRHLPDGREEVLTAEERVKLLADTLADWYALFTGKGWHDEWARQQWETHIAPLLQGSVLPQIPEDAEDVPKARRKYQDDLMERLSPLARSLAGNDSLCRKLHCLWATRWRENDVILRKRLRWLRDWILPRGRNAEGDPAIRHVGGLSLTRIATIKSLYQVQKAFHMRSEPEDPSRNNPSKGDDALLDFGRSILDVMEHMREQRVKQLASRIAEAALGIGRVKRLAGGKDPKRPRQRVDRPCHAVVIENLTHYRPEETRTRRENRQLMSWSSSKVSKYLAEACQLHGLHLREVQAGYTSRQDSRTGAPGVRCQDVPVSEFMQSPFWRKQVAQAEKKRAEGKGDARERFLCDLNEKWKGQPEADWKRAAAVRVPLKGGEIFVSADEKSPAAKGLQADLNAAANIGLRALTDPDWPGKWWYVPCDPTNFKPAKDKVAGSAAICLDKPLKNAPAAQDTDGPRKKRGKAEARSREVVNLWRDVSSQPISANDDWREFTPYWNEVQARVVNILRQSAGFARDQGER

SEQ ID NO: 61645 - protein, 1285 aa, Unknown
  Microbial Source - Accession No. Ga0212093_1006934
MEEKMLKSYDYFTKLYSLQKTLRFELKPIGKTLEHIKNSGIIESDETLEEQYAIVKNIIDKLHRKHIDEALSLVDFTKHLDTLKTFQELYLKRGKTDKEKEELEKLSADLRKLIVSYLKGNVKEKTQHNLNPIKERFEILFGKELFTNEEFFLLAENEKEKKAIQAFKGFTTYFKGFQENRKNMYSEEGNSTSIAYRIINENLPLFIENIARFQKVMSTIEKTTIKKLEQNLKTELKKHNLPGIFTIEYFNNVLTQEGISRYNTIIGGKTTHEGVKIQGLNEIINLYNQQSKDVKLPILKPLHKQILSEEYSTSFKIKAFENDNEVLKAIDTFWNEHIEKSIHPVTGNKFNILSKIENLCDQLQKYKDKDLEKLFIERKNLSTVSHQVYGQWNIIRDALRMHLEMNNKNIKEKDIDKYLDNDAFSWKEIKDSIKIYKEHVEDAKELNENGIIKYFSAMSINEEDDEKEYSISLIKNINEKYNNVKSILQEDRTGKSDLHQDKEKVGIIKEFLDSLKQLQWFLRLLYVTVPLDEKDYEFYNELEVYYEALLPLNSLYNKVRNYMTRKPYSVEKFKLNFNSPTLLDGWDKNKETANLSIILRKNGKYYLGIMNKENNTIFEYYPGTKSNDYYEKMIYKLLPGPNKMLPKVFFSKKGLEYYNPPKEILNIYEKGEFKKDKSGNFKKESLHTLIDFYKEAIAKNEDWEVFNFKFKNTKEYEDISQFYRDVEEQGYLITFEKVDANYVDKLVKEGKLYLFQIYNKDFSENKKSKGNPNLHTIYWKGLYDSENLKNVVYKLNGEAEVFYRKKSIDYPEEIYNHGHHKEELLGKFNYPIIKDRRYTQDKFLFHVPITMNFISKEEKRVNQLACEYLSATKEDVHIIGIDRGERHLLYLSLIDKEGNIKKQLSLNTIKNENYDKEIDYRVKLDEKEKKRDEARKNWDVIENIKELKEGYMSQVIHIIAKMMVEEKAILIMEDLNIGFKRGRFKVEKQVYQKFEKMLIDKLNYLVFKNKNPLEPGGSLNAYQLTSKFDSFKKLGKQSGFIFYVPSAYTSKIDPTTGFYNFIQVDVPNLEKGKEFFSKFEKIIYNTKEDYFEFHCKYGKFVSEPKNKDNDRKTKESLTYYNAIKDTVWVVCSTNHERYKIVRNKAGYYESHPVDVTKNLKDIFSQANINYNEGKDIKPIIIESNNAKLLKSIAEQLKLILAMRYNNGKHGDDEKDYILSPVKNKQGKFFCTLDGNQTLPINADANGAYNIALKGLLLIEKIKKQQGKIKDLYISNLEWFMFMMSR

SEQ ID NO: 61646 - protein, 1273 aa, Unknown
  Microbial Source - Accession No. GA0212092_1000015
MQDKTGWSSFTNKYSLSKTLRFELKPVGNTQKMLEDDGVFQKDRERQENYKKVKPFMDKLHREFIKEALNNLKLEGLTEYFEIFKKFRKDKNNKELKNAEKKLRQIIGRCYTETAQIWVEKYKEFGFKKKNIGFLFEEGVFELMKLKYGNDEASQIEKNGEVLSIFDGWKGFLGYFKKFFETRNNFYKDDGTSTAVSTRIINENLKIYLDNLIKYNKIKDKVDFKEADILQENKLNLSDFFNVESYAKYSLQKGIDYYNEILGGKTLKNGTKLKGLNEVINEYKQKNKSGELSKFKMLKKQILGEGEDRTLFEEIENEDELKDVLKDFFYNADPKITLFKTLLEDFFSNTEKYKDELDKIYFNTVAINGILHRWVDDSGVFQKYLFEVLKSNKLVKSNHYDKKEDSYKFPDFISFEHIKVALENCERDGLKDKFWKEKYYTKECLTENGLANLWQEFLEIYKCEFKKLYDYKTDDNDCYLQYRDNYKKYILDANFNPKEKSAKDIIKDYLDSVLSIYQLAKYFALEKKKVWTTDYETGDFYYEYIKFYEDTYEQIIKPYNLVRNYLTRKPINTAKKWKLNFDNAYLASGWDKDKEVSNLTVILRRDEQYYLAIMKKGKNKIFEKKFSCGEFEKMEYKQIAEASSDIHNLVLMNDGSCRRCIKMHDKRKYWPLDISIIKEKKSYAKENFVRRDFERFVNYMKKCSLLYWKEYDLKFSDTSTYKNINDFTNEIASQGYKLSFSAIPESYINEKNNNGELYLFQIYNKDFGIKTEGNKNLHTMYWESIFSEENRFRNFIVKLNGKAEIFYRPKSEQVEKEQRNFTREIIKNRRYTENKIYFHCPITLNRISRENVKKFNNGINNYIATNPNINILGVDRGEKHLVYYAIVDQDGKLIDAEDATGSFNTIGSTDYHRLLEEKAKDREKERKDWDLIRGIKDLKKGYISLVVRKIADLAIKYNAIIIFEDLNTRFKQIRGGMEKSVYQQLEKALINKLSFLVNKGEKDPEQAGHLLKAYQLAAPFQTFDKMGRQTGIIFYTQASYTSKIDPITGWRPNLYLKYRNIDDSKESIKKFKSILFNKEKNRFEFTYDLKDFVDFEEDKIPEKTEWTLCSSVERHKWNRHMNNNKGGYEVYKDLTENFYKLFDENNISMNKDIVDQVESISNGNFFRQFIYLFNLVCQIRNTDEKAEDVDKRDFILSPVEPFFDSRRAKDFKAYGDNLPKNGDENGAYNIARKGVLIIKKIKEYYNQNGSCDKLGWGDLSISHKEWDDFATNN

SEQ ID NO: 61647 - protein, 488 aa, Unknown
  Microbial Source - Accession No. GA0117933_1071983
VSVFLTAKLKVHNPSRRKRAVLDHALEEYTRAYAWLLGWAKDNLPLLEKKGQYRGRFTETAIRKALPPASAFNTYDLHSSARDSLLVDVAGALCSYFRLRDENPLTAFPTCRDPRPETYPDALEEFASVADDERDYNERRDRLSKVARGAVMPVYFARPDGVPRGRNFSLLCDPAARRYYAIVFLLPGRGGGALHGRGNLARMGWPQGHDAGEPPPRFHGKPSGALVLPLALGRWHAETFLDPCLRGEANVRSAFLSRADVDGRDADYYVHVTFEFSPPTIETETFLGVDRGISNLIALTVTDGEGRVLHQELHPGDDLVSFQKYVFTEYRRRQRRGRTLRGERVIARANEEVCHRLANVIADVAVRHRSQVVMERLKGFKEQRRDFGLLKRAPLQRIEQILEYKLPVRGLPPPRTVNPAYTSRECPRCGYGRDVRGKGINRPSQAQFRCERCGYETHADLNGSHNIARRWIDIRARPKLAASTLTTA

SEQ ID NO: 61648 - protein, 1059 aa, Unknown
  Microbial Source - Accession No. GA0212092_1024084
MADGKPPTFPRTYTMRLCPPDEGQADRNGLWDKLFATHYAVNAGARAFGEFLLDMRGGLSPDLSRMGLDRIKDDAKRRLALAGRRRMLALGWLSVEDDHGAGDHPHALPESSGQPLPRDVAEKLLRQILETKGVTDRATVDEWCDDCLGALTAAVRDDTVWVNRAESYRNLDSGPSPDQAFKILERLLGKNFLDLSLGKETRTRDRHRGQLGTDEGEDGEDKEEWRTTAASGNDPSENARQLICDLFGTGQKGDFRKTAGFAAKVKNWVNSLGDYKNCDQPSLENRIRETFRSVFSGGEYPSFPSKELKKSRPKPTSLYPQECVSGKKPGKLARRVRKLLVYLKVWDQMPGVEDGTIRDNRLHALVNEIDSACDEEIKKDRTDLKAPSWAPALLSRLEKASGIKLASRQQGSPSAGEFRILFAVLAARRLSQTQSWTRLNEMTRHEAQSDLDSAKSEIDRLDPKGKARGLLERWEDRRRQESGTRGEYRITRAAISALDDVLEAWATSTGPEERIGLLPEVQSRAEKFGDASFFEWLARTDNECLWKHASTGAISGEIITNWVKKREAEAAISLVKVPRYCHPDPFLHPVWCEFGNSKPDVRYFLRNELGQTNKRRKNSQHSEDLRNVELLLVNDRSGTVGMERLRWASDRLWKDLGVAATQSSDALARNDRLSRAALGLSTGSYRPIYPFTGQAKKWNARLQVDRNALEELRGLWDNRTRKWTDEGRRAHQVRWFLSFSPDLKASAGPWHRFVENNRDILNDLSTRPYKDKKTDELRVPLPWGKLNRKENRKGRAQLVLCRLPGLRVLSVDLGHRHAAACAVWETLSTAQINQLCYQHHQPPPGPSSLYHVYETSIPDTDGCTGEVRKLKRLKPKQFIYRRIGPDRVNGREHPAPWARLVRQFVIPLQGEKDEPRWPTEEEKRLAHTLRLTLELPESKVERPVRFDELMSGIIDMLERGIDRHKKASRVAYNLTAREIVEPGGKLVPVDGTDRYEVISSALKDWYSLASSPGLYSNFAREIWNAKCAGLKGGRPVPAETAADEPEKVSFSDLAKGLAE

SEQ ID NO: 61649 - protein, 1620 aa, Unknown
  Microbial Source - Accession No. GA0212093_1001507
MAPSRAKNSWSSKKANPSKPAARSSHTAKPRWPYWKSQAWKTNTPSAKWSRKKKARNSPRKCTSNRPLRRELIILESAVKIAQRWRLCSRNQECVICQRDKCLVVKENMSKNNDCMKCAALMLQKAREELACLITESERTTMSQQVKPPVTQRAYTLRLRGIDPSDTSWRKALWQTHEGVNKGAKAFGDWLLTLRGGLDHTLADTKVKGGKGKPDRDPTDEERKARRILLALSWLSVESKLGAPVGFIIASGTEAAEDRNRKVVAALEEILKSRNVATNEIDQWKNDCSASLSAAIRDDAVWVNRSKAFDEAVKSIGSSLTREEAWDMLERFFGSRDAYLAPAKGSEDESSETEQEDKAKDLVQKAGQWLSSRFGTGKGADFCRMANVYGKIAAWADNAQADTTGNDAINNLAAALNEYSPEPNDLKGVLGLISGPGYKSATRNLLNQLAAKATVTQQDFVSLKDKASNDAQKCKQNTGSKGPRPYSDAILKNVESVCGFTYLQDGGPARHSEFAVILDHAARRVSLAHTWIKRAEAERRKFEEDAKKIDQVPKAAKDWLDSFCLERSGASGALEPYRIRRRAVDGWKEVVAAWSKADCKTAEDRIAAARALQDDPEIDKFGDIQLFEALAEDDAVCVWHKDGDAAKPPDPQPLIDYALAAEAEFKKRHFKVPAYRHPDALLHPVFCDFGNSRWDICFDVHKNVQTPFPRALSLTLWTGSGMVSVPLCWQSKRLARDLALGQNAQNDGSSEVTRADRLGRAASNVTKSDEVKISGLFEQEDWNGRLQAPRQQLEAIAAVRDNLSLSDQERERRMSGMIDRIRWLVTFSAKLQPQGPWCEFAEKIQIGINPQYWPHADTNKDRKGHARLILSRLPGLRVLSVDLGHRYAAACAVWEAVNAEQINVACRAAGHREPKASDLYLHLKRKTTKQKKGDQVEFKETTIYRRIGADTLPDGTPHPAPWARLDRQFLIKLQGEEEGVRAASNEEIWAVHRLEVELGRTAPLIDRLVKAGWGQSGKQKTRLDALRNLGWAPANEVQGSDEMDEGEVHKPSLSVDELMSSAVRTMRLALKRHGDRARIAFAMTAAYKPMPGDRKYYFTEAKDASANEDATARNGKHIEFIQDALLLWYGLTSSRGWRDDAARQLWDDHIAKLSVYKAPEEIGEDASGVERKTKQKENREKLHDVAKALAQDVNLRKVLHNAWKKRWEKDDERWKKQLRWFKDWVFPRGKHASDPAIRKVGGLSLPRLATLIEFRRKVQVGFFTRLQPDGTRAETKEQFGQSALDTLEHLREQRVKQLASRIVEAALGIGRVRRPLGGKDPKRPDVRVDEPCHAIVIEDLTHYRPEETRTRRENRQLMTWSSSKVKDYLSEACQLHGLHLREVSASYTSRQDSRTGSPGIRCQDVPVKEFMRSPFWRKQVAQAEKKGDAHERFLCELNAMWKDKTVADWEKAGAVRVPLKGGEVFVSADRISPSAKGLQADLNAAANIGLRALTDPDWPGKWWYVPCEPASFRPAKDKVDGSAVVNPGQPLRQSAQAQSGDAAKDKKKRGNKGAGQSKEVVNLWRDISSSPLECIECGEWKEYAAYQNEVQYRVIRILEEQIKGRDRQPHEGSREDDIPF

SEQ ID NO: 61650 - protein, 377 aa, Unknown
  Microbial Source - Accession No. GA0212120_1000874
MAEGTEEVKLTVKAVILARDAGVKVLREEYNTYRKVLLSRVKEAVRTVVKDPELRVYAQQKWMVDKKLTEYLKNLPMHPMPFHRQSVWIERKDQGFYIHFKVKREGGEAVCYLLVPEKYRDLIAKACGKDNPMLGEVELIEDRKYGRFNVHLTLRLPKPEPYEPKGWLGVDVGWNKLATSILATCNPHLKFSNPTFHGKEFKTSIIQLRHMLKEAQRKGEAVRKWDSRLKNTIKYAVGAVAKEIVEKAKRLKAGVAMERLTFKSTSKGYLVPRYKLMIAVKTLCEREGVPFKLVPAQYTSVTCPKCGYRDERNRSNEWFKCLKCGYQTDADLAGAMNIALRAFDRRPDGGRNAVGYTPTAKSLLDYTSGRLGQPSSP

SEQ ID NO: 61651 - protein, 426 aa, Unknown
  Microbial Source - Accession No. GA0212125_1004414
MRRTIPILLPNDSDLVATIKLFTQIANEVSEMAFKLDKVKRWTLRRQFYSLLRQKYPTVNSRVLEYVLRVVTGCYTAKKRRKMKSKEPVRFKQEFALFDKRLFSFNGDCVTIWTIAGRKEFPFKLPPVSRFMELWERKEDIDSMVLKVRDGRVVAHVCLTIPDPPLRQFTYMVGVDLGAEYPLIAVRSDGVIFCPDYSVFHQKRKLFMQRRRELQKKLAEKRKYGENARSVVRRLKALSHKQRRFTKQFVRWVVKRFVDWAKDALIVMEKLRLPQGRKKKRAKALNRTLSLMPYGMVRKTIEEICEEQGLQVIFVPPAGTSQTCPACGQKGERPKRDLFVCPHCGYSEHADIVGARNVLRRGFEMLLRDGAEAGDKPAGLCQPCSSLPADEAGGGNPTVVPERVKGLQSTSKAKSATEGRLQPSLF

SEQ ID NO: 61652 - protein, 285 aa, Unknown
  Microbial Source - Accession No. GA 0212125_1006348
LHVPAKYHDLIEKACGKDNPVLGQVELVEDKKYGWVNCHITLRLPKPEPYEPLGWVGVDIGWNKLATSIACTCNPHIRFFNPTFHGKEFKTRIIQLRHLLKEYARKGKAWKKWDYRLKHTIKYAVGVVAKEIVTKAKKLKAGVAMESLTFKSTTKGYIVPRHKLMVAVKTLCEREGIPFKLVPAQYTSITCPKCGHINSKNRDGEWFKCLKCEYQTDADLVGAMNIALRALDSCPNGGQIDVGHAPRLKPMGLYAPEGGDVATPLRGMNDDLYKATRKTEKIEER

SEQ ID NO: 61653 - protein, 486 aa, Hydrogenivirga sp.
MNKVLKLTAKREKVKFKLLLLETGREEEVKFYELREALERFVRGVRVAYLKTLPDSLEGLEEKGRPNTRAVNSNELSKRFPPECAKVKLGSLELELGKDNIASSIRYTIEKDIRENLKREFKTIAIKSVPIIARVHTTKSHPYEKAFGEVFRIFEISEPDEKNRVSVRVGVKFFKQVEVEGKKATPVLVVEAVMRLKGRDYATANSYYNILKRIKEGEYKVAYAGLSYREGSGISLLLSYNLPDISEDDKRENILGIDLGQACPVYWSLITPELEKKKLTNGRHPRGQIEYPVNLEGAIRKLWRAKRNLLSSLRRIEEQTSLLSEGNRDLKGRLLRRKREVERSLKGMRRKEKNLMKKMDEFLANEVIRVALRERCRKIRMERLDGVDKTELYFPKWNYGQLQNLIEQRASLYGIEVERVNPRKTSQRCPSCGYVGQRREEVRPTRDLFRCPECGEESFADFVGAFNVGIGGWEAFKPKEALSSSS

SEQ ID NO: 61654 - protein, 376 aa, Rhodothermus marinus
MRTTFKYRLYRSKRDKHLIEQIEVAASIWNHSVALTRRYYRIYGKYPGANRLMKHIARLRRRNPYWQKLGSQAVQDVIQRLDRAYWRFFSDPKAGRPRFKKRERYSSFTLKQAGWKYPGGNRIRIGKHNYKFVLSRPIQGEIKTVTIKRDRVGRLWICFSVVTEEQPKPPAPHEAVMRPVGLDFGLKCFLTLSDGTKIQSPEFFRRGLQEVRKAHRALSRKQRGSNNYRKARVRLAKVYDRISNQRRDWFFKTAHALCERYDFIALEDLNIEGMKRRWGRKVSDLGFGEFVSILEHVARKRGVRVAKVARFFPSSRRCSCCGWVKENLSLADREWTCERCGTVHDRDENAAINICREGASSLGVGDVRPPEAAVAV

SEQ ID NO: 61655 - protein, 461 aa, Microcystis sp.
  misc_feature (35)..(37): Xaa can be any naturally occurring amino acid
  MISC_FEATURE (38)..(247): X = any amino acid
MMKLVQKHLIKFNHKNYSVIDKLGFLSKNLYNCAXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXKVLEVRIIPKLGAYCLEIVYEQPSSSSQEGERYAFIDLGLNNLAAVTSNIPEFQPTLVCGKALKSCNQKYNKTLAKLKSELPSLQKTSKRIQGLTLKRNCQVDYYLHTASKYIIDKLLAHQINLLVIGHNQGWKQNINIGDRNNQSFVNIPHSRLIEQLTYKANLVGIEVKTTNESYTSKCSFLDLESIQKQKSYLGKRIKRGLFRSSSGYFYGADINGSLNIGRKVVGEAAFSGNPIERFVVNPVRVKAYKANSRCNICVQN

SEQ ID NO: 61656 - protein, 1271 aa, Leptospira sp.
MKNLANFTNLYSLQKTLRFELKPIGKTLDWIIKKDLLKQDEILAEDYKIVKKIIDRYHKDFIDLAFESAYLQKKSSDSFTAIMEASIQSYSELYFIKEKSDRDKKAMEEISGIMRKEIVECFTGKYSEVVKKKFGNLFKKELIKEDLLNFCEPDELPIIQKFADFTTYFTGFHENRENMYSNEEKATAIANRLIRENLPRYLDNLRIIRSIQGRYKDFGWKDLESNLKRIDKNLQYSDFLTENGFVYTFSQKGIDRYNLILGGQSVESGEKIQGLNELINLYRQKNQLDRRQLPNLKELYKQILSDRTRHSFVPEKFSSDKALLRSLLDFHKEVIQNKNLFEEKQVSLLQAIRETLTDLKSFDLDRIYLTNDTSLTQISNFVFGDWSKVKTILAIYFDENIANPKDRQRQSNSYLKAKENWLKKNYYSIHELNEAISVYGKHSDEELPNTKIEDYFSGLQTKDETKKPIDVLDAIVSKYADLESLLTKEYPEDKNLKSDKGSIEKIKNYLDSIKLLQNFLKPLKPKKVQDEKDLGFYNDLELYLESLESANSLYNKVRNYLTGKEYSDEKIKLNFKNSTLLDGWDENKETSNLSVIFRDTNNYYLGILDKQNNRIFESIPEIQSGEETIQKMVYKLLPGANNMLPKVFFSEKGLLKFNPSDEITSLYSEGRFKKGDKFSINSLHTLIDFYKKSLAVHEDWSVFNFKFDETSHYEDISQFYRQVESQGYKITFKPISKKYIDTLVEDGKLYLFQIYNKDFSQNKKGGGKPNLHTIYFKSLFEKENLKDVIVKLNGQAEVFFRKKSIHYDENITRYGHHSELLKGRFSYPILKDKRFTEDKFQFHFPITLNFKSGEIKQFNARVNSYLKHNKDVKIIGIDRGERHLLYLSLIDQDGKILRQESLNLIKNDQNFKAINYQEKLHKKEIERDQARKSWGSIENIKELKEGYLSQVVHTISKLMVEHNAIVVLEDLNFGFKRGRQKVERQVYQKFEKMLIEKLNFLVFKDKEMDEPGGILKAYQLTDNFVSFEKMGKQTGFVFYVPAWNTSKIDPKTGFVNFLHLNYENVNQAKELIGKFDQIRYNQDRDWFEFQVTTDQFFTKENAPDTRTWIICSTPTKRFYSKRTVNGSVSTIEIDVNQKLKELFNDCNYQDGEDLVDRILEKDSKDFFSKLIAYLRILTSLRQNNGEQGFEERDFILSPVVGSDGKFFNSLDASSQEPKDADANGAYHIALKGLMNLHVINETDDESLGKPSWKISNKDWLNFVWQRPSLKA

SEQ ID NO: 61657 - protein, 424 aa, Parageobacillus thermoglucosidasius
MKYTKVMRYQIIKPLNAEWDELGMVLRDIQKETRAALNKTIQLCWEYQGFSADYKQIHGQYPKLKDVLGYTSMHGYAYDRLKNEFSKIASSNLSQTIKRAVDKWNSDLKEILRGDRSIPNFRKDCPIDIVKQSTKIQKCNDGYVLSLGLINREYKNELGRKNGVFDVLIKANDKTQQTILERIINGDYTYTASQIINHKNKWFINLTYQFETKETALDPNNVMGVDLGIVYPVYIAFNNSLHRYHIKGGEIERFRRQVEKRKRELLNQGKYCGDGRKGHGYATRTKSIESISDKIARFRDTCNHKYSRFIVDMALKHKCGIIQMEDLTGISKESTFLKNWTYYDLQQKIEYKAREAGIQVIKIEPQYTSQRCSKCGYIDKENRQEQATFKCIECGFETNADYNAARNIAIPNIDKIIRKTLKMQ

SEQ ID NO: 61658 - protein, 464 aa, Synechococcus sp
LSGATTSSLQVRIAAQQPAGTADAPGKNVRAKSALNKAILDQGWYEFRCMLEYKLAWKGGRLIVVPPQNTSRTCPCCGHVSSDNRQTQAWFECVACGYENNAFRGSGPEAFRGSGPEAFLVGAINILARGIQLLRDEGQDTTDAAVGMRVGEPPVSARMACGSNCTGGRKQEPAETTAQGAIHAQRGRNLRPSGRGGCQHSLPSGSAQVRIKKQRSHPQAHFCLPVNPVRTLSATKAAFFSAYPRPINAVYRRVVEELLVELHLTTVNSTFVYDPFFALGLVTLYDGLMEAYHPPEQREAIFNALCKALHLKPEVLRKNARDLLELMGSGDPRQRLDLLCLKPEAEDVGGLKAILERMTQPPYAYSRVLAVGLYTAYEVVAKSLYEEPEERTRRFLENVVSKLPFSTERVRKDLELYRSSLDRMKQARAVVEEMVKAARRQQERRQSAASLPETSLGDPSKPGS

SEQ ID NO: 61659 - protein, 543 aa, Sulfurihydrogenibium azorense
MVNKNLKITSGRDNVEFYLIVDGEEIPLKKQDIRNLITEFLKDVRLAYIKFLPNIELIQTGKYFTVNINSKRLTNENLSNSLTKLIPKNYIELEINGSKVKLDYKKDYVATSILYSVAKDITGNLKEGKTVVIKNLQYLARIKPDKNTPYDKAFSQVIKEFEIVENGKTVECVITFSAFKNASIKVKFKMNLRKKNFAVNNSYYQILNRIKNQEYKVAYIGIGYREKKGAFLLISYKFEKQPETSQEQEKVMGVDLGQVYLIYYSITNSHSRGDISLSYSWKDKIIGIWNRKKHLQKSLMEIRNLKKQGINDESIEKRYEKIVKELNSVREYEKNFMETLNKQIATKLIDIAVKEKVKTIVLEDLSLSNEEKNSLAFPKWNYYQLQSFIENKAQENGIQVKKINPAYTSQRCPSCGFIAFYKEMVRPKREKFTCPVCGFSSNADYVASLNIAEENIEEKIKARLISDIEKIEKVDKNNKVFTLFAIRNRIVKDLLKEFFNTNNGSSKKLLKRLEISNKEAYNTLIRDLKQFKVEYLDKRISNV

SEQ ID NO: 61660 - protein, 312 aa, Microcystis panniformis
MTELHHALKMSPDYQALPAKVSQLVLKQVEKTFKSYQKAKEQYKKSPDKFTGEPKLPRYKDKEKGRNVLTYNYQAISKKALKQGLIKLSGTNLEFKTNLKKVLEVRIIPKLGAYCLEIVYEQPSSSSQEGERYAFIDLGLNNLAAVTSNIPEFQPTLVCGKALKSCNQKYNKTLAKLKSELPSLQKTSKRIQGLTLKRNCQVDYYLHTASKYIIDKLLAHQINLLVIGHNQGWKQNLNIGDRNNQSFVNIPHSRFIEQLTYKANLVGIEVKTTNESYTSKCSFLDLESIQKQKSYLGKRIKRGLFRSSSGYF

SEQ ID NO: 61661 - protein, 377 aa, Rhodothermaceae bacterium
MEARRTYKYRLYRSKRDKHLVRQIEIASEIWNWGVALTRRYYSIYGKHLGYYRLKRQLAKRKKRDMGRWYGLNSQAGQNVIERLDKSYQRFFSDPKAGRPGFKKRTKYPSFTLTQTGWKLPEGQHSNRLRIGKHNFKFVLSRPIEGEVKTVTIKRDRSGDLWVCFSVAQDARPSMPQTGSAVGVDFGLKDFLVLSDGQTVESPQHLRASLKEMARLQRDLSRKKKGSNNREKARRRVAKLHRRIADQRRDFHFKAARAVLERHDFIAIEDLNLDGMKRLWGRKVSDLGFYSFVEILEHLATRNGKRVVKVDRYFASSKTCHDCGWVNKDLTLADREWVCKGCGCVQQRDLNAAKNIRDRALSHVVGDVRPAGRAVAA

SEQ ID NO: 61662 - protein, 548 aa, Elizabethkingia sp.
IFYFQDLFFKINWKQGFVKEGLNKEEANTAILLKKDDLFYLGIMDKNHNKIFRNIPKIKSEKTFSKINYKLLPGASKMLPKVFFSAKSIGYYEPNKEIINIRNHSSHTKGGKPQDGFEKIDFNVQDCRKMIDFFKSSIEKHPEWKNFGFQFSDTQSYNTIDEFYKEIEAQGYNISYSDIPESYINQLVDEGKLYLFQIYNKDFSPYSKGTPNMHTLYWKALFTEENLSNVIYKLNGQAEIFYREKSIDDENIIVHKAKEAIGNKNPNAIKKQSTFEYDLVKDKRYTVDKFQFHVPISLNFKANGSNFINQEVLSFLKNNPDVNIIGIDRGERHLIYLSLINQKGEILSQESFNTIKDEHHEIETPYHQLLSIKEKERDEARKNWGTIENIKELKEGYLSQVVHKIAKMMVDHNTIILLEDLNFGFKRGRFKVEKQVYQKLEKMLIDKLNYLVFKDKKNPFEPGGLYNALQLTNKFTSFKDLGKQSGFLFYVPAWNTSKIDPTTGFVNLFNTKYESIEKAKKFFNNFQSILFNKKENHFEFTFNYNDFT

SEQ ID NO: 61663 - protein, 1442 aa, Syntrophaceae bacterium
  misc_feature (816)..(824): Xaa can be any naturally occurring amino acid
MPRQDKPPVTQRAYTLRLRGADPNDKSWRDALWWTHEAVNKGAKAFGDWLLTLRGGLDHALVTTKVKVGKGKPDRDPTDEERKARRILLALSWLSVESKLGAPAGFIIASGQEAAAARNGKVIAALEEILTSRNVAKNEIGDWKNDCSASLSAAIRDDAVWVNRSKAFDEAVKSVGCSLTREEAWDMLERFFGSREAYLAPVKGSEDESSETEQEEKAKDLVQKAGQWLSSRFGTGKGADFSRMAKVYQKIADWAAACSPNKTGTDAIACLAASLSEFNPASNDLQGVLDLISGPGYKSATRNLLTQIAAKATVTQEDLTKLNETAAADKGKCETNTGSKGQRPYSDAILKNVESVCGFTYLQDGGPARHSEYAVILDHAARRVSLSHTWIKRAEAERRKFEEDAKKIDQVPNAAKDWLDQFCLERSGVSGALEPYRIRRRAVDGWKEVVAAWSKSSCGTSADRIAAARALQDDPEIDKFGDIQLFEALAEDDAVCVWHKDGDAAKPPDPQPLIDYALAAEAEFKKRHFKVPAYRHPDSLLHPIFCDFGNSRWDICFDVHKNMQTPFPRALCLTLWTGSEMKPVPLCWQSKRLARDLALGENAQNAETREVTRADRLGHAAANVPKNLPVKISGLFEQADWNGRLQVPRQQLEAIATRIAKHGFDDKAKEMRDSLQWLVTFSAKLQPQGPWCGFAATNHLKIDPQYWPHADANKARKGQARLILCRLPGLRVLSVDLGHRYAAACAVWEALTAEQVKVACQAARHEEPKESDLYLHLKRKMTKQKKGNQVEVEKTTIYRRIGADTLPDGKAHPAPXXXXXXXXXASGWGAAEKQKARLDALEKLGWKPVEKAEAQEDADAEEEEMSFRPSLSIDELMLSAVRTMRLALKRHGDYARIAYAMTAAYKPMPGDRKYYFTEAKELSANDDEATRANKHIEFIQDALLLWYGLTSSRGWRDHVAKQLWDSHITRLSGYQAPEEVGEEATSVERKNKQKENRERLHAVAMALVENEDLRETLHDAWKTRWEKDDGQWKTHLRRFKDWILPRGKAANDPTIRKVGGLSLARLAVLTEFRRKVQVGFFTRLRPDGTRIEIREQFGQSALAALEQLREQRVKQLASRIAEAALGIGRMMRPKGGKDPKRPDVRVDEPCHAIVIEDLTHYRPEETRTRRENRQLMTWSSSKVKTYLAEACQLHGLHLREVSASYTSRQDSRTGAPGIRCQDVLLKEFMRSPFWRKQVEQAEAKQADNKGDSRERFLCALDAKWKGKTVADWEKAGVIRLPARGGEIFVSADPASPAAKGLQADLNAAANIGLRALTDPDWPGKWWYVPCEPGSCRPIKDKVDGSTAVKPDQALRQPAQAQSGDARDKKKRGKKGAGKSKEVVNFWHDISSSPLECIESGEWREYIAYQNDVQSRVIRVLEKQIKGLDKQPHDGSGDDDIPF

SEQ ID NO: 61664 - protein, 812 aa, Unknown
  TPA ASM bacteria DHGN01000237.1_o
LVGGNDPFEEQLRRFQRRSTMPRQDKPPVTQRAYTLRLRGADPNDKSWRDALWWTHEAVNKGAKAFGDWLLTLRGGLDHALVTTKVKVGKGKPDRDPTDEERKARRILLALSWLSVESKLGAPAGFIIASGQEAAAARNGKVIAALEEILTSRNVAKNEIGDWKNDCSASLSAAIRDDAVWVNRSKAFDEAVKSVGCSLTREEAWDMLERFFGSREAYLAPVKGSEDESSETEQEEKAKDLVQKAGQWLSSRFGTGKGADFSRMAKVYQKIADWAAACSPNKTGTDAIACLAASLSEFNPASNDLQGVLDLISGPGYKSATRNLLTQIAAKATVTQEDLTKLNETAAADKGKCETNTGSKGQRPYSDAILKNVESVCGFTYLQDGGPARHSEYAVILDHAARRVSLSHTWIKRAEAERRKFEEDAKKIDQVPNAAKDWLDQFCLERSGVSGALEPYRIRRRAVDGWKEVVAAWSKSSCGTSADRIAAARALQDDPEIDKFGDIQLFEALAEDDAVCVWHKDGDAAKPPDPQPLIDYALAAEAEFKKRHFKVPAYRHPDSLLHPIFCDFGNSRWDICFDVHKNMQTPFPRALCLTLWTGSEMKPVPLCWQSKRLARDLALGENAQNAETREVTRADRLGHAAANVPKNLPVKISGLFEQADWNGRLQVPRQQLEAIATRIAKHGFDDKAKEMRDSLQWLVTFSAKLQPQGPWCGFAATNHLKIDPQYWPHADANKARKGQARLILCRLPGLRVLSVDLGHRYAAACAVWEALTAEQVKVACQAARHEEPKESDLYLHLKRKMTKQKKGNQVEV

SEQ ID NO: 61665 - protein, 1465 aa, Thermomonas hydrothermalis
MSEKTTQRAYTLRLNRASGECAVCQNNSCDCWHDALWATHKAVNRGAKAFGDWLLTLRGGLCHTLVEMEVPAKGNNPPQRPTDQERRDRRVLLALSWLSVEDEHGAPKEFIVATGRDSADDRAKKVEEKLREILEKRDFQEHEIDAWLQDCGPSLKAHIREDAVWVNRRALFDAAVERIKTLTWEEAWDFLEPFFGTQYFAGIGDGKDKDDAEGPARQGEKAKDLVQKAGQWLSARFGIGTGADFMSMAEAYEKIAKWASQAQNGDNGKATIEKLACALRPSEPPTLDTVLKCISGPGHKSATREYLKTLDKKSTVTQEDLNQLRKLADEDARNCRKKVGKKGKKPWADEVLKDVENSCELTYLQDNSPARHREFSVMLDHAARRVSMAHSWIKKAEQRRRQFESDAQKLKNLQERAPSAVEWLDRFCESRSMTTGANTGSGYRIRKRAIEGWSYVVQAWAEASCDTEDKRIAAARKVQADPEIEKFGDIQLFEALAADEAICVWRDQEGTQNPSILIDYVTGKTAEHNQKRFKVPAYRHPDELRHPVFCDFGNSRWSIQFAIHKEIRDRDKGAKQDTRQLQNRHGLKMRLWNGRSMTDVNLHWSSKRLTADLALDQNPNPNPTEVTRADRLGRAASSAFDHVKIKNVFNEKEWNGRLQAPRAELDRIAKLEEQGKTEQAEKLRKRLRWYVSFSPCLSPSGPFIVYAGQHNIQPKRSGQYAPHAQANKGRARLAQLILSRLPDLRILSVDLGHRFAAACAVWETLSSDAFRREIQGLNVLAGGSGEGDLFLHVEMTGDDGKRRTVVYRRIGPDQLLDNTPHPAPWARLDRQFLIKLQGEDEGVREASNEELWTVHKLEVEVGRTVPLIDRMVRSGFGKTEKQKERLKKLRELGWISAMPNEPSAETDEKEGEIRSISRSVDELMSSALGTLRLALKRHGNRARIAFAMTADYKPMPGGQKYYFHEAKEASKNDDETKRRDNQIEFLQDALSLWHDLFSSPDWEDNEAKKLWQNHIATLPNYQTPEEISAELKRVERNKKRKENRDKLRTAAKALAENDQLRQHLHDTWKERWESDDQQWKERLRSLKDWIFPRGKAEDNPSIRHVGGLSITRINTISGLYQILKAFKMRPEPDDLRKNIPQKGDDELENFNRRLLEARDRLREQRVKQLASRIIEAALGVGRIKIPKNGKLPKRPRTTVDTPCHAVVIESLKTYRPDDLRTRRENRQLMQWSSAKVRKYLKEGCELYGLHFLEVPANYTSRQCSRTGLPGIRCDDVPTGDFLKAPWWRRAINTAREKNGGDAKDRFLVDLYDHLNNLQSKGEALPATVRVPRQGGNLFIAGAQLDDTNKERRAIQADLNAAANIGLRALLDPDWRGRWWYVPCKDGTSEPALDRIEGSTAFNDVRSLPTGDNSSRRAPREIENLWRDPSGDSLESGTWSPTRAYWDTVQSRVIELLRRHAGLPTS

SEQ ID NO: 61666 - protein, 1000 aa, Unknown
  Microbial Source - Accession No. Ga0063162_1014580
  misc_feature (963)..(963): Xaa can be any naturally occurring amino acid
MSQNPAPPVTQRAYTLRLRRGPGKCPACQKDACDCWRDALWATHEAVNRGAKAFGDWLLTLRGGLCHTLADIDVPAKGKKPARNPTKQEQRDRRVLLALSWLSVEDERGAPNGDGLRIATGKEPADKRGEAVKAALRNILGNRGVNASEADSWVKDCEASLAASIRDDAVWVNRSAAFDAACNGQNLRQAREDARTLLWYLLTDDYLVLPKANKKESEDTGEDQEEGQDEESAVDEAAEAVAKSAKGAGQRTRHLFSHIFGRQSTQGFGKPPCQLDLRDYWQGHLKPLIEAAGIPLSDPNVTAKKGAAPSPTELHREMFSKAASRLAQIWTKQKQQEVARQLRAAADDELKELESDQTYSKALDLLEAYCRERGQITGSLEEYRINPRAVEGWERVVAAWEGIKSSDPTEAQQRRIDEVKRLQDESDDKKFGDNNLFVSLAEPEYEPVWQHKGQATPSVLKTFVKGWKARSDAARLKVAAFRHPDPYSHPVFCQFGVSRPWIKHGRLDPKGNAGTVQMLLWTGSKADKVQISAVSKRFDAEIGSASESTVIAARQVARRHRLAVAAVSTSGAGVNTIRVAHVFDQQEVRSRERAVEHGIEDENGDDESQNARKKGPIWNGTLQADRQALKAIGKLASSQKAPQAYRCLQWRLTVALELQSSGPWYDYVRNATDQSPFQRTVRKDEDKGKKRKKGTKYLFLDGWPFEEVNNPLKVNRVDTLLLADKRSARGREAKIVLSRLPGLRVLSVDLGHRYAAACAVWEALPNAAFKGEVAGLKVRAGGPGEDDLYLHVEKPGDDGKTKTVIYRRIGPDSLPDGQFHPAPWARLDRQFLIRLQGEDEEAREASNEEIWKVHQLEAELGRTVPLIDRMEKGTFGQTEKQKQRLEALRGLGWTPATTNVPPGAAGEEEGETRIVSRSVDELMFAAVRTMRLALRRHGDRARIAFAMTGDHKPLPGGRKYYFXMTCSRRGAGKMMRPRSSGSKASPPCRDARRRRRSRKI

SEQ ID NO: 61667 - protein, 428 aa, Unknown
  Microbial Source -  Accession No. Ga0065719_107896
  misc_feature (231)..(231): Xaa can be any naturally occurring amino acid
  misc_feature (265)..(265): Xaa can be any naturally occurring amino acid
  misc_feature (277)..(277): Xaa can be any naturally occurring amino acid
  misc_feature (287)..(287): Xaa can be any naturally occurring amino acid
  misc_feature (298)..(298): Xaa can be any naturally occurring amino acid
MKRTVPIKLPADDSLVKTIQLFTQIANEVSKQVWELKTPIRNFVTLYKHCYHNLRTKYPHVNSRFIGYILRIVAGRYSPKNFRKLKEAVVFKRDFALLDKRLFTIKDGHITLWTIDGRKEFPFVLPKVGRFLELWKRKEDVDSITLKVRNGEVIGFLCLTIPESEPKDAKHFVGIDIGASYPLIAVRDDGAIFCPDYSTFHKKRQHFFELRRQLQRKLTEKRLAKKDAKSXIRALRRLSGRQRNFTKQFLRWVVCRLFDWAGDAXIIMENLHLPQGXKVKNAKALNXTLSLLPAGIIXQAIVNKAAELGLQVIFVPPAGTSQTCPRCQNKGKRPNRDLFVCPYCGYEEHADIVGARNILRKGLERFSQSGAETGDKPVGLCQPHESLPADEAGGGNSTIVLQKRLQSTLKKLPATEGRLQPSLFSTEN

SEQ ID NO: 61668 - protein, 428 aa, Unknown
  Microbial Source -  Accession No. Ga0065719_116807
MRRTVHIYLPMDEDLVATIRLFTQIANELSKKVWEMKEPIRHPLALRKRYYHALRAQYPQVASRVLEYIIKIVAGCYSPKKFRKLDNAVEFKKDFALFDKRLFKIEGDQIVLWTINGCKRYPFVLPKVGRFQKMWACKEDVDSITLQIKKERIVGHVCLTVPAGKPREVKHIVGIDIGASYPLIAVRDDGAVFCPDYSTFHKKRQHFFELRRQLQRKLTEKRLAKKDAKSVIRALRRLSGRQRNFTKQFLRWVIRRLFDWAGDAVIVMEKLHLPQGKKVKNAKALNRTLSLLPAGIIKQAIVDKATELGLRVIFVPPAGTSQTCPRCQNKGKRPKRDLFVCPYCGYEEHADIVGARNILRRGLERFSQSGAETGDKPVGLCQSHESLPADEAGGGNPIIVPPKRLQSTSKKLSATEGRLQPSLFFAEN

SEQ ID NO: 61669 - protein, 1497 aa, Unknown
  Microbial Source -  Accession No.  Ga0067045_1002454
MPQQTNLPDTQRAYTLRLREADPNDLSWRTALWKTHEAVNKGAKAFGEWLLTLRGGLDHTLADTQIKQKDPSGRNPADEKRKARRILLALSWLSVESEIGAPADYIIASGKEAAENRNRKVIASLEEILKSRNLAENEIEDWKADCSASLSAAIREDAVWVNRSKAFDDAVKLAGCSLTREEVWDMLERFLGSRDAYLAPVKGSEDESSETEQKDEAKDLVQKAGQWLSSRFGTGKGADFSRMAAVYGRIAAWAGKNKSNGSVTVDDLVKELQQHFDTTESKATAGINWIFELSSYPGHSPNPVHELLQNGPKLGRDKLDNLEKKANTRAESCRSKIGSKGQRAYADAILKDVEAVCGFTYRIDENGNAVSVADYSRYDDDYKWGPARHFEFAVILDHAARRVSLAHTWIKRAEAERRRFEEDAQRIANVPPPVKEWLDEFCRKRSQESGALEDYRIRRRAVDGWKEVVAAWSKADCKNAEDRIAAARALQDDPEIDKFGDIQLFEALAEDDAVCVWHKDGDAAKTPDPQLLIDYVLAAEAEFKKRHFKVPAYRHPDSLLHPVFCDFGKSRWDICFDIHKNPQTPFPRALCLTLWTGSEMKPVPLCWQSKRLARDLAIGQDIESDEAVEVTRADRLGRAASNVTKSDAVKISKLFEQKDWNGRLQAPRQQLEAIARYVEKHGWDQKAEKMRDRIQWLVTFSAKLQRKGPWYDFIKNSFDKTAFIRIHKRGEKKGTEYISQDGWPHEEANESRQGLARLILSRLPGLRVLSVDLGHRYAAACAVWETLSSKDMKKACQAAEHEEPKESDLYLHLKKKVKKQKKGKEVEVEETTIYRRIGTDTLPDGTSHPAPWARLDRQFLIKLQGEEEGVREASNEEIWKVHQLEVELGRTMPIIDRLVKAGWGSTEKQQARLEQLKRLGWTPTVVPEAEAGEDADEYAIRWPSLSVDELMSSAVRTMRLALKRHGDRARIAHYIITDEKTKPGGIKEKLDENGRIDLLQDALVMWHDLFSSRGWRDNAARQLWDDHIAKLSGYRAPEEIGEESSGSERRNKQKENREKLYDVAKALAQDVTLREALHDSWKNRWENDDEQWKRQLRWFKDWVLPRGKHASDPTIRKVGGLSLTRLATLTEFRRRVQVGFFTRLKPDGIRVETKEQFGQSALDALEHLREQRVKQLASRIVEAALGIGSEGGKGWNKRKRPQERIEDPRFAPCHAVVIEDLTHYRPEETRTRRENRQLMTWSSSKVKKYLSEACQLHGLHLREVSASYTSRQDSRTGAPGIRCQDVPVNEFMRSSFWRKQVAQAEKKEAEGKGDARERFLCSLNAKWKDKTVKDWEKAGVIRIPLNGGEIFVSADANSPVAQGIHADLNAAANIGLRALTDPDWPGKWWYVPCDPNSFMPIKDKVEGSAAVKPDQALRQSAQTQNGDAATDKKKGGRKRAGKAKEIVNLWRDISSSPLESIEVGEWREYAAYQNEVQYRVIRVLEEQIKGRDQANTR

SEQ ID NO: 61670 - protein, 1469 aa, Unknown
  Microbial Source -  Accession No. Ga0067045_1004962
MPQQDKPPVTQRAYTLRLRGSDPSDTSWRKALWQTHEGVNKGAKAFGDWLLTLRGGLDHTLADTKVKGGKGKPDRDPTDEERKARRILLALSWLSVESKIGAPAVYIIASGKEAAEDRNGKVVAVLEEILRSRNVAENEIGEWKNDCSASLSAAIRDDAVWVNRSKAFDEAVKSVGCSLTREEAWDMLERFFGSRDAYLAPAKGSEDESSETEQEDKAKDLVQKAGQWLSSRFGTGKGADFCRMADVYGKIAAWADKAQAGMTGNDAINNLAAALNESTLASNDLQGVLGLISGPGYKSATRNLLNQLATKTTVTQQDLASLKDKATKDAQKCNQNTGSKGRRPYSDAILKNVEAVCGFTYLQDGGSARHSEFAVMLDHAARRVSLAHTWIKRAEAERRKFEEDATKINNVPSAAKNWLDEFCRKRSETSGALEPYRIRRRAVDGWKEVVAAWSKSSCSTSADRIAAARALQDDPEIDKFGDIQLFETLAEDDAVCVWHKDGDAAKAPDPQPLIDYALAAEAEFKKRHFKVPMYRHPDALLHPIFCDFGCSRWSIKFSLHEAKKNAEKKRKKKDDVQQPDSPRSLWMTLWTGKEMKLVPLRWQSKRLARDLALGQDARKDGASEVTRGDRLGRAASNVTKSDDVKISGLFEQADWNGRLQAPRQQLEAIARRVNNHGWDETAKKMRDRLQWLVTFSARLQPQGPWCEFAEKLQLRINPQYWPHADTNKDRKGHARLILSRLPGLRVLSVDLGHRYAAACAVWEAVNAEQVRGVCQIAGHEEPKASDLYLHLKRKTTKQKKGKEVEVEKTTIYRRIGADTLPDGTPHPAPWARLDRQFLIKLHGEDEGTREASNEEIWAVHQMETVLGRSVPLIDRLIAAGWGCTEKQKARLEELNKLGWTSVPKAESSGEQEENEEADVYKPSLAVDELMSSAVRTMRLALKRHGDLARIAHYLITDEKTKPGGTKEKLDENGRVDLLQDALVMWHDLFSSRGWRDEAARQLWDEHVAKLSGYKAPEEIGEESSGPERKKKQKENREKLYDVAKAMAQDVILRETLHDAWKKRWKDDDERWKKQLRWFKDWVLPRGKHASDPTIRKVGGLSLPRLATLTEFRRKVQVGFFTRLQPDGTRAETKEQFGQSALDALEHLREQRVKQLASRIAEAALGIGRMRRPMGGKDPKRPDVRVDEPCQAIVIEDLTHYRPEETRTRRENRQLMTWSSSKVKKYLAEACQLHGLHLREVSASYTSRQDSRTGAPGIRCQDVPVDEFMRSLFWRKQVKQAEAKQSENKGDASERFLCDLNAKWKDKTVADWEKAGVIRVPLRGGEVFVSADPNSPAAKGLQADLNAAANIGLRALTDPDWPGKWWYVPCDPASFKPTPDKVKGSAAINLDMPLKDASVVSGDATMKKAGKAKSQSKEVVNLWRDVSSREVSTTDVAWEVYSAYQNQVQTRVVNILRRSACPKDNREKQS

SEQ ID NO: 61671 - protein, 888 aa, Unknown
  Microbial Source -  Accession No. Ga0068669_10235961
MFNKKKGYRLHLERIIYSGGEITRSIKYLLASHSDSQKNKELLNNFSQDLYNDDLKIRGCLNLNDLVNNNQIYNLADFWIDSLRAGVIWQSSASSLIDFIKRLNHQETIGEKIFNNANERIKRFFNSEKFIKEIILSEPKRISSKKQAFYNSLFDILKDEFKKQEKNEKIIIDNKAEQLIKEIVDAFYSNDGVFLMEGEEKQNKFWQENFNIDKNMIKKEKEDILKDVGDITAFIHPPLIILKGDVSQLIDERKKYFSEKDLEEILGLSDNFNAFSHYFNKFFLLLYQDKQEKIFECYQKIFSFSQEDRKRIKDALDFLLEKSKLLGLPKIVNSWSDYRSVFGGKIKSWFSNYLNREDKAKKQEKKIKEGLEKVNKFLLDFIQKNQVDSDLQQEIKFYYDKLNQFINSYQNQEFFHQQELFLLFSDLLAEYREKLNRFYQKYLSDKEKEEKKVDEFPLFKDLFEKYEGPISFYGKTKLEDNKKIIDLTFKTIKVGLNLIRRLLIDLYNSSDFKNSDNNNQERDLRRIFEFLLNKIPATKTFREKYLSILKDNFDQQTYKEMTLKPSRYTFVENIYSRENRKLIELPSKNFEELLSKIIKDLTDFSLSFKNDDLFVDIYLLSDLVELAKTLISLVINYSNKSQFDSYKNELIDDTYQKAKKYLETFKISFFNSKKEANYFYQTRVLSELKGAVALFSKKYYQAKYNIQILKSNEIFPLFVKFSDLLKKEEINDINKLKLIFKKPYRYLIALKKIKFKKNQQQSSVIHLDKKNKDLVLISPQDEDFLFKLTSSFYQLQFLDRFVYPVKKWLNVDITLSEWSFILEKKYKINWDFNSGKPEFSEIDSRLYLNIPFKIKAINQQKILKPKELFLGIDVGEYGVGYALVNFKD

SEQ ID NO: 61672 - protein, 1335 aa, Unknown
  Microbial Source - Accession No.  Ga0068707_1002163
MKSLAQFQNLYALQKTLRFELKPEGHTRETFNRWLEEIEKEQASENENIVYQDLLRAKKYEKIKIILDEYHKDFIEQALAYANLTELEKYEELYRKSNRTSEEEEEFENTKESLRKQIANIFIKNPNKTVQERWKFLFSKKLIQNELIVWVKGNYELLSEKLKNEFPDESSIISTIEDFKYFTTYFRNYHENRKNLYSNEDKFSTIAHRLIHENLPKFIDNIAIYQKAKAVLNINEVEKELGLPEDTLDKIFSLDFFSKALTQKGIDQYNYFLGGKTENEVKKIKGLNEFINLYNQQQQDKNQRLPFLKVLYKLPLFERTSTSFRFEPIENDRDLIERIGKFYYNDLKQYRDDSQGDTTDILSGINTLLRHVHDYRDGLYVNGGITLTQISQKIFGSWSYINNALAYFYDTYIDASGVDHQGERKPKKQKQIQEKTKWLKQKQFPVILVEKALSEYKSIETNEDLKTRISDTTLCDFFKRCGNDDNGQDLFDRIEARLREKNEEGYSLEDLLKKEFTTERKLMQDKTKTLLIKNFLDVIQGDKDDITAGLLHFVKCLIPRTEISEKNELFYSGMEKYLNILSEVTPLYNKARNYLTQKPYSIEKVKLNFENSTLLDGWDENEESDNSCVLLRKRGYYYLGIMNKKHNMIFDRKIYPKATEGEAYYEKMIYKLLPGAYKMLPKVFFSEKNIDYFKPSEEILRIRNTASYSKNGQPQEGYQKASFSIEDCRKYIDFFKKCIANHWDWQKFNFNFSPTEYYQSIDEFYREIERQGYKIDFVKIPESYINQLIKENKLYLFKIYNKDFSEKKKSKGKDNLHTLYWKMLFDEKNLKDVVLKLNGEAEVFFRQKSILYNEEIWNKGHHYSELKDRFSYPIISNKRYAEDKFFLHVPITLNFKADGINNVNNMVNEFIKDNRDIHIIGIDRGERHLLYVSVINQKGDIVEQCSLNEIVTEYNGKIFKKNYHEELDNLEKERDRARKDWQTIANIKELKEGYLSHVIHKISKLILKYNAIVVMEDLNSGFKRGRQKVEKQVYQNFEKQLIEKLNYLVLKESNVDEPGGVLRAYQLANKFETFKKLGKQSGIIFYVPAAYTSAIDPVTGYIQYLYPLKQADSVEKARKFYSQFKRISYNPHKQWFEFSFDYNDFNIIYHGKSSWTICTTNTERYMWNRLLNNGHGGEELVYVTNELELLFGEYNIIYGDGKDIKQQITDVQDIDVDRTAKQFYKRINELLNLTLKLRHNNGKKGADEEDYILSPVEPYFDSRFESRKPSMQQTLPINADANGAFNIARKGLLLLERLNQLGVEEFEKTKKSNNKKTQWLPHELWVEYAQNHTRK

SEQ ID NO: 61673 - protein, 1231 aa, Unknown
  Microbial Source -  Accession No. Ga0068707_1009867
WVSTNFGTGEKSDADLILKKLNILVAADLIRFAKQSKVSFIKEMCNLLGIQGEDVDALRTGIGWKTGRKSKGRLAIDSLPEQVTSESIQRLQQKFEEEVSDKQRKTRDVPGWMPSFRQAIEKECGMPFRGDRDHIGEFAVMLDHAARRVSQAHSWIKRAEAERRRFEEDAKKMKVVPEKTKEWLDFFCSERSDTSGALEPYRIRKRAVDGWKEVVAAWSKADCLTTEDRIAAARALQDDPEISKFGDIQLFEALAEEDAMCVWHKDGDPANAPDPQPLIYYALASEADFKKRQFKVPAYRHPDALKHPVFCDFGKSRWAIDYEIHRNAKTPSPRALTLTLWTGKEMKPVSLRWQSKRLAHDLNIKSDGRGEGASLVTRADRMGRAASGVSKDDEVEIAGLFETKEWNGRLQAPRCQLEDIARHVDKHGWDSKASVMLNAVQWLVTFSARLQPQEPWREYAKNNENVNLNLDKKNRQPHTDENKNRKGRHAKLVLSRLPGLRVLSVDLGHRYAAACAVWETLSIESFRKEIRGRTIIRGGKDAEALYCHTEHEENGNKHVTIYRRIGADKLPDGATHPAPWARLDRQFLIKLQGEGEEAREASNEEIWAVHRMESELGRAVPLIDRLVAAGWGRTEKQAERLEALKRLGWEPPLATAPVVEDASGEDADAYRPSLAVDELMSSAVRTLRLALKRHGDRARIAYAMTATYKSMPGDRKYYFTKAEELSSNDDQATREEKHIEFILDALVLWQSLISSRGWRDEAAKLLWDKHIAKLPVYEAPEELGEDITSVERKKKRDNNREKLYGVAKALVQDRPLRNELHDAWNKRWEQDDARWREWLRWSRDWILPRGRQAGDHSIRKVGGLSLNRLATLTEFRRKVQVGYYTRLRPDGTRKEIGEAFGQKVLDDLEQMREQRVKQLASRIVEAALGIGSEDRAHWEGGKRPRQRIDDRRFAPCHAVVIENLTHYRPEETRTRRENRQLMTWSSSKIKKYLKEACQLHGLHLCEVTASYTSRQDSRTGAPGIRCQDVAVREFMLSPFWRKQVKRAEAKQAENKGDSRERFLCELNAKWKNKTEVEWRNAGVVRIPLRGGAVFVSADRRSPASKGIQADLNAAANIGLRALIDPDWPGKWWYVPCFSSSFIPTDESTKGSEAITGKPLKERPTDDTGKMATRKRSGRSSRSSGGVVNLWRDVSSLPVSADKGPWEEYQPYWNKVQERVVRILHDNMVDSG

SEQ ID NO: 61674 - protein, 850 aa, Unknown
  Microbial Source -  Accession No. Ga0068707_1024093
WSDYRSVFGGKIKSWFSNYLNREDKAKKQEKKIKEGLDKVNKFLLNFIQKNQIDPDLQQEIKFYYDKLNQFINSYQNQEFFHQQELFLLFSDLLAEYREKLNRFYQKYLSDKEKEEKKVDEFPLFKDLFEKYEGPISFYGKTKLEDNKKIIDLTFKTIKVGLNLIRRLLLDLYNSFDFKNSDNNNQERDLRRIFELLLNKIPATKTFREKYLSILKDNFDQKTYKDITLKPSQYTFEENIYSRENRKLIELPSKNFEELLSKIIKDLTDFSLSFKNDDLFADIYLLSDLVELAKTLISLLINYSNKSQFDSYKNELIDDTYQKAKKYLETFKISFFNSKKEANYFYQTRVLSELKGAVALFSKKYYQAKYNIQILKSNEIFPLFVKFSDLLKKEEINDINKLKLIFKKPYRYLIALKKIKFKKNQQQSSVIHLDKKNKDLVLISPQDEDFLFKLTSSFYQLQFLDRFVYPVKKWLDVDITLSEWSFILEKKYKINWDFNNGKPEFSEIDSRLYLNIPFKIKAINQQKILKPKELFLGIDVGEYGVGYALVNFKDEEIKIIKSGFIRSKNIASIRDKYRLLQDRSKKGVYFSSTNVVQEVRENAIGEIRNQIHDILIKNNADLIYEYNISNFETGSGRITKIYDSIKKSDVYAENEADKSVIQHVWGIKKSIASHLSAYGSSYTCSNCGRSIFSFSENDICSSKVIKRDGNIITIQTPKGEVFAYSKDKKFNVGYSFSQEKSKEEMKNLFMKIVKAYARPPLLKSEVFLAQKKLDKEFLEKFKKERGNSAIFVCPFVDCQSLADADIQAAFIMALRGYLKKKKGKDINYLEESLNYLQNFKGKINFSNLLN

SEQ ID NO: 61675 - protein, 377 aa, Unknown
  Microbial Source -  Accession No. Ga0071330_1110381
VRKTIRIQLPKDADLLATMRLFREIANEVSKMAWEIREQLKGKFDLRRQCYPLLRSRYTHVNSRVLEYIIRVVNGCYSKKKRRKLSEPVVFRRNFALFDKRLFKFGDGNITLWTIAGRKNFPFTFAPVKRFKEYWEKKVDVDSITLKESDRCIVGFVCLTVPEPPFKVSHHFVGIDIGAECPLVAVRDDGAIFFPDFSKFHKKRKQFLQRRRYLQSKLAAQRLLGKDAHNTIRELKRLSGKQRRFTKQFLNWVINRLFNWMGDAVIVMERLKLPQGKKVKNAKALNRTLSLMPSGIIKQVILEKAKERGLRVIFVNPAGTSQTCPKCGGKGERVSRDLFRCHVCGFSCHADIVGAKNILKRGFERVVKQGAETGDEP

SEQ ID NO: 61676 - protein, 270 aa, Unknown
  Microbial Source -  Accession No. a0072682_101461
LKNLPLHPMPFHNQSVWIENKNGKFWIHFKTKQGETVCYLQVPAKYRSLIEKASGEKNPILGQVEIVEDQKYGWINCHITLRLPKPEPYEPRGWIGVDVGWNKLATSILATCNPHLRFSNPSIHGKDFKTRIIQLKYLLKQYARKGKAWKKWDYRLKHTIKYAVGSVAKEIVSKAKNLKAGVAMEKLTFKSTTKGYLVPRYKLMIAVKTLCERKGIPFMVVPAQNTSVTCPYCGYKDKKNRNGERFKCLNCGYQADADIAAAMNIAKRAL

SEQ ID NO: 61677 - protein, 456 aa, Unknown
  Microbial Source - Accession No.  Ga0073928_10004924
MKIIRTYKFRLRPTAAQAARMSSWCAAVRHVYNAALQQREWYGRAVGTDPHGRDSRFNSFRQGRELKDIRAAFKWIEDAPADILMAAVRDLDKAFDAFFASRARYPTPRRADQNNSFALPVFVQGKARPKGYFVNVVFGQDSVRLPKFGRVRWVRHRKIRGRPKTANVVREGDRWFICISSEIEIADRSPAAAAVGIDFGVAIPLATSDGETLSLARTAPRIAQREKRLRRELARCKRGSRRRSARKRRLSEHTRRTAARRKGRLHAITTDLARKYGLIVIEDLRVANMTASAKGTVDEPGSNVRAKAGLNRSLLDLSLHAFRALLTYKVAARGGTLIAVNPRNTSRTCAACAHVDKDSRRSQAIFVCVACGHEANADINAAKIILARGISQSSATVLGRRKAPSEPRQRPATPKSCGSPAMGRDQHSKFRGESAVSAAESAGCSSSGCGPRRCRW

SEQ ID NO: 61678 - protein, 968 aa, Unknown
  Microbial Source -  Accession No. Ga0073932_1022770
MLKSYDYFTKLYSLQKTLRFELKPIGKTLEHIKNSGIIESDETLEEQYAIVKNIIDKLHRKHIDEALSLVDFTKHLDTLKTFQELYLKRGKTDKEKEELEKLSADLRKLIVSYLKGNVKEKTQHNLNPIKERFEILFGKELFTNEEFFLLAENEKEKKAIQAFKGFTTYFKGFQENRKNMYSEEGNSTSIAYRIINENLPLFIENIARFQKVMSTIEKTTIKKLEQNLKTELKKHNLPGIFTIEYFNNVLTQEGISRYNTIIGGKTTHEGVKIQGLNEIINLYNQQSKDVKLPILKPLHKQILSEEYSTSFKIKAFENDNEVLKAIDTFWNEHIEKSIHPVTGNKFNILSKIENLCDQLQKYKDKDLEKLFIERKNLSTVSHQVYGQWNIIRDALRMHLEMNNKNIKEKDIDKYLDNDAFSWKEIKDSIKIYKEHVEDAKELDENGIIKYFSAMSINEEDDEKEYSISLIKNINEKYNNVKSILQEDRTGKSDLHQDKEKVGIIKEFLDSLKQLQWFLRLLYVTVPLDEKDYEFYNELEVYYEALLPLNSLYNKVRNYMTRKPYSVEKFKLNFNSPTLLDGWDKNKETANLSIILRKNGKYYLGIMNKENNTIFEYYPGTKSNDYYEKMIYKLLPGPNKMLPKVFFSKKGLEYYNPPKEILNIYEKGEFKKDKSGNFKKESLHTLIDFYKEAIAKNEDWEVFNFKFKNTKEYEDISQFYRDVEEQGYLITFEKVDANYVDKLVKEGKLYLFQIYNKDFSENKKSKGNPNLHTIYWKGLYDSENLKNVVYKLNGEAEVFYRKKSIDYPEEIYNHGHHKEELLGKFNYPIIKDRRYTQDKFLFHVPITMNFISKEEKRVNQLACEYLSATKEDVHIIGIDRGERHLLYLSLIDKEGNIKKQLSLNTIKNENYDKEIDYRVKLDEKEKKRDEARKNWDVIENIKELKEGYMSQVIHIIAKMMVEEKAILIM

SEQ ID NO: 61679 - protein, 759 aa, Unknown
  Microbial Source -  Accession No. Ga0079044_1002244
MPRRRPRVPRHTRSRKRGASERPTRRFRAAMTGPAARRRIGGGDERACAEAWYRRLGDRPRYGPEAIRRKSLRRGVVSATPCRLHTAPAEKPATRRRGVADAHRKCDNVTMGPPAEAPGPRRDTAHSTEEEIASMRVYRYGAKLRGPLDPVAEEQVELANRFWNELVDMHRKYGELLQKAQEEASPALAALRAEMAALAEEKIRLRGLIKKSRQKARGNVPADPAIKEQLRAVSQRIKELKPIVKMEKEKAKTASSDERHRLSEQQKLEKKRLRQKYAALGLYWSNYNAVLQGFDTAVKRELETQGRLRVRKHAPSGAAVWTVRIQHPTGAREYTWADATRGDPSKPFSIIMPDSEREEFTTHDGRTLSRRRLPVARLRVRAERAKTPDGTWVEFGGHHIDVPFYMHRQPPPTARVVMARLVRKRIADCYEYHLCITVDEPPAPKRSGTAAGVDLGWRRLPDGAVRVAYVAGEDGAKGALAVPQSTLDRLAHAERLQGIRDSALEGIRSDFVAWAKPLLGNPALPDFVAAALAGDREHGIPPLASWRSPRRFARLTGQLVRWAADHPNQAAALPDWPAWNRRIQSWNRQDKPLWRTLSFLRVKAIAHRNEQYRIFAKRLAERYAYIVLEDMDIQDMNRKPQAEQAPETSQQKLRHLARAAAPAAVRSAIENASWRWGSTFVKVDPANTTRRHAPCGNLVEQNYAESVMVYCPECKVWYDQDENAAVNLLLRIRENPPPAPTNPKPANGSRWQRAKAKAR

SEQ ID NO: 61680 - protein, 348 aa, Unknown
  Microbial Source -  Accession No. Ga0079639_1009487
VEETIKLTVRAVIPPRDVGLRKLMREYKAYKKALIPKVKQAVRHVIKDRNLRIYAQQKWMVDKKLNEYLKNLPFHPMPFHNQSVWIENKDGKFWIHFKTKEGEAVCYLHVPAKYRDLIEKACGEDNPVLGQVELIEDKKYGWVNCHICLRLPKPEPYKPKGWIGVDTGWNKLATSIACTCNPHILFFKPTFHGKKFKKQIIQLRHLLKQYARKGKAWKKWDYRLKNTIKYAVGVVAKEIVSKAKKLKTGVAMEQLTFQSTTKGYLVPRYKLMIAVKTLCEREGVPFKLVPAQYTSITCPKCGFVDEKNRNGEWFKCTKCGYQTDADLAGAMNIAERALTATQMEGRMA

SEQ ID NO: 61681 - protein, 527 aa, Unknown
  Microbial Source -  Accession No. Ga0099914_10727
NFDNLLELINLQKGYLFQIYNKDFSEYSKGKPNMHTMYWRALFDEENLKDVVYKLNGEAELFYRKKSIDDDKKIIHKANEKLANKNPLNPKRESKFSFHVPITMNFKADGNDYINQDVLKFLKNNPDVNIIGLDRGERHLIYLTLINQKGEILDGLQFSLNEILNTYKNSKGENVELKTSYHTLLDAKEKERDEARKTWKSIENIKELKEGYISQVVHIIAKMMVEFNAIVVMEDLNFGFKRGRFKVEKQVYQKLEKMLIDKLNYLVFKDVEESKSGGLYNALQLTNKFTSFKEMGKQSGFLFYVPAWNTSKIDPTTGFVNLFDTRYESIEKAQQFFKKFKSIQYNSQKQYFEFAFDYSEFTNRAEGSKTNWKVCTQGDRIITFRNPESNNQWINKKVNLSQEFEDFFGKHNVIYGNGENFQPQIEAQTTKEFFEKLLQLFKLTVQMRNSKSDEDYLISPVINKTGEFYDSREANDTLPKDADANGAYHIAKKGLWVLEQINETEDYKKLKLAISNKEWLQFVQKNN

SEQ ID NO: 61682 - protein, 956 aa, Unknown
  Microbial Source -  Accession No. Ga010790_149349
MPQQDKPPVTQRAYTLRLRGADPSDTSWRKALWQTHEGVNKGAKAFGDWLLTLRGGLDHTLADTKVKGGKGKPDRDPTDEERKARRVLLALSWLSVESKLGAPVDYIIASGKDAAEDRNGKVVAALEEILKSRNLADNEIGEWKNDCSASLSAAIRDDAVWVNRSKAFDDAVNSIGCSLTREEAWDMLERFLGSRDAYLTPVKGSEDESSATEQEEKAKDLVQKAGQWLSSRFGTGKGADFSRMAAVYGKIAAWAGAHSPNKDAIASLATALSEFTPASNDLQGVLGLISGPGYKSATRNLLTQIADKTIVTQEDLKKLNETAAADRGKCETNTGSKGQRAYSDAILKDVESVCGFTYRVDENGNAVSVSNYSLYGDDYNWGSARHSEFAVILDHAARRVSLAHTWIKRAEAERRRFEDDAQRMANVPGPVKEWLDSFCLERSGMSGGLEPYRIRRRAVDGWKEVVTAWSKSSCSTSADRIAAARALQDDPEIDKFGDIQLFEALAEDDAVCVWHKEGDAAKAPDPQPLIDYALAAEAEFKKRHFKVPAYRHPDALLHPIFCDFGKSRWDICFDVHKNAQTPFPRALCLTLWTGNGMVSVPLCWQSKRLAHDLALGQDVQNDGSSEVARADRLGRAASNVTKSDEVKISGLFEQADWNGRLQAPRQQLEAIAVVRDNLSLSDQERERRMSGMMDRIRWLVTFSAKLQPQGPWCEFAEKLQLRINPQYWPHADTNKDRKGHARLILSRLPGLRVLSVDLGHRYAAACAVWEAVNAEQVKKACQVAGHEAPKASDLYLHLKRKATKQKKGNQVVVEETTIYRRIGADTLPGGTQHPAPWARLDRQFLIKLQGEEEGVREASNEEVLKVYQLEAELGRTAPIIDRLVKAGWGQSGKQRTRLEALRELGWKPASEAAGVSDGMDADEGEVRKPSLSVDELMSSAVRTMRLALKRHGDRAR

SEQ ID NO: 61683 - protein, 540 aa, Unknown
  Microbial Source -  Accession No. Ga102924_1013089
MPFGNAARASRAYEYGVRFTAGEDLALLALREKVRLWNCLVAVDHDLRERRDALIGAYLTDHPPIDDTPVAAKAARKAAFADAGVKAALAELDREGQERSRLLGHESPLWWCNRDAVRTTWLQHRRDPEPSRFHSARRAEGTLIVRRSGGWTVASLLRGGDRFIGLGAVDPLGWSHSVRAERRRRCRVPLTLRIGSTPDREPIAVELTLFFHRPLPEGGNVQEVRLAATPLADTVRWTAVFVVALPEADAAPEPTAPAGTRAALDLGWRARPAGLRTAVWHDAGRWGELSLPEKDFAAQLGKVDDLRSIRDQHLNVAKAALAAWVKRQPSLPEWLGESTKTLGQWRSQGRLAGLVRRWARQRFEGDADIWPELAAWQAQDRHLWLWQEHLRDQVLHRRRECYRVFAADLARRYREVVLESVDWSKLARQGKELPPLARWHRVVAAPSILEEAIEHAVGREGGIVRRAEPAYTTMLCHVCGSIEAVDGVALYHVCVACREGGVHTRWDIDVNATRNLLANRPAAGKGGGFATDGPEERAGA

SEQ ID NO: 61684 - protein, 712 aa, Unknown
  Microbial Source - Accession No.  Ga0103818_10095
LEPHSPVLLLRPCPDLGRTGNRARLGGQPREPGRRRRPLQSFRREPVERNGEVSAPVQPEPVPSRRSLARLHPGDPDGARSRAVPDGLRRRTCRPGHPPHDGMVLPVVGEKPNNQGDQMDHVVEKDPTGDPIGLQFVVRQYGLLDPLDWDQDCQEHLWRENKFWNTLVELEKKHRDAYFRLTGSDPELKEIEDALSALMEEKEARIAEKKALRQAARKKAGVDTSAQDLRIEEIRPEIRRLSGLAKETRKKTRERMKPEIDALERTRREDVKIARNASGLWWGNYNAVCASYETARVRAMRTGGDLRFHSFDGTGRFTCQIQGGMTVSEFFSGDRNSVVSADPVSPDAFYHPSRGARRRAARTTLRITVYTTKDENGKYVRRILSFPMILHREIPSDVLIKQVVVTRKRVGATFRWTVTLTGTRSGSPRIVPGIPGLCGIDLGWRLVPEGLRVATIADDKGVRHIVLPEKMLRRMDHVEDLKSRIDLERDRIVTWLRAHWWGIVETFPEPIRERFVGHIRSLKVSPRKLAGSILAWRDDHGDFRPDLLAALEAWRKTNKRLTQEMDNLREKLSAQRTDLYRNEALRIVREHSCVALEDFDLREVVKLETPEGEKTDQPAAARANRVRAAVSDLRNWIGIQAAKTGTEIVKIPAADTTRACRQCLHVNVRSRPEELVWTCDACGAVWDQDENAARNLLMAAEMRQENAKKVSA

SEQ ID NO: 61685 - protein, 394 aa, Unknown
  Microbial Source -  Accession No. Ga0105154_1006902
LAGEEKLKLTVKCVIPPRDIGLQKLMREYSVYKKVLIPRVKQAVRQVIKDKTITVYAQQKWMIDKKLNEYLKNLPLHPMPFHNQSVYIEKKDGKFWIHFKTKRGEAVCYLHVPAKYHDLIEKACGKDNPVLGQVELVEDKKYGWVNCHITLRLPKPEPYEPLGWVGVDIGWNKLATSIACTCNPHIRFFNPTFHGKEFKTRIIQLRHLLKEYARKGKAWKKWDYRLKHTIKYAVGVVAKEIVTKAKKLKAGVAMESLTFKSTTKGYIVPRHKLMVAVKTLCEREGIPFKLVPAQYTSITCPKCGHINSKNRDGEWFKCLKCEYQTDADLVGAMNIALRALDSCPNGGQIDVGHAPRLKPMGLYAPEGGDVATPLRGMNDDLYKATRKTEKIEER

SEQ ID NO: 61686 - protein, 380 aa, Unknown
  Microbial Source -  Accession No. Ga105158_1004615
MEETIKLTVRAVIPPRDLGLRKLMREYTAYKKVLIPKIKQAVRRVIKDKSIRVYAQQKWMVDKKLSEYLKNLPFHPMPFHNQSVWIEDKDGKFWIHFKTKEGEAICYLHVPLKYHSLIEQACGEGNPTLGQVELVEDKKYGWVNCHICLRLPKPKSYEPKGWVGVDVGWNKLATSILATTNPHLTFSNPTFHGKQFKTRIIQLRYLLKQYARKGKAWKKWDFRLKNTIKYAVGTVAKEIVSKAKRLKAGVAMEILTFKSTTKGYIIPRYKLMIAVKTLCEREGVPFKLVPAQYTSITCPKCGYADDENRNNERFKCLKCGYKADADIVGAMNIALKALDGTADEAVNGMGLAPMPKTLRLYAERGGHVASPLRAMTDDPL

SEQ ID NO: 61687 - protein, 824 aa, Unknown
  Microbial Source -  Accession No. Ga0114945_10008792
VRASRIRIPRWTSGRLDHSSVRSSDEESVPWGGEGCQGGVDGARRFRYLLDSVCRTTHRSEHLPKGGRNHGSTCQTAAVGSRPNAPARPRIARADAPSRAPRARPARSALQGRAARHPCAARIPDALRAARRSVVPTLRRRIGSRARVCSGVRTQAACRHHRHRGGVVMRPWWQREHAERADADGQSSLVVEAPLHEPSRWKRRVLEHCSVLVSNATAALLAFIRERLVVTPDVEDATKIASADLAFEVGKEHASRIAALLAQVKHDRETGERLPFSNAYRFTACEPVPGTDRFRVVARLADGTWRERKLKRGGVRRTHGINCIHATTGFQQLLATYAAPKLLHVVPPALRAGVCQEVAQQVLSYLGQLESSKVRGDVAFPTVEDRDPVRRRQAYEDAIDALVADLTPFSYAKLRDKFPGEYAADDPRGDRLIVDDPRWFAVTTTPDPHPIPLLFSQGSAVRLLEGSTSFDAGVSKRNRHRGSSTASESVRQSRPDAVQRKGTTGLRQWYAAIPLLDADDDALRAIAAAAHERSGRQLDLALHPLPLDGGVRWRRRERDVLVPLSGDRKRLERILRNPNLHIAWSRLVQKRTGWVLQLTVRIPMQPAVEHRRVLGVSFGIDAVATWSLVDEDGVELEHGALAPNEQILTFLREKRQLEWDQEKGRWIGKQRFAMQLESIAHGVANTLLAIAEEHHAVLAVEDVSWVKKAGPNHAQNVLFTAWNFGQLRRILSYKSPMVGRGDPVTVSDYVVSYTCPTCGACRKPKQKPDHADTWRDGDTLSCRSCGFQGVLSPSDRARRVTANGLTIWQDRWQRSDERNGTETS

SEQ ID NO: 61688 - protein, 867 aa, Unknown
  Microbial Source -  Accession No. Ga011614_1003707
DYFSITEIEVALWNYRTENDLLKDLEEEQHLIANYFNSYFKTTVNDKEYDLVANVTAKYSCIKGLLEQDYPEDKKLNQETKEIDDIKAFLDALMLVLHFVKPLMLPHDSTLEKDQSFYNTIAPYYEELQYLISLYNKVRNFASQKAYSVEKYKLNFENSTLLAGWDVNKEPDNTSVLFRKENDYFLGVMDKKHNGIFKKTPKSKTQDTYSKVNYKLLPGASKMLPKVFFSRSNIAFYNPSEEIITIRNHSTHTKGGTPQTGFEKKDFNLSDCRKMIDFFKDSIAKHPDWKQFGFNFSDTDSYDSIDGFYREVEAQGYTISYTEIDETYIHQLVDEGKLYLFQIYNKDFSEFSKGKPNMHTLYWKALFDSENLRDVVYKLNGQAEIFYRKSSIKKDKIIVHKANEKVANKNPLNTKKESLFTYDLVKDKRFTVDKFQFHVPITLNFKASGNDYINQEVLSFLRQNPDVNIIGLDRGERHLIYLSLINQKGEILQQFSLNDIINEYKGITHKTAYKTLLEKKEKERADARENWGTIESIKELKEGYISQVVHKIAKMMVEYNAIVVMEDLNMGFKRGRFAVEKQVYQKLEKMLIDKLNYLVFKDKAPNEAGGLYNALQLANKFESFQKMGKQSGFLFYVPAWNTSKIDPTTGFVNLFYTKYESIEKAQKFFEKFDSIHFNTKEQYFEFAFDYDNFTERATGTQTQWTVCTQGERILTFRNPSANNQWDNKEIKLTEQFEDLLGKHNISYGSGTCIKAQVATQSGKDFLKGMMDLFKLTLQMRNSITNSEVDYLISPVRNAQGSFYDSRNADATLPKDADANGAYHIAKKGLMWLHQIHEFEGNDWRKLDLDKTNKGWLNFVQPKNKTNE

SEQ ID NO: 61689 - protein, 1089 aa, Unknown
  Microbial Source -  Accession No. Ga116143_10029534
MPQQAKPPVTQRAYTLRLRGAGPSDISWRKALWQTHEGVNKGAKAFGDWLLTLRGGLDHTLADTKVKGGKGKPDRDPTDEERKARRVLLALSWLSVESKLGAPEGYIIASGEEAAEDRNGKVVTVLEELLKSRNVPNNEISEWKNDCSASLSAAIRDDAVWVNRSKAFDDAVKSVGCSLTREEAWDMLERFFGSRDAYLAPVKGSEDESSETEQEDKAKDLVQKAGQWLSSRFGTGKGADFCRMADVYGKIAAWADNAQADTTGNDAINNLAAALNESTLASNDLQGVLGLISGPGYKSATRNLLNQLATKTIVTQQDLANLKDKAIKDAQKCNQNTGSKGKRPYSDAILKNVEAVCGFTYLQDGGSARHSEFAVILDHAARRVSLAHTWIKRAEAERRRFEEDTQRLANVPGPVKDWLDSFCSERSGTSGALEPYRIRRRAVDGWKEVVTAWSKSSCSTSADRIAAARALQDDPEIDKFGDIQLFEALAEDDAVCVWHKEGDAAKAPDPQPLIDYALAAEAEFKKRHFKVPAYRHPDALLHPIFCDFGKSRWDICFDVHKNAQTPFPRALCLTLWTGNGMVSVPLCWQSKRLAHDLALGQDVQNDGSSEVARADRLGRAASNVTKSDEVKISGLFEQADWNGRLQAPRQQLEAIAVVRDNLSLSDQERERRMSGMMDRIRWLVTFSAKLQPQGPWCEFAEKLQLRINPQYWPHADTNKDRKGHARLILSRLPGLRVLSVDLGHRYAAACAVWEAVAKGDFEKECSNAKGKGAEIHYGPDGCKPEDAIYAHLVWPEKASNSATKKAKTEGRDKFHPVTIYRRIGADTLPDGTQHPAPWARLDRQFLIRLQGEEEGVREASNEEVWKVHQMEAELGRTAPIIDRLVKAGWGQSGKQRTRLEALRELGWKPASEAAGVSDDMDADEGDDRKPSLSVDELMSSAVRTMRLALKRHGDRARIAHYLITDEKTKPGGTKEKLDENGRVDLLQDALVMWHDLFSSRGWRDDAARQLWDEHVAKLSGYKAPEEIGEEFSGPERKKKQKENREKLHDVAKAMAQDVTIREALHDAWKKRWKDDDERWKKQLRWFKDW

SEQ ID NO: 61690 - protein, 1236 aa, Unknown
  Microbial Source -  Accession No. Ga116146_1004071
MMMSQKEKPATTQRAYTLRLRGVNPNDNSWRHALWQTHEAVNKGAKVFGDWLLTLRGGLDHSLVAADNSDRIPTDEERKARRILLALSWLSVESERGAPEKYIVASGKEASTDRDIKVIAALEEILKKRKLSDDEIKGWIDDCKASLSAAIRDDAVWVNRSKAFDDARVGRASFRSHAVWVNRSKAFDDAVNVKRIGDSLTREEVWDMLDYFFVSAEAYLKPIKISGDESTDTEKEEKAKDLVQKAGQWLSGRFGSGKGADFPRMAKVYEKIVQWADQAEADTAGGEAISNLVEALKEFKPASEDLDGVLGLISGRGYKSATRNYLQQIHTKSNITKEDLDNLKKKADEDRKKCLGKSGSKGQRPYADAILDDVERDCVFTYRVAENGEHVSVLDYSKYKEGCKWGTSSHQEFSVMLDHAARRVSLAHTWIKRAEAERRKFEEDAKKKDFVPKSASKWLDQFCEERSEASGALEPYRIRRKALDGWKDVVEAWSDKSCKTNTDRIEAARALQHQIDKFGDIQLFEALAADDARCVWHKDGNETASPDPQPLIDYVLAAEAEFNKQRFKVPAYRHPDALLHPVFCDFGNSRWSIDFSIREATTELNKAKKKLQKTEEAFTKATNVFVTDRENGKKREKLEKAKKELTDARQEVKRLSSARRLSMTLWTGIVLENKFPLCWQSKRLVQDLALSQKEQKCEATEVTRADRFGRAASNVTKSDDVEISGLFEQKDWNGRLQAPRQQLEAIAKVRDNDSLPTEERDRRICKMKDRIRWLVTFSAKLQPMGPWCDFAEKHRELELKIDPQYWPHAEENKKRKGQARLILSRLPGLRVLSVDLGHRYAAACAVWETVDSRQVEDACKDANHERPKSEDLYLHLTKRKNAGNDVEKTIIYRRIGADNLPNGTPHPAPWARLDRQFLIKLQGEEEGARMASDEEIWAVHQMEAAFGRSVLLIDRLVASGWGSSDEQKARLEKLKGLGWTPAKQPSSNYESDLDQGEFFKPSLSIDELMYSAVRMMRLALKRHGDRARIAFAMTAEYKTMPGDRRYYFAESKELSVEDNQEVRDSKRVEFIRDALVLWYDLAYSQGWRDNKARQLWDEYIAKLPEYGAFDEKIEESAAQGDKKRNEEIKEKLNNVPRVLANNESLRKDLHDAWQCRWEEDDDQWKKQLRWFKDWILPRGKAAKDPAIRGVGGLSLTRLATLTEFRRKVQVGFFTRLRPDGTRQKPRKGLGKALWMH

SEQ ID NO: 61691 - protein, 1496 aa, Unknown
  Microbial Source -  Accession No. Ga116159_1001590
MADDLSTQRAYTLRLQGTDPEDQSWRDALWMTHEAVNAGGRAFGDWLLTLRGGIAHELADTPVKGKKDITDELRKNRRILLALSWLSVESRRGAPDKFIVAGGEEPAGSRNEKVLQALKEILKRRGLSAEESESWMSDCRASLSAAIRDDAVWVNRSAAFDDAQVRIGASLTREDIWDMLDPFFGSREAYLTPAKKKKEDEDSSEGTGEEKAKDLVQKAGQWLSSRFGTGKGANFAAMAEVYSKISEWAGTAQEGVSGKEGIKNLADALAAFSPVSQNLEGVLKLISGPGYKSATRDLLGELDSLPVVSRDHLSALHEKAAEDTVKCKESTGTKGRRPYADAILNDVEKRCGFTYLTDSDNRSVSILDTSEFPSDYKWGTARHSEFAVILDHAARRISVAHSWIKLAEAERDRCEEDAAKVYDLPDKVKEWLDTFCSNRSDISGAQGEGYRIRRKAIEGWKEVVASWGRSSCITAEDRVAAARALQDDPEIDKFGDIQLFEILAQDEALCVWHKDGDVAKSPDAQMLIDYVLASDAESKKRRFKVPAYRHPDALLHPIFCDFGNSRWDITYDIHGARGKKKAKRGSKKEEAMPRGVAMKLWTGSDVLSVSLRWQSKKLAADLALDQEAEEVTDTAAVSRADRLGRAAAGIDRGAGVTIAGLFEEAHWNGRLQAPRQQLEAIAAVRDNQKLSSEERERRIAFMKDRIRWLVTFSAKLRPQGPWHSYAPTQGLQSDPKYWPHSEINKKRKGQAKLILSRLPGLRILSVDLGHRFAAACAVWETMSSEAIQEACRLANHQLPAPADLYLHLKRTVQKNLIDGEKTVEESTVYRRIGADRLPDGTAHPAPWARLDRQFLIKLQGEEKVREASNEEVWQVHLMESALGLSFPLIDRLVYAGWGGTEKQAARLEALREKGWKPTGTPADQDEEGGGYKPSLAVDELMFSAVRTLRLALKYHGDRARIAFALTADYKPMPGDTRYYFSEAKDRSSGADAAEREAKHKDYLLDMLLLWHDLAFSRKWRDEEAKELWNLHIAALPGYQAPAAPIQEEAGQGRKKAREEARAKMTPAAEALLADGTLREKLHGLWKERWEKDDAQWKKHLRWMKDGILPRGGRAATPSIRYVGGLSLTRLATLTEFRRKVQVGFYTRLFPSGEKREIKEAFGQTALDALERLREQRVKQLASRIAEAALGAGRVSRTALKQDPKRPEARVDAACHAVIIENLEHYRPEETRTRRENRGLMNWASSKVKKYLSEACQLHGLFLREVPAGYTSRQDSRTGAPGMRCQDVTVKTFLNSPFWQKQCVQAQKNKSTARDRFLCALKEAVAQGGMEEEKKMGPIRVPVPGGEVFVSADAASPAAKGLQADLNAAANIGLRALLDPDWPGKWWYVPCDRKTAYPAKEKVEGSAAVDVKQALPFVLPEEKENKGKTKGGKKGKGEVMNLWRDVSAEPLMTGQWLDYTAYRKEVENRVIQVLTAQLKARNPLRFGNLGDEEEIPY

SEQ ID NO: 61692 - protein, 1563 aa, Unknown
  Microbial Source -  Accession No. Ga116160_1008286
MSITNKPSVTPRAYTLRLRRAPGECVLCRKNDCNCWRENLWQTHEAVNKGAKAFGDWLLTLRGGLEHTLADNKVKGGKGKPDRDPTDDERKARRILLALSWLSVESKIGAPPEFIVASGQDVAKNRNGKVFRALEEILKTRRMAKKNIEEWKNDCSASLSAAIRKDAVWVNRSKAFDRAVKSIGASLTREEAWDMLERFFGSRVAYLTPIQSFENESSDAAEQEEKGKDLIQKAGQWLSSRFGAGKGADFRRMANVYNMIARWADKAHADMDGNQAINSLASALSIFTPASNNLKGVLDLISGPGYKSATRNLLSQFSDKTSVSRQDLFNLRDKAKNDARKCNQRSGSKGQRPYSEAILKNVESVCGFTYLQEKGPARHSEFAVMLDHAARRVSLAHTWIKRAEAERSKFEEDAKKANQVSKAAKNWLDLFCIERSVMSSALEQYRIRRRAVDGWKEVVAAWGKRSCNNLNDRIAEARALQEMDKFGDIQLFEALAEDDAVCVWHEDGDATKAPAHQQLIDYVLATEAEFKKRHFKVPAYCHSDSLVHPVFCDFGNSRWDIDFSIREAASCLEKAQTACTNKQAVVDKIEKIIKKPSGKVEKKSRLIEKLKKAKSEYEEARRELVRLNSKRGMTMTLFNGSDVKKTALGWQSKRLAADLALHTDDDSTNNIRVSRANRLGRAASNVIGSDGVKISGLFEQADWNGRLQAPRKQLEDIGKRVAKYGWDIKAQKMRDNLQWLVSFSAKLQPNGPWCDFASANDLKLDQKNGEIIIASQNSKNDWRGLAYPFWHSSNEKGRKGMAKHNLSRLSGLRVLSVDLGHRYAAACAVWEAINTKELKKVCRAAQHDAPKASDLYLHLKQKVKKEKNGNLVEMNKITVYRRIGAETLSDGMQHPAPWARLDRQFLIKLQGEEEGIREASNEEVWKVNQLESELGRTAPVIDRLVKAGWGQSDRQKTRLNALHNLGWTPASGAEVSDRTDENECEVCKPSLSVDELMSSAVRTMRLALKRHGDRARIAFAMSAECKPMPGDRRYFFTEAKELSVNDDQATRGNKHIEFIQDALMLWHGLASLRGWRDDVAKQLWDNYIANLSGYKAIKEISEDVSDAERKKKQKENREKLHDVAEALVKDARLRRVLHNVWKKRWEQDDKWWKERLRWLKDWILPRGQAANGPAIRKVGGLSLTRLATLTEFRRKVQVGFYMRLKPDGTSVEIKERFGQRTLDALENLREQRVKQLASRLTEAALGIGRMKRFRGEKDAKRPRERVDKPCHAIVIEDLTHYRPEETRTRRENRQIMTWSSSRVKKYLSEACQLHGLHLREVPAGYTSRQDSRTGAPGIRCQDISVKEFMRSYFWRKQVKNAQEKLAEDKGNSRERYLCKLAAMWTDKAAVGWEKGGNVRVPLKGGEIFVSADRRSPAAKGIQADLNAAANIGLRALTDPDWPGKWWYVPCDPASFKPVRDKVGGCAAVNPDTTLWQSAQVQSCDTDNNKKKQGKKDARNANGVVNLWRDISSSPLECIGSGEWKEYAAYQNDVQCRVIRILEEQIKERGWHLHDGSKEDEIPF

SEQ ID NO: 61693 - protein, 1570 aa, Unknown
  Microbial Source - Accession No.  Ga0116161_1004008
MMMSQKEKPATTQRAYTLRLRGVNPNDNSWRHALWQTHEAVNKGAKVFGDWLLTLRGGLDHSLVAADNSDRIPTDEERKARRILLALSWLSVESERGAPEKYIVASGKEASTDRDIKVIAALEEILKKRKLSDDEIKGWIDDCKASLSAAIRDDAVWVNRSKAFDDARVGRASFRSHAVWVNRSKAFDDAVNVKRIGDSLTREEVWDMLDYFFVSAEAYLKPIKISGDESTDTEKEEKAKDLVQKAGQWLSGRFGSGKGADFPRMAKVYEKIVQWADQAEADTAGGEAISNLVEALKEFKPASEDLDGVLGLISGRGYKSATRNYLQQIHTKSNITKEDLDNLKKKADEDRKKCLGKSGSKGQRPYADAILDDVERDCVFTYRVAENGEHVSVLDYSKYKEGCKWGTSSHQEFSVMLDHAARRVSLAHTWIKRAEAERRKFEEDAKKKDFVPKSASKWLDQFCEERSEASGALEPYRIRRKALDGWKDVVEAWSDKSCKTNTDRIEAARALQHQIDKFGDIQLFEALAADDARCVWHKDGNETASPDPQPLIDYVLAAEAEFNKQRFKVPAYRHPDALLHPVFCDFGNSRWSIDFSIREATTELNKAKKKLQKTEEAFTKATNVFVTDRENGKKREKLEKAKKELTDARQEVKRLSSARRLSMTLWTGIVLENKFPLCWQSKRLVQDLALSQKEQKCEATEVTRADRFGRAASNVTKSDDVEISGLFEQKDWNGRLQAPRQQLEAIAKVRDNDSLPTEERDRRICKMKDRIRWLVTFSAKLQPMGPWCDFAEKHRELELKIDPQYWPHAEENKKRKGQARLILSRLPGLRVLSVDLGHRYAAACAVWETVDSRQVEDACKDANHERPKSEDLYLHLTKRKNAGNDVEKTIIYRRIGADNLPNGTPHPAPWARLDRQFLIKLQGEEEGARMASDEEIWAVHQMEAAFGRSVLLIDRLVASGWGSSDEQKARLEKLKGLGWTPAKQPSSNYESDLDQGEFFKPSLSIDELMYSAVRMMRLALKRHGDRARIAFAMTAEYKTMPGDRRYYFAESKELSVEDNQEVRDSKRVEFIRDALVLWYDLAYSQGWRDNKARQLWDEYIAKLPEYGAFDEKIEESAAQGDKKRNEEIKEKLNNVPRVLANNESLRKDLHDAWQCRWEEDDDQWKKQLRWFKDWILPRGKAAKDPAIRGVGGLSLTRLATLTEFRRKVQVGFFTRLRPDGTRAETKEGFGQSTLDALENLREQRVKQLTSRIVEAALGVGRVKRPAGGKDPKRPDKRVDEPCHAIIIENLTNYRPEETRTRRENRQLMSWSSSKVQKYLSEACQLHGLHLREVSASYTSRQDSRTGAPGMRCQDVPVAEFMRSPFWRKQVKQAQENVSKNKGNKRERYLCDLNEMWGHKQPADWKEAGDVRIPLNGGEIFVSADSTSPAAKGLQADLNAAANIGLRALIEPDWEGKWWYVPCDAAGLPVKDHVEGSQVSGLNQALRQPEQAQTNEANTETKKRKSGRGKSREVINLWHDISSSELNDREWKDYNAYWNGVQYRVVSNLNQQMNGRNKKRQVDLGDDDVPF

SEQ ID NO: 61694 - protein, 1519 aa, Unknown
  Microbial Source -  Accession No. Ga116167_1006930
MPQQDNPPVTQRAYTLRLRGADPSDISWRNALWQTHEAVNKGAKAFGDWLLTLRGGLDHTLADAKVKGGKGNPDRDPTDEERKVRRILLALSWLSVESKLGAPQNYIIASGTEAAEDRNGKVVAALEEILKSRNLAENEIDKWKKDCSASLSAAIRDDAVWVNRSRAFDDAVESVGCSLTREEVWDMLERFFGSRAAYLAPAKVTEDESSEEEQEEKAKDLVQKAGQWLSSRFGTGKGADFFRMAAVYGKIAAWAVNAQAGTTGNQAINKLAADLSEFTPASNDLKGVLGLISGPGYKSATRNLLTQIDDKPIVTQEDLKKLNKTAAADRGKCETNTGSKGQRAYSDAILKDVESVCGFTYRVDENGNAVSVSNYSLYGDDYNWGSARHSEFAVILDHAARRVSLAHTWIKRAEAERRRFEDDAQRMANVPGPVKAWLDSFCSERSATSGALEPYRIRRRAVDGWKEVVTAWSKSSCSTSADRIAAARALQDDPEIDKFGDIQLFEALAEDDAVCVWHKEGDAAKAPDPQPLIDYALAAEAEFKKRHFKVPAYRHPDALLHPIFCDFGKSRWDICFDVHKNAQTPFPRALCLTLWTGSGMEPVPLCWQSKRLACDLALGNNPRNAGASAVTRADRLGRAASNVTKNDQVKISGLFEQEDWNGRLQAPRQQLEEIARYVEKHGWDQKAKKMRDGIQWLVTFSAKLQPQGPWLDYAKTNVLKLDQKNGDIVVAPSNSKNEWRGLAYPFWHSDNQDGRKGLAKHCLSRLPGLRVLSVDLGHRYAAACAVWEAVEKGDFEKECSKAKEKGAEIHYGPDRYKPEVAIYAHLVWPEKASNSATKKAKTEGRDKFHPVTIYRRIGADTLPDGPPHPAPWARLDRQFLIKLQGEEEEVREASNEEIWKVHQLESELGRRVPLIDRLVNAGWGWSDKQKARLEALCAWGWKRASEAGFSGGTDADEGEVRRPSLSVDELMSSAVRTMRLALKHHGDRARIAHYLITDEKTKPGGVKEKLDENGRVELLQDALIMWHDLFSSRGWRDDAAGQLWNDYVAKLSGYNAPEETDEESSGPERRKKQKENREKLYDAAKALAQDVTLRKALHDAWKKRWKDDDERWKKQLRWFKDWVLPRGKHASDPAIRKVGGLSLPRLATLTEFRRKVQVGFFTRLQPDGTRAETKEQFGQSALDALEHLREQRVKQLASRIAEAALGIGRMRRPMEGKDPKRPDVRVDAPCHAIVIEDLTHYRPEETRTRRENRQLMTWSSSKVKKYLAEACQLHGLHLREVSASYTSRQDSRTGAPGIRCQDVPVDEFMRSPFWRKQVKQAEAKQAENKGDARDRFLCNLNAMWKDKTVADWEKAGVIRIPLNGGEIFVSADCTSPAAKGLQADLNAAANIGLRALTDPDWPGKWWYVPCDPASFKPIKDKVEGSKAVNPDKPLPHSTQKQDGNAAKDTKKRGNKGAGKSKEVVNLWCDISSFPLQDKSREWKEYAAYQNEVQCRILEEQIKGRDKQPHEGSKEDDISF

SEQ ID NO: 61695 - protein, 1558 aa, Unknown
  Microbial Source -  Accession No. Ga00116184_1002336
MTKKNKPSVTQRAYTLRLRRAPGECVFCQKNDCHCWNEHLWKTHEAVNKGAKAFGDWLLTLRGGLDHTLADAKVKGGKGKPDRDPTDEERKARRVLLALSWLSVESKLGAPPEFIVASGHDVAKNGNEKVFEALEEILKSRKIAKNEIKEWKDNCSASLGAAIQEDDAVWVNRSKAFDKAKVNDLKGLTRKYAQNAIMHFFGPEHDYFALPGGGNDDDDNDDADSSRLVANEGPEYRTLARQWISTNFGTGKKSNNERIIEILRKLVASDLNRFACHPKSEIIKEMCKIVNCSSPDLDKLCVAIGWITGRKSTGRLAIENLPACPNKTDIEKMKQKLADEADEKDSASGMREVPSWIALLRLSIEQACSIPFVGKRNHIGEFAVMLDHAARRVSIAHSWIKRAEAERRKFEVETKKVNIVPVAAKKWLDLFCMERTVMSGALAQYRIRRRAVNGWKEVVAAWGKSSCINLDDRIAVARALQFDPEIKIDKIGDIQLFEALAEDDAACVWHEEGDATKATAHQPLIDYVIATEAEFKKRHFKVPAYCHPDAFMHPIFCDFGNSRWDIDFSVREAAIYLEKAKTRCTKKQAVVNKVELILRKSSGNIAKEDQLIDKLKTAKRELEDAERELERLNSKHGMTMTLFDGKAVKKTELAWRSKRLAADLALHTDDDSTKLIEVSRANRLGRAASNVTGRDGVKISGLFEQADWNGRLQAPRKQLEAIAKRVADNRWDTKAKKMRDSLQWLVSFSAKLQPNGPWCDFASANNIKLDQKNGEIILASQNSKNDWRGLAYPFWHSSNEEGRKGMAKHNLSRLAGLRVLSVDLGHRYAAACAVWEAISTDKVRKACRAAGHEPPKASDLYLHLKQKVKKVEKGGQTEVNKTTIYRRIGADKLPNGMPHSAPWARLDRQFLIRLQGEEQGVREASNKEIWEVHQLEAEIGRTAPIIDQLVKGGWGESEKQKKRLKVLRTLGWKPINKDVGDVSSPSLSIDEMMFFAVRTMRLGLKRHADRARIAFAMTAAYNTMPGGRRYYFNEPKELSANDNKAERDNKRVEFIQDALMLWHSLAFSNGWQDDAASQLWDGLIAKLPGYKIPEEIGEEDSGAERRKKMKENRKNLYDVAVALAKDAKLRKALHEAWKKRWEGDDKQWQKRLRWFKDWILPRGKAAQDSAIRKVGGLSLTRLATLTEFRRKVQVGFFTRLKPDGTSEKNKERFGQRTLDALENMREQRVKQLASRIAESALGIGRMKRFRGEKDVKRPRERVDEPCHAIVIENLTQYRPKETRTRRENCLLMTWSSSKVKKYLTESCQLHGIHLREVSASYTSLQDSRTGSPGIRCQDLSVKEFMRSKYWRKQVEQAEKKPAEGKGDSRMRFLCELNKRWKDKRGEWEKAGVIRIPLKGGEIFVSAESKSPAAMGLQADLNAAANIGLRALTDPDWPGKWWYVPCDRASFKPVREKVDGSAAVNPDKQLRQPAHVHSSDIDKIITKRGRKNVGKANGIVNLWRDISSSSLECVKSGEWKEIAAYQNDVQCRVIRNIKEKKKGRDKQPQKGSKEADIPF

SEQ ID NO: 61696 - protein, 1102 aa, Unknown
  Microbial Source -  Accession No. Ga0116185_1015740
MPKQDKPPVTQRAYTLRLRGADPNDQSWSDALWQTHEAVNKGAKEFGDWLLTLRGGLDHTLADTKVKGGKGKPDRDPTDEERKARRILLALSWLSVESSLGAPADFIIASGAEASEDRNGKVVAALEDILKTRGVGQNEIKNWKIDCSASLSAAIRDDAVWVNRSKAFDNAVNSIGCSLTREEAWDMLERFLGSRDAYLTPVKGSEDESSATEQEEKAKDLVQKAGQWLSSRFGTGKGADFSRMAAEYGKIAAWADAHSPNKPGTDAIASLATALSEFTPASNDLQGVLGLISGPGYKSATRNLLTQIAAKTIVTQEDLKKLNETAAADKGKCETNTGSKGQRAYSDAILKDVESVCGFTYRVDENGNAVSVSNYSLYGDDYNWGSARHSEFAVILDHAARRVSLAHTWIKRAEAERRRFEEDAQRMANVPGPVKEWLDSFCLERSGMSGALEPYRIRRRALDGWKEVVAAWGKNSCSTSADRIAAARALQDDPEIDKFGDIQLFEALAEDDAVCVWHKDGDAAKAPDPQPLIDYAFAAEAEFKKRRFKVPAYRHPDALLHPIFCDFGKSRWGICFDVHKNVQTPFPRALCLTLWTGSEMKPVPLCWQSKRLACDLALGNNARNAGASAVTRANRLGRAASNVTKNDEVKIAGLFEQADWNGRLQAPRQQFEAIAAVRDNLSLSAQEREQRMSGMTDRIRWLVTFSARLQPQGPWCEFAEQNQLRIDPQYWPHADANKSRKGQARLILSRLPGLRVLSVDLGHRYAAACAVWEAISTEEARSACQAAGHEEPKESDLYLHLKKTAKKQKKTREVVVEETTIYRRIGADTLPDGVPHPAPWARLDRQFLIRLQGEEEGVREASNEEIWAIHQLEAALGRPVPFIDCLVASGWGGSDKQKARLKELKHLGWKPAEKPESGDESVAGEESNAYRPSLSVDELMSSAVRTMRLALKRHGDRARIAHYLITDEKTKPGGTKEKLDENGRVDLLQDALVMWHDLFSSRGWRDDAARQLWDEHVAKLSGYKAPEEIGEEFSGPERKKKQKENREKLHDVAKAMAQDVTIREALHDAWKKRWKDDDERWKKQLRWFKDWVLPRGKHASDP

SEQ ID NO: 61697 - protein, 1123 aa, Unknown
  Microbial Source -  Accession No. Ga0116188_1022712
GRAFGDWLLTLRGGIAHELADTPVKGKKDITDELRKNRRILLALSWLSVESRRGAPDKFIVAGGEEPAGSRNEKVLQALKEILKRRGLGAEESESWMSDCRASLSAAIRDDAVWVNRSAAFDDAQVRIGASLTREDIWDMLDPFFGSREAYLTPAKKKKEDEDSSEGTGEEKAKDLVQKAGQWLSSRFGTGKGANFAAMAEVYSKISEWAGTAQEGVSGKEGIKNLADALAAFSPVSQNLEGVLKLISGPGYKSATRNLLGELDSLPVVSRDHLSALHEKAAEDTVKCKESTGTKGRRPYADAILNDVEKRCGFTYLTDSDNRSVSILDTSEFPSDYKWGTARHSEFAVILDHAARRISVAHSWIKLAEAERDRCEEDAAKVYDLPDKVKEWLDTFCSNRSDISGAQGEGYRIRRKAIEGWKEVVASWGRSSCITAEDRVAAARALQDDPEIDKFGDIQLFEILAQDEALCVWHKDGDVAKSPDAQMLIDYVLASDAESKKRRFKVPAYRHPDALLHPIFCDFGNSRWDITYDIHGARGKKKAKRGSKKEEAMPRGVAMKLWTGSDVLSVSLRWQSKKLAADLALDQEAEEVTDTAAVSRADRLGRAAAGIDRGAGVTIAGLFEEAHWNGRLQAPRQQLEAIAAVRDNQKLSSEERERRIAFMKDRIRWLVTFSAKLRPQGPWHSYAPTQGLQSDPKYWPHSEINKKRKGQAKLILSRLPGLRILSVDLGHRFAAACAVWETMSSEAIQEACRLANHQLPAPADLYLHLKRTVQKNLIDGEKTVEESTVYRRIGADRLPDGTAHPAPWARLDRQFLIKLQGEEKVREASNEEVWQVHLMESALGLSFPLIDRLVYAGWGGTEKQAARLEALREKGWKPTGTPADQDEEGGGYKPSLAVDELMFSAVRTLRLALKYHGDRARIAFALTADYKPMPGDTRYYFSEAKDRSSGADAAEREAKHKDYLLDMLLLWHDLAFSRKWRDEEAKELWNLHIAALPGYQAPAAPIQEEAGQGRKKAREEARAKMTPAAEALLADGTLREKLHGLWKERWEKDDAQWKKHLRWMKDGILPRGGRAATPSIRYVGGLSLTRLATLTEFRRKVQVGFYTRLFPSGEKREIKEAFG

SEQ ID NO: 61698 - protein, 1240 aa, Unknown
  Microbial Source -  Accession No. Ga0116210_1003377
MKIKGYRLHKERIKFTSGTTIRSIKLPIKEFSLNEDKKELILKIKKQVKNDDLLLKGDVNLNDYAQKGFRGNPSYNFFDFWVDSLRAGVIWKKTTNELIDFVNGKLSKKDIIGEILIKASDKFLKYFDIANQDLKNFFKLSEVRANKNKQSLSRSLVSYLKQDYKKKKDKYDYEIINSDAQNLINFIVNSFFDNQSLLKLKGPQKQNQFWLKNFGIDKTKLKQFRPQGELGNISFVIVPQLISIDKDINIVDLIEKRIHFLERLNLNNDNEIKSILGLENNFSALSNYLGIIFKKLYQGEIEEIFQALVFIYKDLEDYKNVAFKSLNFLKEKAKLLSPEPSLEFISNWADYRSLLGGKIESWLSNYLRRKKEINQQINDFFNGLDLTKKFLIENKNYKKELKDNDLDSILKIIKEINQFGNKDLNNKKNYEIFDSFLSILKSDLNLFYQKYLIDEKNEIKVDEFSPFEAIYKKIYKPVSFYGEIKRENNDKNLRLVLPIIKTGLEFSKLMINELTENFSFNDDDDAEIFFRKLLNFYHQKILTKSINSNDFKNFFIDILVHYISEEDKKNIFKKNRVFYKSDYSKGTQSLFKLINTEFSQEFKKLIFKIKDFLASFENDYILINKDLLLDWIETFKNLSSILIKFSINNDFDSKIFEPLLKNYLKIKIYYDVFNPPDFDKNLFTKLWQQFFLSEFKGAAILYSKKTYLARYVSQFIGSENKIKIFFYSSNQDLLEKINDFENIDNDVSKNLVNKRKYLISFDENLKLSTKRKLETDVCLIKLSKNLNQFKKVYIKKESFDNLFEITSSYYQLQFLDRLFYKPKDWRNVDIKLSEWNLILEQDYEINWKLEANKAEFIKKENSKKNKLYINIPFEISSKNLVIKFKQLDNNRFAYPICGIDVGEYGLAYCLIKVGGNQTNIIDKGFFEDKNIANIKDKFAKIQERSRKGIFNETDSTIVQVRENAIGALRNQIHDLVVKYNASPVYEYSISNFETGSGRTTKIYNSVKRSDVFEEGSEVSVFLKTQIWGIKKTIGRNVSSYASSYTCINCKRSLYELNFQKKHLENGEVIIVVQKRQGNIIYFQINNNLIICGYSDKNKFVNNYQLKTRQDLDDFNKALKDFTRPPVKSNSEVLVKFANDLTMKKLKKEDKELSFIDVFRKRRGNSSIFVCPFDDCHFVADADIQAAFIMAIRGYIKFLKGANNNNQNNDKNRQKIDYFKETLIFLKKLQLQEDIFYPSID

SEQ ID NO: 61699 - protein, 663 aa, Unknown
  Microbial Source -  Accession No. Ga0123519_10000481
MGRNRGADRAAMGDHARGRDAVGDLAQLRLTRRSAPRSADQRRIAMATRNCRYGLLAPVEGRDEVMRQLRVAHEVYNTLVQYERERRKAVADATRETDAEVARLEAEVEGLLSRLADLRAAIQAARAGGGDNARLAEAQAEARECRRLLGEAKGALRETKRVARQNPALRERLEAIKAEHHRRQLALYHEVVEVGKRLYWPSWNDTKAAVEQAAKKTKNGDLRFRRWTGEGSLYTQVQGKQPVCETATSRWVRIDPVPPEAHDPATPRGERRRLCRTRFYLRIGSTGPREDPVFAVFPMVYHRPLPEGAVICGARIVRRKNADREYWQAVVTVDLPDEAAQKSGPRVCALDIGWRDRRPGGSDEPPPLRVAAWYDGDRTGEVLVDPSVFERCAKADAIRSTRDRMLDDLRAWLCEARKDLPEHLAEALAGCGLWRAAGKFARLRGLLSSGDVPAEVRDRFLAWYHRDRHLWQYEHGMRLNAIRDRDNAYRIAAKRFAQEYDVLIVEATGTPQKERDPKAPAAMDLRPLIKEPDPEDAPPRDQQRERKENKAHHQRFIAAAGTFRRYLLEAAAKYGTRVVMVPCEQTTLECWVCGAKYEFDRWPLMHECESCGTTWDQDQNAARNLFARGAVAAKGPGPLEVQGKPRLPRWHKRHKAYREGGAG

SEQ ID NO: 61700 - protein, 792 aa, Unknown
  Microbial Source -  Accession No. Ga012519_10002165
MATKSFEAKIVCKPDEKYTAEQKKQFLWFTHQVFNDGVRKVIPYVFKMKRGELGPEFQAIYYAITSSQDAIGKLEAVINPDWTSGKIGKSDPNKWKELLKYQELEKGFRQRLKEEGIKSTKKFRKELEDEKKKLAKEIGQKDIWADAAAILRNKNLLLFNRDELLPNLPSEFRRKIYEMTIQLIHGHQELVANWEDEHAEWLIEKDKWEEEHPEYMNVRPIFEKFEKEQGKVKGSRIRWLAYLDFLSSKPELANWRGKAKETIPLTKEERAGFRKPGQHFAAFFNKNPELQELDRLHKEYQEKFARTQSKRTPHPDGFKHRPTFTLPDAMRHPVWYSFKGATDPTKGSTYRNLDLENCTLDLKVLTAMEGEGRNPGGMIQYAFEPDERIKGFRYVGTTEKGKRAKGYIYYDPILEKERPAKIQGIKLVFRPPRPDGTAYLIFSCQIEDEKPKIKIWKDKEEESPGEITKRKKTEVYPPELITLAIDFGQRHLGAITICKNNNGRPEPIRFIPAYPKRRKDRESKPVSAWLAKIPGLTFNAVGMHEKEISAGMSRRFQDPKSIRQAGEKEGRKSKGQHIPETETPWAHLREHIANMKEDHYKKAANLIIRTALQNGAQVILIENLRNYRPMLERTNLENRRRMQWAVRQTAKFLEDTARPLGLIVRQVSSAYTSRFCSSCGHPGARVSLPGQKNWEKFYAEKYGKERKMIAVAGGQFFCCPACKKIINADINASLNMHKVFYQNFIWPGKIDKKDTKNFIWQGKNYNWDQIADDVQSFLDQKAGIKKEDDIPY

SEQ ID NO: 61701 - protein, 1481 aa, Unknown
  Microbial Source -  Accession No. Ga0123519_10002912
MPKQNKPPVTQRAYTLRLRGTDLNDQSWRDALWKTHEAINKGAKAFGDRLLTLRGGLDHSLVDTKVKGGKGNPDRDPTDEERKTRRILLALSWLSVESKLGAPENFIVASGEESAQDRNNKVIAALEEILKSRGVAENEIDQWKKDCSASLSAAIREDAVWVNRSKAFDEAVKSVAFSLTRDEVWDMLERFFKSPTAYLDPAKGSEHEYSETEKEEKAKDIVQNAGQWLSSRFGTGKGADFSRMAEVYEKIAVWAGNAQAGTTWNEAIRNLAAALSKFSPKTNDLQGVDGLISGTGHKSRTKNLLKVLAAKSEVTIQDLEILKNNAAEDARKCFQKKGSKGHLPYSDAILRDVESVCGFTYLQNGGPARHFEFAVMLGHAARRVSLAHTWIKRAEAERRRFEEDAKKMDNVPVKTKEWLDEFIRERSGFSGALEPYQIRRRAVDGWKEVVAAWSKAVCKTAEDRIAAARALQDDPEIDKFGDIQLFEALAADDALCVWHNEGNATNAPDPQPLIDYVLAAEAEFKKRHFKVPAYRHPDPLLHPVFCDFGKSSWDIKFAVHSFSKKRGRSNNRMTESNDLHAFSMTLWTGVRMQPVSLYWQSKRLARDLAFGKYVRNEGAIAVTRADRLGRAASNTSNNDLVTIAGLFEQEYWNGRLEAPRRQLEAIARYVEKHGWDDQAEKMRDQIKWFVTFSAKLQPQGPWCAFAQKLRLSINPQYWPFADANKKRKAHAKLILSRLPGLRVLSVDLGHRYAAACAVWEALSSEEVLQACRAVGHEDPKESDLYLHLKKKVTKQKKGNPVEVEETTIYRRIGADKLPDGTPHPAPWARLDRQFLIKLQGEEEGVRQASNEEIWQVHQLEAALGRSKPLINRLISSGWGITKNQQSRIEALKKLGWCPPEQPESGDVSDADEEEITYKPPLSVDELMSSAVRTMRLALKRHGDRARIAHYLITDEKTKPGGVKEKLDANGRTEMLQDALVLWHDLFSSRSWRDDAAKQLWDEHIIKLTGDKLPEEIGEDASESERGKKKKENREKLHDAAKALAEDESLRKTLHDLWKTRWEEDDRQWKKHLRWFSDWVLPRGKAADDPAIRKVGGLSLTRLATLTEFRRKVQVGFFTRLHPDGTRAETKEQFGLSTLDALERMREQRVKQLASRIAEAALGIGSQDKRHWEGGNRPRRRINDPRFAPCHAVVIEDLTHYRPEETRTRRENRQLMTWSSSKVKKYLAEACQLYGLHFREIFAGYTSVQDSRTGAPGIRCQDVPVKEFMRSPFWRKQVKQAETKLSENKGDARERFLCSLNAMWKDKAVTDWERAGVVRLPLKGGEVFVSADPLSPAARGLQADLNAAANIGLRALTDSDWPGKWWYVPCESSSLRPVKEKVEGSPAVNPTQALPQSAQKQSDGAGAKKKRKGSGTGKPKEVVNLWRDVSSSPLDDPNAGEWKEYTAYQNEVQWRVVRILEEELKGRFQRLYEGAKEDGIPF

SEQ ID NO: 61702 - protein, 1338 aa, Unknown
  Microbial Source -  Accession No.  Ga0123519_10003344
MNKKSSNSTGYRLHKDRILFSGGEIMRTIKYPLVVEKNNLNSEEIVEKIRQAIINDDRVIRSDINLNDYIEYTKKGNRLYTLIDFWQDCLRAGVIWQPSTSFLLYLINKLYSKPKAIELIENAKPDISRFFDVDKFSKCFILPGEIREGKILKTFKRELIEALKGEFKKGKKEKIKDEDDYLEKFVEKDARKLIREIADCFFSNDILVTHDLKEGKKEYQDRLWEEKFGIKKGKLLENFKLPDHLRNFKNISFFIIPELSDKSKNFDELIELRRKWLLERKICVREDGDYLENEKKLDEELRNLVGLSDNCNPLSNFLGTVFCELLVPNNLNEDNALEKFYDVFTIVEPKIAELNIKDQIMGSLEFLRLRAKQLGSPNLVNFSKSQNLKANESIKLDGWSLYRQNFGSKMQSWFTSYIERNKLLEDSLKNFKEKIKKAQNFIKNLKNISEEPQQEEEAQQEKEEIVELFEKIFSSLEKVNRENFEVFDSLLSSLRKRLNFFYQQYLYNEAKEGDDVKKHKILGPIFKNIEKPIAFYGETQRKKNEKFVEDTIPILEEGTVFLTTLISNLLDSFSPKQVFPDVRKKDETEEIIYRKELQFFWNKLKDLAVNSKEFEKEYQDIIESAVDESELSKLKELFVNKKKNGSKYNKYTFYKSKYTKGSIEEIKLKGSKEEYLLRFEKLIKSLTNFLTQFNRNKLLQDKDLLLDWVELAKNIVSVLIRFSTNTEFSLNEIKAQSQFKKAKNYLELFKLKKAKKKEFGFIIQSFILSEIKGAATLYSKRKYIASYSVQIVGSNNKFKLFYQPLDSSINISGGPKDFVTKKHKYLIVFQDLKNVKNKDATENRINLLRLNKERKIPLVAYKDDLVSKSLLLSSSPYQLQFLDKYLYRPRGWENIDIKLNEWSFVVEEAYDIEWDLNSKTPKLIPSPKSNRNKLYLAIPFTLKGNVKEPPLDKIVLKSETKKDHSRDKNRLNYPILGVDVGEYGVAWCLTKFDYNQDFSLRDIDIQGKGFIEDRNIGKIKDYFAEIQQKSRKGAYDEDDTTIAKVRENAIGKLRNAIHSILTGSLEGASPVYEDAISNFETGSGKTIKIYNSVKRADTEFKSEADKAEHSLVWGKKDRNQETKYIGRNVSAYASSYTCVNCLHTLFKVKKEDLSNIKILEKDGRIVTMSSPYGPDKKVRGYLSEKEKYEIGYQFKESEEDLKAFRKIVRDFARPPVNKNSEVLEKYAKEILAGNKIEEFRKKRGNSAIFVCPFCQFKADADIQAAFMMAMRGYLRFSGIVPSKENSKNNPQESEDKSLKNSKKQSETGDTFLTKTAEYLQQLRFEIKEKIKEAVKVDF

SEQ ID NO: 61703 - protein, 1520 aa, Unknown
  Microbial Source -  Accession No. Ga0123519_10003852
MAYQNGKEQPTVTNQRAYTLRLSGTNDQDSIWRNRLWHTHEAVNKGAKTFGDWLLTMRGGLCHTLAEADVPGKGNKPARHPTPQEIRSRRVVLALSWLSVESQHGAPERHLVSHDLDIATGERKNWKTVEALREILHGRCLCKELIDEWANDCRDSLSATIREDAVWVNRSKAFDLAAKKIGASLTREELWDFLQPFFANKHGYLQMDTVAGVTNGDSETDAEEAKEDSSEEKAKDLSQKAGQWLSSRFGTGTGADFSRFSKVYEVLAARCGSVAVGVSGVEAIRILAGTLADFSPGSNDIEGMLGLMSGPGYKSATRNILQKINTLQTVSQQDLDRLREASEKDALQSKQKVGGKGSRPYANAILQDVEAACGICYAGTGESPARHWQYAVILDHAARRVSMAHSWIKRAEEQRSKFEIEKDKLDHVPKDALAWLDAFCARRSSESGASDAYRIRRSAVDGWKQVVAAWAALPPKPENQGSELLSDAESARIQAARELQDTVEKFGDIQLFEALSLTGAKCVWQPDGRPDAQPLLDYVAGTDAISKKQRFKVPAYRHPDALLHPVFCDFGNSRWNINYAIHRAPEKLTPAQQLLEKKKAEIDKAELTLAKAGDAAKQANISEKINGLRAAFIQQQEKVAWLNSRHAMTMSLWDGTHIEDTPLIWQSKRFGSDIGQPVEAQPLPVSRADRFGRAVALAQDNVPVIPSGLFDLSDWNGRLQAPRRQLEAIAAIRDSAKLSVNEKQQLVAKRIQSIRWLLTFSAKLQSHGPFIAYAAQHGFDWRYGAHGPENKSRQGLAKLILCRLPGLRILSVDLGHRYAAACAVWETLNAGQIQKACLDAGKEAPGPCTLYLHLKQIANGKEKKTIFRRIAADTLPDGSPHPAPWARLDRQFLIKLQGEDRDARLATSEEIAAVEQMENELGVVRQLKRKGRELLVDELMSDALRTLRLGLRRHGVRARIAFNLTANKRIRPGGKEEVLDQEGRVLLLTETLLAWYELYTAERWTDEPARELWNRHIQPLLGATILQNTVNQEDTPSAAKRRKLREETSGKLKHVAEEIAKNDSLCRQLHVLWSAQWQTEDVIWRTRLRMMRRWLLPRGVKRNAQLRISIRDVGGLSLTRIASFKSLYQVQKAYQMRPHPEDPRLNIPERGDSRLENFGQRVLDAMERMRENRVKQLASRIAEAALGIGGETGISSKDGSQKKRPTERSSDPRFAPCHAVVIEDLTHYRPDETQTRRENRQLMSWSSSKVKKYLGEACELNGLYLREVSPAYTSRQDSRTGAPGLRCNDVTVVEFNNSPFWRKQVGAAEKNQKEGNKGDARERYLLSIEEGIRGAANDRDIFRIPVKGGEIFVSACITDGGNNAKKNAPPGLQADLNAAANIGLRAIFDPDWEGRWWYIPCDAATLCPDAKKFIGCKAVDPTKPLRVVAEEGAISASGIGSKKSGRKKNAATDGTRIVNLWRDPSGAPIHRDVLRSPEWQDYAGYWNEVQHRVIRNLKTCYEQTSQQEDPFVSQDADKPF

SEQ ID NO: 61704 - protein, 1519 aa, Unknown
  Microbial Source - Accession No.  Ga0123519_10021143
MDLTQRAYTLRLEGVDPSDDSWREALWQTHEAVNIGAKVFGDWLLTFRGGLDHTLADKKVKGRGGKDVRVSSDEERRMRRIFLALSWLSVESRLGAPDKFIVATGEEDEETRNNKVIKAFEEILKKRGLSKKEIEEWKEDCKISLNSAIRKDAVWVNRSKAFDEACRDLKGALNRKEVWDFLGFFFLSPNAYLASEKSVDEEIIDSEQVDEEKDFVEKAGQWLSSRFGKGKGADFQRMAKIYKEIGSWANTARPGIGGKRAIEEMARRLSRKGFGPGLRNLNDILDLISGPGYKSATRNLLKKLSEKGTINRQDLYNLKTKAEMDAQKCEEKIGKKGHRKYADFILDKVERSSGITYFADKNGFNIPISDRNKFGTKILLGASRHREFAVMLDHAARRVCSTHTWIKRAEANRRKYEDDANKMKSIPSTIKEWLCDFCENRSAALGASVPYRIRRRAVEGWKEVVDAWSKDGCNTTEDRIASARRLQGELENFGDIQLFEALADEDASCVWHVDGDPKKAPSHQLLLDYVAAEEASFNMQRHKVPAYRHPDPLFHPVFCDFGNSRWSIKYSVHEAKKTRKDPWKEVDKRRREVEKAKNAAQRCSNDGEKKIKAEEKLRLAEMLLHEAERELEFLASPKRVCMKLWNGINLQEVQMLWRSKRLDKDLAIRCGNRGPHAIQVSRADRLGRAAVNASKSDSLQIAGPFEQRCWNGRLQAPREQLARIGRRVERHGWDKKSQMMKRDIKWLLTFSPKLRPLGPWLEYGGKEKIKERQEVEEKGGRGNDARLLLCRLPRLRVLSVDLGHRYAAACAVWETLGEEDFKREIKGRKVLCGGSSGECMYCHTLHRDREGKVLKTIYRRIGADTLPDGRPHPAPWARLDRQFLIKLQGEREGAREASVEEIWKVHELEARLGRTKPLIDRLVAAGWGQTPGQKKRLRILEGLGWKQTQGVVDVTKDNEMSYKPSLSVDELMFSTVRTLCLALGRHGDRARIAHALTADYKKMPGGQRYYFNRAEDASVGDDESVRHEKHVEYILDALLRWHDLFEAKGWQDEEARELWDKYIANLSCCLEVSEMDDSLTDAELKKRRKDFKERLRPVAEAIVKDGKLRKKIQQEWKRRWERDDEKWREDIRWFKHWIFPRKKQAGPSIYRMGGLSLTRLATMTEFRRKVQVGFFTRLHPDGTTGEIGEDFGRKVLEDLEVMREQRVKQLVSRLVEAALGIGSEDLSHWEGQKRPQQRIEDPRFSPCHAIIIEDLTHYRPDETRTRRENRQLMTWSSSKVKKYLAEACELHGLYLLEVPARYTSRQDSRTGAPGIRCSDVSVAEFKNSPYWRKEVARAKAKNEKNQGDARDRYLCELDAQLAGSGRLKNVRVPIAGGEIFVSADTGSPATKGIQADLNAAANIGLRALVDPDWPGKWWYVPCDSSSFKPINDRVKGCKVIDTQESLKEASPGLAVKGEKNSEKKRQRRAKHREVVNLWRDISAKPVSAAYGPWDEYSVYWNRVQDQVVKILRNNLALSK

SEQ ID NO: 61705 - protein, 1026 aa, Unknown
  Microbial Source -  Accession No. Ga0123519_10027137
LILEGKKQDNFWLNEFGIDKSIIQKTKPEGELKDITFVIIPELIVDSFNKEYEVDSLIEKRRVWLKKRFNKEKEIEKNLQLILGLSNNFNGFSNFLGKGLRAFQGGKILMIFEAMSKINPSIKNQENKEKVLEALNFLSDKSKFFPLRPSLNIVKSWADYRTFFGGKLQSWYSNGIRRKNELKVQVKEIYEFLTKAQDYLAAKISFNDENKRYARKELESINLKINRLKQFIENENFDISSEDRYLIFDTLLSSLRTQLNLYYQKYLSSEEDNIRENKDLKGIYQKIYKPIAFFGKATKRKNKKVIEETVPIIESGINNLFSLMKKLEKTFLPKNTFSKVKNKNEDEETNLRNLVDYYQNKVSHKMLNSLTFVNKLEEVMKSVIEENDWDKLHSNKYVFYKSEYQKGALELIPLKKGSWIDIFEKIILEMTSYLLTFDLTDLLKDKKILLDWIEIAKNTLAKLIKFNTCDVFTLDELNLDLRNFPKAMDYIKIFKITKVDKNELNFIVQSFILSELKGAATLFSKEKYLAKYNVQVINADKKFKLFYKPNDGFIEREVDRKNLLKPHQYFVALDKIEDKKIKEKANFLLITKEDIKPVFIKEENFSKLYKISSSFYQIQFLDKFIYMPEEFKDLGIRLSEWNFVLEREYKIDWDLCTKRPKMTFIENSKKNKLYLSIPFNVFYKSKKKDVSLSKVISNRLSYPILGIDVGEYGLAYLLAEFSDKKIKILKKGFIEDRNIANIKDKFAEIQLKARTGIFNEEDTTIARVRENAIGNLRNKVHYILTSDRGASIIYERSISNFETGSGRTTKIYDSVKRADTEFETEADKFIHNHVWGKNTKYVGRSLSAYGSSYICSKCHRSIYQFKKEDLREIKLLMREGNILTFLTPIGKVWGYSKDEKFKKDYQFKPTEKDFKEFIKILKDFARPPVGKNKTEVLEKFFLKDNDKKAKIDEFRKKRGASAIFICPFCGFIADADIQAAFVMAVRGYIRFKESQIKEENKSLILEKTINYLKEVQFKPEDIFLPF

SEQ ID NO: 61706 - protein, 387 aa, Unknown
  Microbial Source -  Accession No. Ga0063162_10057643
VETIKLCVKGVISPRDIGLEKLMHEYTVYKRVLIPRTKHAVREVIKDRSIVVYAQQKWELDKKINEYLKNLSFHPMPFHNQSVYIENGNGKFWIHFKTKEGEAVCHLHVPAKYKPLIEKSCGSGYATNPVLGQVELIEDEKYGWINCHITLRLPKPKPYEPKGWLGVDVGWNKLATSILATTNPHLCFNNPTVHGKLFKTRIIQLKYLLKDYARKRRAWKKWNFRLKQTVKYATGVVAKEIVTKAKKHKAGIVMENLTFQSQTKKWLIPRYKLMIAIKTLCEREGIPFKLVPPKHTSIKCPRCGYINNENRKGERFACQKCSYEADADITAAMNIAAIAVGLAPTVKEVRLYAEASGDVATPLSPMVDDLYEDEGKPSKIEMRWAKS

SEQ ID NO: 61707 - protein, 332 aa, Unknown
  Microbial Source -  Accession No. Ga0123519_10064432
MAIPVRCDKPGQKRLEKTNDGQVEVDLMICTHPYPRVVLATQDKSLGKGARTILAHLLENKDQSKNGYRQRYFEIKEDKLSHKWFLLVSYDFPASTPSLSKERIVGVDLGISCPLYVAINNGYARLGWRQFHALAARIRAIQNQTIRRRREILRGGKTIISDDRARSGHGLKRKLLPIEKLQGRIDRAYTTINHQFSSAVIKFAKDHGAGMIQIEDLDGLKEILSGTFLGERWRYSELQQFIKYKAKENGIEVKEVNPQYTSQRCSQCGYINEQFTFNYRQEQRQKLGKPVPFTCPECKYEANADYNAARNLATLDIEQLIMRQLDKQGIKN

SEQ ID NO: 61708 - protein, 975 aa, Unknown
  Microbial Source -  Accession No. Ga0124943_1106748
MKSLAQFQNLYALQKTLRFELKPEGHTRETFNRWLEEIEKEQASENENIVYQDLLRAKKYEKIKIILDEYHKDFIEQALAYANLTELEKYEELYRKSNRTSEEEEEFENTKESLRKQIANIFIKNPNKTVQERWKFLFSKKLIQNELIVWVKGNYELLSEKLKNEFPDESSIISTIEDFKYFTTYFRNYHENRKNLYSNEDKFSTIAHRLIHENLPKFIDNIAIYQKAKAVLNINEVEKELGLPEDTLDKIFSLDFFSKALTQKGIDQYNYFLGGKTENEVKKIKGLNEFINLYNQQQQDKNQRLPFLKVLYKLPLFERTSTSFRFEPIENDRDLIERIGKFYYNDLKQYRDDSQGDTTDILSGINTLLRHVHDYRDGLYVNGGITLTQISQKIFGSWSYINNALAYFYDTYIDASGVDHQGERKPKKQKQIQEKTKWLKQKQFPVILVEKALSEYKSIETNEDLKTRISDTTLCDFFKRCGNDDNGQDLFDRIEARLREKNEEGYSLEDLLKKEFTTERKLMQDKTKTLLIKNFLDVIQGDKDDITAGLLHFVKCLIPRTEISEKNELFYSGMEKYLNILSEVTPLYNKARNYLTQKPYSIEKVKLNFENSTLLDGWDENEESDNSCVLLRKRGYYYLGIMNKKHNMIFDRKIYPKATEGEAYYEKMIYKLLPGAYKMLPKVFFSEKNIDYFKPSEEILRIRNTASYSKNGQPQEGYQKASFSIEDCRKYIDFFKKCIANHWDWQKFNFNFSPTEYYQSIDEFYREIERQGYKIDFVKIPESYINQLIKENKLYLFKIYNKDFSEKKKSKGKDNLHTLYWKMLFDEKNLKDVVLKLNGEAEVFFRQKSILYNEEIWNKGHHYSELKDRFSYPIISNKRYAEDKFFLHVPITLNFKADGINNVNNMVNEFIKDNRDIHIIGIDRGERHLLYVSVINQKGDIVEQCSLNEIVTEYNGKIFKKNYHEELDNLEKERD

SEQ ID NO: 61709 - protein, 922 aa, Unknown
  Microbial Source - Accession No. GA0124945_1030784
MHLELTIKGSENPKKQKQIQEKTKWLKQKQFPVILVEKALSEYKSIETNEDLKTRISDTTLCDFFKRCGNDDNGQDLFDRIEARLREKNEEGYSLEDLLKKEFTTERKLMQDKTKTLLIKNFLDVIQGDKDDITAGLLHFVKCLIPRTEISEKNELFYSGMEKYLNILSEVTPLYNKARNYLTQKPYSIEKVKLNFENSTLLDGWDENEESDNSCVLLRKRGYYYLGIMNKKHNMIFDRKIYPKATEGEAYYEKMIYKLLPGAYKMLPKVFFSEKNIDYFKPSEEILRIRNTASYSKNGQPQEGYQKASFSIEDCRKYIDFFKKCIANHWDWQKFNFNFSPTEYYQSIDEFYREIERQGYKIDFVKIPESYINQLIKENKLYLFKIYNKDFSEKKKSKGKDNLHTLYWKMLFDEKNLKDVVLKLNGEAEVFFRQKSILYNEEIWNKGHHYSELKDRFSYPIISNKRYAEDKFFLHVPITLNFKADGINNVNNMVNEFIKDNRDIHIIGIDRGERHLLYVSVINQKGDIVEQCSLNEIVTEYNGKIFKKNYHEELDNLEKERDRARKDWQTIANIKELKEGYLSHVIHKISKLILKYNAIVVMEDLNSGFKRGRQKVEKQVYQNFEKQLIEKLNYLVLKESNVDEPGGVLRAYQLANKFETFKKLGKQSGIIFYVPAAYTSAIDPVTGYIQYLYPLKQADSVEKARKFYSQFKRISYNPHKQWFEFSFDYNDFNIIYHGKSSWTICTTNTERYMWNRLLNNGHGGEELVYVTNELELLFGEYNIIYGDGKDIKQQITDVQDIDVDRTAKQFYKRINELLNLTLKLRHNNGKKGADEEDYILSPVEPYFDSRFESRKPSMQQTLPINADANGAFNIARKGLLLLERLNQLGVEEFEKTKKSNNKKTQWLPHELWVEYAQNHTRK

SEQ ID NO: 61710 - protein, 409 aa, Unknown
  Microbial Source - Accession No. GA0133944_1001807
MKLVQRHLIKRTNKYFSEIDNLAFLSKNLYNCGIYQCRQAYFKGEKPPTMTDLHHNLKTSIDYKALPAKVSQLVLKQVEKTFKSYLAAKKEYYKYPDKFTGKPKLPRYKDKVKGRNILSYNYQAVSQKLLKQGFVNPSGTNLKIPTDIKEITEVRIIPKVGAYCIEIVYEQPEIEQSQNTHYAFIDLGLNNLAAVTSNKPDFQPSLICGKALKSCNQKYNKTLSRLRSQLPANQKSSKRIQGLTLKRNCKVDYYLHTASKYIVNLLVSNQISLLVIGQNQCWKQNINIGSRNNQNFVNIPHSRFVEQLTYKCQLSGIEVKTVNESYTSKCSFLDLEPIQKHSSYVGKRVKRGVFRAKSGYLYGADINGSLNIGRKVVGEVAFSGDPIERFVVNPVRVKAYKETCGHICP

SEQ ID NO: 61711 - protein, 406 aa, Unknown
  Microbial Source - Accession No. Ga0134095_1000962
MCCKSYLLKIDKSHLNKKVAKQLNLLFLESKWFVNHAIAQGVFDVDYKTKTVLVKKGEGFEERKIQVLSSQMKQALLENLKKDIKALSIKKKNGHKVGMLKFKKFIRAIPLKQFKVTYSLCGKNHICIQNIGKKLRVRGLKQIPEGVEFANAYLIQECRDYYLRVVTYCLPDKNQQTEDKAVGIDFGVRNQLTLSNGISIQYRVPITKKLKKLYQKLSKKQKNSNNRYKARVKVQKEFCRLNRIKDDIKNKIVSCIKNNYSIVCYQNDSIKLWQTWWGRKTFETALGEIKNILKERISTPIALKREFPSTRRCFCGTENQIQLDEEIYSCINCGLRMHRDLKASISILLEGLNQLPTERREAALQYAERKACGEESSTLSMFEYLNSIPHVRARLLVETGSLSALA

SEQ ID NO: 61712 - protein, 855 aa, Unknown
  Microbial Source - Accession No. GA017716_10003017
VVASRYREARTLVRRLGRLPGEGEASFRAKLARLRKHFERFNVDVSELCQWLMGLRKQHCHKAGTASFGVLGDFLLHPESSNVAPGEAEADRWRLLVFDAVAGICPAKQLTNAPMPRGLPEAMEREAKRLADLEWRRRNTTQSKLIDRLAILEPAHRLVLLKAAAEWVVSRYQRGLENWAARRGEWEKERHAWEKRHPALSEEVRQRFTEVFKSLNDPERTDKPGVRRKNPRICPYERLRANIDNCIYAGEKGHGALCWKYAEFVKARKTRQPQFNDKRFAEDAEKVLPLLKQGMKRHQALQRLFPRDRPHGQLAQQRFNENWTAYLQALGLKEERVVNRGRLPHCLKIGETHEKSKCAWNPHTELCKQYKRALDQFDEETLKLEPLYREWRRDYLAGPGKPQFRYPSSRELPMPKIFGAGFHEIDFDRSILRLRLEDMPEGEWIEFGFAPWPRGYRPSKEEVKVKGAISSVHVNFVGVRARAGFRFDVRHRASRFQCTQDELDQLRSRAYPRRAQDREYLDAARKRLLESFAEGEEAAKRELRLLAVDLGETGACAAVYHGHAHQKDVQLAILKINRLYTQLPEALEPDPHGRPEEGKRKYERDDPRGVRKEHMGRHLKRMADGAASIAARRQGTMPATVTMAGHDFRGLKRHVTWMIRDWARHNAARIVAAAEEHGCDLIVFESLRGQKVPGYHELSSEKERDKRQLAMLSYGRIRHKVREKAVERGMRVVMVPDYRSSRLCSSCGHEQCAEKWQERRWRENKKKRLFKCVCGEPAPTEKPHHGGSAPDRQRAARRDGPGPGKRPGMAADQAKQRCRCGAEMNSDANAARVLARVFWGEITPPASERSFAGSA

SEQ ID NO: 61713 - protein, 439 aa, Unknown
  Microbial Source - Accession No. GA0137716_10003038
MPTINYRYGLLPPVEGRDEVMRQLHVAHEVYNTLVQYERERRKAVADATRETDAEVARLEAEVEALLSRLTALRSEIQAARAGGGDNARLAEAQAEARVCKRLFGEAKGALREAKRAARQNPALRERLAAIKDEHHRRQLALYHEVVEVGKRLYWPSWNDTKAAVEQAAKKTKNGDLRFRRWTGEGSLYTQVQGKQPICETATSRWVRIDLVPPEAHDPATPRGERRRLCRTRFYLRIGSTGPREDPVFAVFPMVYHRSLPPDAVICGARIVRRLNADREYWQAVITVDLPDAVGQKSGPRVCALDIGWRDRRPEGSDEPPPLRVAAWYDGDRTGEVLVDPSVFERCAKADAIRSTRDRMLDDMRAFLSEARKDLPEHLAEALAGCGLWRAAGKFARLRGLLSAGDVPAEVCARPVSRVVSPRPAPVAIRARHEVERDP

SEQ ID NO: 61714 - protein, 456 aa, Unknown
  Microbial Source - Accession No. Ga0137716_10003531
MGNVKAGQLAGVRVVTLEISGLTKDDIARWRALMDDCRGIVNCTWQTWLVWHVQNGTRAKLQAYLAEAKAWHEGGKQGKKPEWPVKAVTPECAKLTYDEVSAAFPYIETTARELCRNAVIQKINNTKAAHGSLSGWVAILLHRQSLPSTVRSVPIPFSKRNAIIEPPDPADENGCWKLHVKVTRRPRPGKKAGETVTDTVKLWSKGRKAASAVATLKKIAAGVYEFCGSQIIYKESRRKWFAAICYRASIEPPKKLDKEQVAYLRPAPMSATWPHPWRLRVPGANRAPGGCGDWIASVRRRIFAERRSRQNSYRYAGSANKGHGRERALRPIWRLQNRWKDSVKTYNYTVAKDVVDQCVARGIGRLVYFQPGDRVRDSRFLTVSGCGEGDHWAGWDYYQIGKRLADLCQAQGIDFVWRKPSEHPREVGGNVEKTEAKNGTVRNAARKRKASAGLHG

SEQ ID NO: 61715 - protein, 685 aa, Unknown
  Microbial Source - Accession No. Ga0137716_10006890
LDNLFNKYEQLVRITDSFIYHLYPYYANINEQGNLERLKELIKSLDEKAIIKNQRRKREPQKAEEQTTTETETKHQYTHSYLLKTLLHRFIKYAKKYYAKYYAKKHYAKKHYAKKYYEIDVDVKHAYLDTQGGLTDIMHSNAESAYKHRSIPNLRGLSNVMPIRVSKRPLLENRRSKDNDKYYKRTAEFIFNNGKIMLRIGSQRNGLIKIAKRFNDIEKLGMLIDAIQGKNNLTIGDPCYLVRKEIDNGYRYYIMVSISKNVDKKALHEASKNKSKIRIIGIDSNISKYIATMFCIEVDKENKTYKLINAKGIDSKDYINAVKKYEEERRKLQQERMKGKVNKKKGSRYKEEEDYTIKNRCGDSKRIDLRRQLIGYICNQILEFANKNDADIIVIEDLKGLNKELKHLRIIKKELGKLYNDVNSKGNNAIDDKINEINKKYNNKTRRPLLELLDKIKEYSNNNRDRIKVAKYVIKQKRRVERRISLLSIMAYYQFKQELEVEALWNGKLLYIINPKYTSQQCLRCDHISKLNRITQRMFKCIKCNFEMNADFNASANIALRFAREILKLDLKQEQGKSSSMMTVTNATTPLHASINAGSKVGVVVSNNNTDGSVAPTMSGVASILQGCDEGRSLFMRGQTLTVKGGIFTALKGRSLFMRGQTEQPCSAKRFATLDEFLEKRGNGG

SEQ ID NO: 61716 - protein, 519 aa, Unknown
  Microbial Source - Accession No. Ga0137716_10009026
VRSFKIPLKHKDTSVLNAFSERVRQDYISQVGLVNFSDWFEHRGRQWYSLADFWLDSLRAGVVFAHKEAEIKNLIIYLNGDDSVLTRFDRVVRERYPDLYGLVSVKPLYEFCISDTRPGNKSFNELLSSLRNRLFPNYRNVENNDVDEWVKRFAGWVYGDREEGEDGERTRRERRKAKVIEFLGFDPFPQMEYDHLFYFHPLIPMNKNASPKDLLFQYKDVLEKSDPGLYGSDIPIQEKLKMAFGLFNNHGALAGYFNQSLSALAQGDPSIKRHIQSTSTYWQSYEDQLDERISFLQSCAKKVSEPILAKGWHEYRSSIGGKIESWVSNTLNQDEEIRRQLFGYEGENGSFEAVVKQTLLDVTQDVTLGENGVAVVSESSKTIARDCLAIIGDDCSRSPSDERLFLLRKLIGGLRVRLGEEYQIAFRELQGTNEKEREKEAKEKRAYKKYPVIFKDIRLVPNFLGETKKKAYEKFVGSAALLKEGIAFLASIDEQVLRATPSPRFESDAELLEFALKQC

SEQ ID NO: 61717 - protein, 1262 aa, Unknown
  Microbial Source - Accession No. Ga0137716_10009341
MAKRKSRLAGYRLHKERILFSGGQVIRTIKYPLVPLGPSEETAQFLKDFERAIIADDLKIRGDLNINDYLAHTVEGKPPYTLFDFWVDSLRAGVIWMPKGTKLIDFLASQYNANSPFDDVWEKASPRITAIFKKDKFKDIFLSDPIRNTSTKNSFYKRILESLKDDLVKENIIISTDAKEEVELIVNSFFNDDGQLILDGESQFDFWEKEYNLDKGIIESAKPKGKYTDITFVIIPELISNLNTKQTLEDLINKRDTWLSNRELDEDNKLLASILGFSDNANGFSNYLGMVLRGLQEEDGDKEALYEAQKTIFPRLENYRDKVLESLDFLSQKAKLLGETSLPLVNCWHDYRSVFGGKLQSWFTNFQKRKEELDEQISQFKESLFKAKNYLQKENFGEEADKGKEDILSFLSLLENFFADEQKSIKIEENYQLFEPLLALIRRRLNFFYQKYLQKEGDETKVNKFKEFEGLYKTIYKPVAFYGYSAKRANEKFVNETVPILEDGIENIKKLIFCLQDSFSVQKTFEDIRRDGGEIDGPYRKFLQFFWNKYVDASINSPLFLEKYEKIIKESIEDNKWEEISDKNKKGRYVFFKSPYAKGSIEEIQLKTNDYLEQLQTSVLELAEFILSFERDTLLSDAALLLDWIEVSKNIISILLRFNTKETYKLDDLLLESFSQAKRYQELFRREDYPKNEFSFIIQSLILSEIRGAAILYSKREYIASYSVQVVNSDEKFKLYYISKEEIPITADTIKSKPDSIERKQLMKPHCFVVALDKVSEKKKNQSFNAILLSKSNITAVFLPDESLQKLFKLSSSPYQLQFLDKYLYRPAGWENTDISLSEWNFVVEKRYKINWDLQTKRPKLLPITDSEQAKKNKIYLAIPFNLSPNNQIKQSAPLKSIARGNEKIEKDLSRLNYPILGVDVGEYGLAYCLVKFDFDKNTYKITGIKLGSDEKETFGFIEDKNIGNIKDKFSEIQQKARQGAFDEEDTIVARVRENAIGHLRNRIHIVVTQEKSSSVYEDSITNFETGSGRTTKIYNSVKRADTESSTKADEQIHNHIWGEKTKLVGRNVSAYASSYTCVNCLKSLYQIKKEDLTKMTITQKDGRVVTISSPYGDIKGYVSNEEKYDVGYQFRGTDEDFKKLRKIVQDFARPPVSNRSEVLEKYAKSILETGRIEEWRKRRGNSSIFVCPFCQYVADADIQAAFMMAVRGYLRFSGIVPSQSYKEKQSQEGEKTAGESFLEQTQEQLKDIDRSRIKNAFSIRI

SEQ ID NO: 61718 - protein, 1546 aa, Unknown
  Microbial Source - Accession No. Ga0137716_10027208
VNAQSCPCRCNSSDHYFFSRCLRSEQVPTFSPRIDLALLKLLYFAYRANTLRTQNWTFLPIAAGRDPMSRGRAPVTQRAYTLRLRGVDPGDTSWRKALWQTHEAVNKGAKVFGDWLLTLRGGLNHTLADTKVKGEKWKPDRDPTDDERRVRRILLALSWLSVESKLGAPEKLIVSSGEEAAEDRNSKVIAALEEILKSRNLADNEIDDWKNDCSASLSAAIRDDAVWVNRSKAFDEAVKHIGPSLTREEPWDMLERFFGSRDAYLAPAKGSEDESSEAEQEDKAKDLVQKAGQWLSSRFGTGKGADFPRMAAVYGRIAAWADTAQAGTTGKDAIKELAAALGTFAPASNDIQGVLGLISGPGYKSATRNLLAQFDARPILTQQDLTRLNQTATADRKKCATNTGSKGQRAYANAILKNVESVCGFTYLQNGGPARHSEFAVILDHAARRVSLAHTWIKRAEAERAKFEEDAKKIDQVPKAAREWLDQFCLKRSEASGALEPYRIRRRAVDGWKEVVAAWSKPDCKTAEDRIAAARALQDDPEIDKFGDIQLFEALAEDEAVCVWHRDGDAAKPPDPQLLIDYALAAEAEFKKRRFKVPAYRHPDALLHPVFCDFGRSRWEIRFDVHKNVQTPFPRKILMVARPSVTDVHKNVQTPFPRALRLTLWTGSEMKQVPLCWQSKRLARDLDLGNNARNAGASEVTRADRLGRAASNVTKNDEVKIAGLFEEEDWNGRLQAPRRQLETIARYIEKHGWDQKAETMRDGVQWLVSFSARLQPHGPWCMYAKNSGLGLKHDPQYRPHVEENKKRKGHARLILCRLPGLRVLSVDLGHRYAAACAVWEALSAEAFKKDIDGKIILRGGTDKDALYCHTEHKANGKKHVTVYRRIGADTLPGGTPHPAPWARLDRQFLIKLQGEEEEVREASNEEIWAVHKMEAALGRRTPLIDRLIASGWGSTEKQKARIEAFKKLGWTPAQTPQPTSESAEDGETGVYRPSLSVDELMFSAIRTMRLALKRHGDRARIAAHLMTDEKTKPGGIKEKLDENGRIDLLLDALVMWNDLFSSREWRDDKAKRLWDERISSLSGYRAPEEIGEDTAGSDRKPKQKENREKFHDAAKALAEDATLRKEIHDAWKIRWEEDDGLWKKQLRWFKDWILPRGKATADPGIRKIGGLSLARLATLTEFRRKVQVGFFTRFRPDGTRADTKEGFGQKALHALEHLREQRVKQLASRIAEAALGIGSENKQHWEGGKRPRQRTFPPCHAVVIEDLTHYRPEETRTRRENRQLMTWSSSKVKKYLFEACQLHGLHLREVPASYTSRQDSRTGAPGIRCQDVPIREFMRSPLWRRQVEQAEAKLAEDKGDARDRFLCNLNQIWKDKTLAEWEKAGAVRVPLNGGEVFVSADPVSPAAKGLQADLNAAANIGLRALTDPDWPGKWWYVPCDPASFKPIQDKVEGSAAVEPDQALRQPAQEHRSDASAKKTRRKMGAGKSKEVVNLWRDISSSPLKFGEWREYGAYQNEVQCRVISILKKQCREKRLHDGSKEDDIPF

SEQ ID NO: 61719 - protein, 1368 aa, Unknown
  Microbial Source - Accession No. Ga0137716_10032400
  misc_feature (444)..(548): Xaa can be any naturally occurring amino acid
  MISC_FEATURE (558)..(692): Xaa = any amino acid
MNNNTTNQQSIWSAFTRQYALNKTLRFELKPVGKTEDFLKQNKVFEKDKTIDDSYNQAKFYFDKLHQKFINEALSSDKVQEIKLEKFAKEFFSLKDKIQKLKSDKKQKEVYGVEKEINELRTNYYKEIKSLLDKVAEDWQKKYQEIGINFSKSDLKQKGTDFLMKSGILGILKYEFPKEKEDEFKSKDWPSLFVEDKANPGNKVYIFDSFDDFTTYLLKFQETRKNLYKDDGTSTAVATRVISNFEKFLNNKKIFEDKYNNCWKKIGINKKEKQIFNIDYYYSCFIQDGIDKYNDLIGQINKKTKEYRDRNKIEKSHLPLLKVLDKQILGEVIKERELITKIETETEEEVFIKRFKEFIDQNKKRISIIKNKKDSEKEKEYLTDDLFNEKFESEYAGIYLKRSAINTIANRWFKNTTEFLLKLPQVSKSKSKENKESPKVKPFXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXCDAALRIYQMMKYFALEARKQDDIPLDYATEFYNRFDEYYKDFKFIRYYDAIRNFITKKPSNEDKIKLNFESGSLLTGFDKNKESEKLGVILRNRNSDKYFLGIINKEHNKIFDSKNESKFIGDDNKDLYEKMELKLFPDPKRMIPKIAFADKNKKYFGWTQEIQKIKEDFKNFQENKKDNKDLKFDKNKLSKLIEYYQNCLEKGNYKKEFEFEWKRPEEYQSMSEFNQDIEKKNYKIKFIPIKASYIEDKVKNGELYLFEISNKDFIWPNQKKNIHTLYFLNLFSDKNIQKPVFRLGANAEVFYRPASVRKEMDKERSKGGKEIIKYKRYTEDKIFLHLPIEINYGCPKDPNKNGYNKKIVEFLNKNKDEINIIGIDRGEKNLLYYTVINQKGEILAHGSLNEINGVNYLEKLIEREKERQINRQSWEPVVKIKDLKKGYLSYVVRKIADLVEKYNAIVILEDLNFRFKQVRGGIERSIYQQFEKQLIDKLGYLVFKDDRDPESPGGVLNGYQLVAPFDTFKDLGKQTGIIFYTNAEYTSKTDPITGYRRNIYISNSASQKKIKENLINKLKEIGWDEKEKSYFFTYNQKGFGSPISKQWTLYSKVTRVRREKNNSTGYWEYKPIDLNKEFEDLFKKYGINEKSSDILSEIKELIKNKEEKLTQKQKFDEKEKSFYERFIYLFNLLLEIRNTMSLQVKLDKRGNEIKLEEIDYGVDFFASLVKPFFTTAGVRFIGKQNENGKIEKHKKEEFTKENLTDFEELFKGCTSENFDSDGVGAYNIARKGIMILKRIKQNPEKPDFYFYKEEWDDFALKNALIK

SEQ ID NO: 61720 - protein, 418 aa, Unknown
  Microbial Source - Accession No. Ga0137716_10033855
MAVKMAIKVFKGYLRRVPADDQEGRAHRREVLGQLRQASYHAAQFANLLLSLNYLKFKFEQRGEIPDSLDKEIKRQYTAWNDRLSAAVRDAVSRSVVGKIRALGRKVMRGDVTLPSYRRRGALLVRGDRGAVQLWQDNGRVFCSLKITPEPPVVLELWVKGLKTSPGYRAVLDRLLDGTYAVKQAQVIFPEQGEVEVRLAYELPVVERTGNKVATLEIEEEALLLRWGQRRALFPHEVGHLARVKRQIEARMAKARREARRTERHGRSRFYQYRVLRRFRRRWYHIQLTWRQQLAARIIRQAEAWGVDEIELPTGGKFAEELNQLLDWSALASTLAAKAQERGLRVSQIPSQEEQEQEGRKQARKQRRSRARTGKEESNDPHQTSDAFRHGPAEPDALDGPGRRAVAGPSGPILVPRP

SEQ ID NO: 61721 - protein, 577 aa, Unknown
  Microbial Source - Accession No. Ga0137716_10038387
LTVAIKINAGDEMPEEQEKIITGVKFKLFFDNFEDKKEMNRYFDEYARAVTFAARKINEIQNSFKDTWVLDEQGKKQKGEDGKPLRPIEICNSCNEKKEIIKQEIESGKKFCLSCYSSTYSKPMIRKLLVPKTHGQEKRKVDPSINIKNAAALSATSYHYAVRDASQLLQALKEQRRKRRDFLKRDGSRLKKFKEMLDNENKRFQLPMKGRMRVPRFVHIDDKENTNLRGWRIKDLQNKVKRLQWNIDKLKRSLEKPSPIEYKGTKVSLSNDTIFDIQQNKVRIRLWKPKWYKISGSDVANRHGVEFFKDKLSKIQPKKYGWLIKKIDRNAKSSKTKTEYYNIPIKVKGTTRYISIDSINFYLQYPIEEQIEYRNPTTLMGIDIGLNKLAAVSVLPLNSNNVKPLLVKIFSGKEIKRLRYRKLKHDRMLRNVHHRLDKIKRIRSIENMINQQYHILAKQIADIADVNNSIVAFERLEDMKKKLKAEERRSQRFIRHSFVYATIRNLIEYKLKLRGLRTIEIDPEGTSYTCSKCGATNTTRPKQAIFKCNDCGVQLNADYNASVNIAKKALNTLNINK

SEQ ID NO: 61722 - protein, 693 aa, Unknown
  Microbial Source - Accession No. Ga0137716_10042212
LGTRSLKYRAYPTPVQADLLGRMHRACIALQNALIDQGRQAQARVTMEHARSVQVVRSACCGVRLRQGRCRCTGCGQPACQARDGRRCGQTETAQIERVVRSGLLLDAQTRCGACLRPCKSVSTCASCAGPLRRSRPSCPTCRAAVTRAPKDEQAQAPKDTPPWRCPSHGPVEAVAECGPNAWVCEACGPRARAADAAVSDCHRAPLRSPYRDVAELREAQKDARGALNVRVRRRTGIGLDQVPVKMLQEVLDRVDLAQQAHRKGQRGEPRFRSALRTRVSLGCPVQASPLVQVPVADRTHPALRLPVATAPGSPAVGDLRLVLHQHEAALLDGTITIKKVIVHEDAAGRWWATLQCDGVPDQGLPAAAQGRERGVDLGLQPLAVLDDGTQIPAPEFLGRALQQDKPEPGKPRRMSPLKRAQRELSRKIEAQTQRRRQMAAAGNPRPPQSKRLARAQLRVAKLHARIADGRKDFAHKLSHGLVYGGEVAPGVRLEGAERIAIEKIGVANMVRRSADPEIRDPAGLNRRDLDAGWGQILQLAQGKAAAAGALVVPVPAQRDQKAGGRQASARQILAAGQAVWSAPDEKKKSSPRSKQGGRRQGMPSLDASSRSPRAGDEDSTQAGRPPRAEGIGSTTRGNPGASVPVEASTTDILYEHRGDAHGAPSLSSSAERPDRGVLAKEPPKPRRSRGSA

SEQ ID NO: 61723 - protein, 448 aa, Unknown
  Microbial Source - Accession No. Ga0137716_10061480
MAKGKKKEEKPLYRAVRFEIFPSPQDVEILYKVSQNLSLIWNEALKERQECFEKNIKPIYEKIAAAKKKAEEAGASEVWKENLRKTINKLMREKGFLVRFTSEKESLLLELKTAFAKHKVTLYDQINSLTAKRLNEAFAFVPRNWQEETLDSLDGSFKSFLSLCKNGDMDANPPGERDVENHFYKIPGRYGFKIANGKLVLSFPKLDYRLTLDIPTFQMGKLGAATKLKKFELYRDERNMAKPGRFWVSIVYEVEKPISRPLLADNTVYLAVGASRLGVISPNGSFCLNLPRPDFHWKPNINNLEDRLKHVVKGSRKWKRLISARAKMFSKMSHQQKHGQYEVVRDLLKLGTHFVVTDLKVRSKENSLADASKANRGGSPFGANWSAQNTGNIGRFIQKLTDKAQERGGTVLKRQPPKLSLEERQLPEKQQKILIAEKLREEFLAEHR

SEQ ID NO: 61724 - protein, 577 aa, Unknown
  Microbial Source - Accession No. Ga0172363_1001655
MAEEKFFFCEKCNKDIKIPKNYINKQGAEEKARAKHEHRVHALILGIKFKIYPKKEDISKLNDYFDEYAKAVTFTAKIVDKLKAPFLFAGKRDKDTSKKKWVFPVDKCSFCKEKTEINYRTKQGKNICNSCYLTEFGEQGLLEKIYATKGRKVSSSFNLFNSTKKLTGTHNNYVVKESLQLLDALKKQRSKRLKKLSNTRRKLKQFEEMFEKEDKRFQLPLKEKQRELRFIHVSQKDRATEFKGYTMNKIKSKIKVLRRNIEREQRSLNRKSPVFFRGTRIRLSPSVQFDDKDNKIKLTLSKELPKEYSFSGLNVANEHGRKFFAEKLKLIKENKSKYAYLLRRQVNKNNKKPIYDYYLQYTVEFLPNIITNYNGILGIDRGINTLACIVLLENKKEKPSFVKFFSGKGILNLKNKRRKQLYFLKGVHNKYRKQQKIRPIEPRIDQILHDISKQIIDLAKEKRVAISLEQLEKPQKPKFRQSRKAKYKLSQFNFKTLSNYIDYKAKKEGIRVIYIAPEMTSQNCSRCAMKNDLHVNTQRPYKNTSSLFKCNKCGVELNADYNAAFNIAQKGLKILNS

SEQ ID NO: 61725 - protein, 491 aa, Unknown
  Microbial Source - Accession No. Ga0172365_10006450
MAIKSFEARVICKPDDKYTADQKRQFLWYTHKVFNDGVRAVLPYVFKMKRRKLGDEFQAIYYAIKNSQDAIGKLEAVIHVDWKTKKAGKYPPEQWKKFLQFPEIEKEFRQRLHEQGEKNIKKFRKELERQKKELAKEIGGKDVWADAAMRLHQRGELLFDREKLLDNLPSEFRRKIYEMTIQLMHGYQELVANWEDEHAKWLKEKDEWEEDNPEYMKVRPIFEAFQKEKGKVKGSRIRWFDYLDFLSSHPDLANWRGKASEIVPLTSEERKGLRKPREHFEAFFEKNPELRELDRKHKYYQEKFSRSQSQRTPNPDGFKHRPTFTLPSADKHPAWYSFKGATDPTKGATYRNHNIENCSVDLKVLTALEGKGRNPKGMVTYEFEPDDRIKKFRYVGTKEKGKKAKGFVYYDSILQKERPAKIQGIKLVFRPASPDGIPYLIFSCAIEDEKSKIKIWQDKETVDDGVFSKPKKAKKILYPPELVTLAIDFGQ

SEQ ID NO: 61726 - protein, 1487 aa, Unknown
  Microbial Source - Accession No. Ga0172382_10012866
MPQQDKPLVTQRAYTLRLRGADSNDQSWRDTLWQTHEAVNKGAKAFGGWLLTLRGGLDHTLADTKVKGGKGKPDRDPTDEERKARRILLALSWLSVESSLGAPANFIIASGTEASEDRNGKVVAVLEEILKSRGVDQNEINAWRDDCSASLRAAIRDDAVWVNRSKAFDDAVKSIGCSLTCEEAWDMLERFFGSRDAYLAPVKGSEDEFSDTGQEEKTKDLVQKAGQWLSSRFGTGKGADFSRMAKVYQKIADWADTASPNMGGTQAVASLATALSGFIPASNDLQGVLGLISGPGYKSATRNLLNQIAADTTVTQEDLKKLNETAAADKGRCETNTGSKGQRAYSDAILKDVESVCGLTYRMDENGNAVSVADYSRYDDDYNWGSARHSEFAVILDHAARRVSLAHTWIKRAEAERCRFEEDAQRMGNIPVGVKEWLDSFCLERSGMSGALEPYRIRRRAVDGWKEVVAAWSKSSCSTSADRIAAARALQDDPEIDKFGDIQLFEVLAEDDAVCVWHKDGDAAKAPDPQPLIDYALAAEAEFKKRHFKVPAYRHPDELLHPIFCDFGKSRWDICFDVHKKVQTPFLRALCLTLWTGSEMKPVPLCWQSKRLARDLALGQDTQNDGASEVARADRLGRAASNVTKSDEVKISGLFEQADWNGRLQAPRQQFEAIAAVMNNLSLSAQERERRMSGMRDRIRWLVTFSARLQPQGPWCDFAKKTQLRIDPQYWPHADANKTRKGQARLILSRLPGLRVLSIDLGHRYAASCAVWEAVNAKQVKEACQAAGHEEPKESDLYLHLKKKVTKQKRGKHVEVEETTVYRRIGVDTLPDGRQHPAPWARLDRQFLIKLQGEEEGVREASNEEIWAVHQMEAALGRPVPLIDRLVASGWGGSDKQKARLEELKHLGWKPAEKPEPGDESDAGEESNAYRPSLSVDELMSSAVRTMRLGLKRHGDRARIAHYLITDEKTKPGGIKERLDDNGRVDLLQDTLLMWHDLFSSRGWRDDAARQLWDNYVAKLSGYKAPEEIGEESSGPERRNKQKENREKLHDVAKVLVTDARSREDLHDAWKKRWEEDDERWKRQLRWFKDWILPRGKAANDPTIRKVGGLSLPRLATLTEFRRKVQVGFFTRLQPDGTRAETKEQFGQSALDALEHLREQRVKQLASRIAEAALGIGRMRRPMGGKDPKRPNSRVDEPCHAIVIEDLTHYRPEETRTRRENRQLMTWSSSKVKKYLFEACQLHGLHLREVSAGYTSRQDSRTGAPGIRCQDVPVKEFMQSPFWRKQVKQAENKGDACERFICDMNVMWKDKAVADWEKAGVARVPLKGGEVFVSADPVSPAAKGLQADLNAAANIGLRALTDPDWPGKWWYVPCEPASFRPVKDKVDGSAVVNPDQTLRQPTQAQSGDTAKDKKKRGNKGAGKSKEVVNLWRDISSSPLECIEFGEWKEYAAYQNEVQCRVVHVLEEQIKGRDRQPHDGSKEDDIPF

SEQ ID NO: 61727 - protein, 493 aa, Unknown
  Microbial Source - Accession No. Ga0180300_10000403
MEDKIKLTVRAVIPPRDLGLRKLMREYKAYKKALIPRVREAVREVIKDRSIRVYAQQKWMIEKKLLEYLKNLPFHPMPFHNQSVWIENKDGDFWIHFKTKEGEAICYLLVPAKYRSLIEKACGVDNPVLGQVELIEDRKYGWVNCHICLRLPKPEPYEPKGWVGVDVGWNKLATSILCTANPHVKFSNPTFHGKQFKTRIIQLRYLLKQYARKGKSWKKWNHRLKNTIKYAIGVTAKEIVSKAKKFKAGVAMEKLTFKSTTKGYLVPRYKLMIAVKTLCEREGVPFKLVPAQYTSVTCPYCGYRDKKNRNGKWFKCLKCGYQTDADLAAAMNIALRAFDSSPDGGEIGTGHAPCLKARGLHAPERGDVATPLRAMRDVPLERAANTTMYCNCSQNVHTVTMPHTVDCKLQHAAQRALAYIGPVTMPHTVNCELQHVPHSHRSHGSQGVTMPYTVGCELQPPNACSTMYLTAPLIDNPRFTANFSTRSYSFRGM

SEQ ID NO: 61728 - protein, 329 aa, Unknown
  Microbial Source - Accession No. Ga0180301_10011215
LKLEPTPSQEKVLKGCEEESFKFLSLSREKLKQLLYHELKDEVKLSRRTLALLIQRFTGSMGGKTIIPFDEDNSKFVKEDGFWFVEIQPFKGRGRIKIPVARTEVPYYSVIQELQGYPFYITRENVDWFAYISIPAPNNSNGTVIGIDFNLKKWVATPYQGKPQFFDAEKYEGEIDRLQKLIARYQSRGESEKVKECHEKIQEQVKLAHGNFLKLIRDTWDVCNLAIEDVEVMFKLREKDSQVINNWLYRKAALRQFALRAMAKGFNIIEVNPEGTSKICHRCGSPVKIYGKHKRLITCEKCGYKDYNRDLNAARNIAKKGLHHLTLHL

SEQ ID NO: 61729 - protein, 1507 aa, Unknown
  Microbial Source - Accession No. Ga0180435_10008691
PPIYIRRHCLNNIDYRPSWRLPFQRFSIPPDGPIFNAFRHLADAKVKGGKSKPDRDPTDEERKAWRILLALSWLSVESRLGVPANFIIASGTEASKDRNGKVAAAFEEILKGRNIAADEIENWKQDCLASLSAAIREDAVWVNRSKAFDEAVKLIGDSLTREEVWDLLERFFGSRDAYLAPAKSSEDESSDTGQEEKAKDLVQKAGQWLSSRFGTGKGADFRRMKDIYEKIAQWAANNNSSPLVGTDAIVNLANTLQNFNPASNDVNGILGLISGPGYKSATRNLLTQISNKITVTQEDLTKLSETAASDKGKCETNTGSKGQRPYSDTILKDVESACGFTYRVDKDGQPVSVAEYSKYNDDYSWGSAKHSEFAVILDHAARRVSLAHTWIKLAEAERRRFEEDARKIDDVPDSVKEWLDSFCLERSRTSGALEPYRIRKRAVGGWKEVVAAWGKSSCTGYADRIAAARALQDNPEIDKFGDIQLFEALAEDDAVCVWHKDGDAVKSSDHQPLIDYALAAEAEFKKRHFKVPAYRHPDALLHPIFCDFGNSRWEIDFSIREASADAKKKAEEKVTKKQKEFEKAQAALKKAGENGNNESAAKEKLDAATKKLSEAQKEFERLSSIHLMKMTLWNGETIAETHLSWQSKRLVADLALEQNKRATEITEVTRADRLGRAASNVNGSSRVKISGLFEQKDWNGRLQAPRQQLEAIAARVEKHGWDAKSQSMLSHLKWLVTFSAKLQTQGPWCDFASENQLNIDPKYWPHADANKKRKGHARLVLSRLPGLRVLSVDLGHRYAATCAVWEAISTKKVREACKAAGRTEPKDSDLFLHLKRKVKKHKKGKEVEVEETTIYRRIGANTLPDDKPHPAPWARLDRQFLIKLQGEDREVREASNEEIWAVHQLEAELGRPMPLIDRLVKADWGYTSKQKARLEALRHLGWTPVNQTQDFAATDEGELRKPSLSVDELMFSAVRTLRLALRRHRDRARIAHYLITDEKTKSGGMKEKLDENGRINLLQDALVMWHDLFSSRGWRYDAAKNLWNEHIARLQGYQAPVEIEEDITNVERKKKRKENQDKLRGAAKALAENENLRKTLSKAWTEQWNDNDQRWKKRLRWFKDWILPRGKRKADKSIRHVGGLSLTRLATLTEFRRKVQVGFYTRLKPDGSKCEIKDKFGQQALDALEYLREQRVKQLASRIAEAALGIGRMKRSKNGKDIKRPRERVDEPCHAVVIENLTHYRPEETRTRRENRQLMSWASSKVKKYLTEACQLHGLHLREVQAGYTSRQDSRTGAPGIRCQDVAIHEFMRSPFWRKQVAQAEKKQGDSKGDTREKLLCALNGKWKDKSDPEWKNAGTVRIPLKGGDLFVSANRNSPAATGLQADLNAAANIGLRALLDPDFTGKWWYVPCDPKTFKPVNDKVSGSTVIDVNQSLKDNQPESGEKNPKGDKKTKEAVNLWRDISSQPISEKNTWKQFTEYWNGVVFRVIENVLRSYNAIPSQDSQESPV

SEQ ID NO: 61730 - protein, 646 aa, Unknown
  Microbial Source - Accession No. Ga0180446_1198
MLPKVFFSDKNIGYYKPSDSLLENYKNETHKKGEKFNLQHCHELIDFFKNSIEKHEDWENFGFTFSPTESYKDLSDFYKEVEKQGYKITFQPVSESYIKQLVNEGKLYLFQIYNKDFSEYSKGKPNLHTLYWKALFDPENLNDVVYKLNGEAEVFYRKKSIDNPTIHKANQPIENKNPNTTKKQSIFSCDIIKDRRYTLDKFQFHVPITLNFKAEGKENINNDVLNHLKDNSDIKIIGLDRGERHLIYLTLINQDGKILKQESLNVIKDEKFGIETPYHQLLQSKEEQRAKARENWGVIENIKELKEGYISQVIHYIAKMMVEENAIVVMEDLNTGFKRGRFKVERQVYQKLEKMLIDKLNYLVFKDKDPRTPGGLYKALQLTNKFTSFKEMGKHNGFIFFVPASYTSKIDPTTGFVNFFNTKYESIKKAQEFFNNFKSIRYIPSRSNPSEYNPSEYNPSEDYFEFEVDDYTKFNPKAQGIKKDWVICTYGDRIRTFRKPNKNNQWDYEKVNLSKEFKNLFKKHKIEYTNGSCIKEQITKKDDKKFLMELLDLFNLTVQMRNSIPNDKEDYLISPVKNSNGKFYDSREAGNNLPKDADANGAFNIARKGLLLIKKIKETKETGKLPIITNKEWLEFAIEKGQDIIK

SEQ ID NO: 61731 - protein, 1232 aa, Unknown
  Microbial Source - Accession No. Ga0181613_1004254
KEIKSLLDKKAEKWKEVYKKKRIEFSQTDLKQEGTNFLTKSGILGILKYEFPLEKEKEFKSKDWPSLFVEDKANPGNKVYIFDSFDNFATYLLKFQETRKNLYKDDGTSTAVAARVISNFEKFLNNKKIFKDKYVDYWERIGITEEEKEIFKIDYYYNCFIQEGIDKYNKIIGQINQKTKQYRDKNKIDKNRLPLFKVLDKQILGEVIKERELITKTETETEEEVFIKRFKEFIDQNKKMISVIKNQKDLEKEKEYLMDDLFDEKFESEYFGIYLKNSAINTIANRWFKNTTEFLLKLPQASKSKSKENKESPKVKPLISLLDIKNALDDFEKERESLGAIFKDKYYKTKEIDEAPLNDDNQESYWKQFLKIWGYEFNQLFEDKFNEKGFKIFWGYTEDLEKQAENLNSFSHKKEEIVLVKNYCDAALRIYQIMKYFALEAKKQGEITDFSTEFYNRFDEYYKDFKFIRYYDAIRNFVTKKPSNEDKIKLNFEKPNLLGGFSESPVGNAQYCGYILRKNDKYYLGISLFTHFLDIEKYKLNELKGEDFYEKLEYYSLDWAKNIVGGRVYQSFTKSKFGKPISFQEHKNEFKNYPKKHVEIIKELIKEKYLRRYPQLKQIIEKDFDTPKEMQKAFSDLSLKGFYWVKVKASHVDNQKIIEGGGNHEKRHLLYLFEIVNKDFVWSRKTKNIHTLYFLNLFSDKNIQKPVFRLGANAEVFYRPASVRKEMDKERSKGGKEIIKYKRYTEDKIFLHLPIEINYGCSKAPNKNQYNKKIIEFLNKNKDEINIIGIDRGEKNLLYYTVINQKGEILKHGSLNEIRGINYLEKLIEREKERQINRQSWEPVVKIKDLKKGYLSYVVREIADLVEKYNAIIVLEDLNMRFKQVIRGGIERSVYQQFEKQLIDKLGYLVFKDDRGSEFPGGVLNGYQLVAPFTTFKDLGKQTGIIFYTNAEYTSKTDPVTGYRKNIYISNSASQKKIKEDLINKLKALGWDEKEKSYFFTYNQKDFGSSISKEWTLYSKVSRIRREKNNSTGYWEYKPIDLNKEFEDLFKKYGINEKSSDILSEIKELIKNKEEKLTQKQKFDGKEKNFYERFIYLFNLLLETRNTMSLQVKLDKRGNEIKLEEIDYGVDFFASLVKPFFTTAGVRFIGKQTEGGKIQKEKKEEFAIKNFGDFERLFRNCSSDGFDSDGVGAYNIARKGIMILERIKQKPQKLYISKEDWDAFAIKNALVK

SEQ ID NO: 61732 - protein, 1039 aa, Unknown
  Microbial Source - Accession No. Ga0181613_1005053
MNQIQIRKLDYQLTKNIGFLLKDVILEKWLVQKSENLKSSRLSINKLEFLKKLNNLLEDLFSSKDVGLIDRFLFYKHERGFNLFNYELDKKFLCKYDLYSGKTRYSHLAFNKMSFKKIKGFWLYFSRRIEEEILNPLNNYLNLYEKGINPKESEIRSVLRKFQGRYYFELLKEFFDGLRFNYKEKNINKIDFEAKIKDIKNKINSINELIQKNPFENKDELTKFSFNYYTLNKRPLNYRGDIDDTQSIENYYKSLKESYEKSLNEKINQFEFIKRYNNIINFVNKNLGENLLSYSLENAVEKLKEFRATIKSNFYKDINRADKDKLDLNYFDRAHPLFKFKDKNSFNKFLNSKVDDIKKYFNYEFKGYKNLCNLYQKLAVERGKIKAQIKGLEKEKEEFINLKYWGFIADYNNEKYLILLKKEFRKDFKDYLDSYKEEKPDFTLYNFKSFTFRALEKLIFNSYNNDFFEGIKQDERISDLLKKSNIRDKYKIKESLNNKDLILFYKYILTSEYAKNNLDLEDFNLEEVLSKDFDNIEDFRIALDGACYFIKEINLSWNKFINAWKNNVSIFKIYSYDLIGKQKELKFHTKVWKAFWSSFKDSRIRLNPEGSIFLNVVDEDERRTILLKKEKLEREGKKFIRNRKLEDYYYKALFNFNLYFPSKEIKISFKEKDKIDKSIEEYNNNFNQQNDFKNLFYIGIDLGEIELATLGIIKFKDSSSNFELQKIKAYKIKDEFINPQNIKNPSLLDDNFFEEVELDSLDLSKAKLIRDKIVINGDISTYLKLRIVSAKRKLFDLVKKQGEALANEKICFYNETKNNLGVNLGNDVFVLKKNNKKEKYLRVYKYDPEFENICPKEYLNEELNNYYRSLLKDESINYYEEINSLRKAISSNIVGIASYLQDIFPSILVLENLSKETREYHMRKENFFLDSQVDWMIYRKLETKKLCPPNINNFKFLKDLESENGVFQLGGLVFVSEKSTSKKCPRCGAEELGLSEEKFKEAKFELRNMKCEQCSEEFHPDLIACINIAKSAFDFLNSK

SEQ ID NO: 61733 - protein, 529 aa, Unknown
  Microbial Source - Accession No. Ga0181858_1004277
MRRFSAAYRWTYRRLLEGYDPNVLKRADGPMTKLFGLGLKYNEGGRDLAKWKLGALKRLGQPPEKIVFGGRGLFRRLGRKGDLRSRLEAKRLWWERRNGLLYCPGDRSQPSGNPNLRLFWEHGALWLRILLEGTPAKGRYVDALVQTSSPYLEAIAEAVGRKGVAPIGVNLRLRDGKVYAIFTRSLPSPAPHITRQGGVLGVDVNARPLHLALAVAGPDGNLRRYLTLSLEEVDRIRERKRGESADALSDFYWKVAHRVVDLAKEEGTAIAIENIRNLPRGKRGDGNKRLRRALPRFAYRAVLERIVAVASREGVEVWGVNPAYTSVIGMLKYAPQLSLSKDVAAAYVIARRAMGLRERVPKRYLELLARPEHWERVAEWFASEWRALEARVREEKNEYKLRRYRQEQEELKNAWDYLRKFVESLEGAPGAPRRGPTGADALPSSGSQKEPEGGLLLWRALQVGVLRPLLGRKVPRDLSALKPLLVGGAWEGGGGERLGPDRCAGPTRTGARGLTALTLEDISRGEEVF

SEQ ID NO: 61734 - protein, 1522 aa, Unknown
  Microbial Source - Accession No. Ga0182014_10001887
MAEKNSKEQPVVTTQRAYTLRLSGTDKHDNSWCDRLWKTHEAVNKGAKVFGDWLLTMRGGLCHTLAEADVPGKGKKPARRPTQQEIKNRRIVLALSWLSVESKCGAPESYIVPHDSNTATGERKNWKTVEALREILRSRGLTEERAIEWADDCRDSLRATIREDAVWVNRSKAFDLAATNIGASLTREELWDFLQPFFANRHSYLEMDTVASATNGDSETDTEESKAASSDEKAKDLSQKAGQWLSSRFGTGPGADFSRFSKVYEVLATACRSIAPEVSGVEAINRLAIAIKKCSPSSNDIEGILGLISGPGYKSATRNILQQINRLQSVSEQDLSRLCDACEKDASQSRQKVGGKGSRPYADAILQDVERTCGICYARTEDHPSRHWQYAVILDHAARRVSMAHSWIKRAEEQRSKFEIEKNKLLRVPRDALAWLAAFCAKRSSDSGANDAYRIRRSAVDGWKQVVAAWAALPAKSEIAGSELRSDAERARIQVARELQDTVEKFGDIQLFEALAIREAKCVWMPDGKPDAQPLLDYVFGTDAIAKKQRFKVPAYRHPDAFLHPVFCDFGNSRWSIDYAVHRAPGKLTKARQLLEKKSAEISKAELALGKMDDALRHAAISETLQNLRAAYKQQQAEVAWLKTLQAITMGLWDGNGIQDTQLLWRSKRFGANIGQPDAVHPSPVSRADRFGRAVALAEDNVPVIPSGLFDLPEWNGRLQAPRRQLEAIAAMRDSAKLSAGEKQQLVAKRIHSIRWLVTFSAKLQSHGPFITYAEQHGFDWRYGMHGFENKSRQGLAKLILCRLPGLRILSVDLGHRYAAACAVWETLSTGQIQKSCGVAGMEAPGPRTLYLHLKQIVDGKEKKTIYRRIGADTLPDGSPHPAPWARLDRQFLIKLQGEDRDARPATSEEIAAVEHMENELGVVRQLKRKGRELLVDELMSDTLRTLRLGLRRHGERARIAFNLTAAKRIRPGGIQDVLDQEGRISLLKETLLLWYELYSGERWRDKPAEDLWNRHLQPLLGGAILPDTVDQEGNASAAKRRKQREETSENLRPVAEQIAKNDSLCRQLHVLWGAQWQTEDAVWRTRLRWMRRWLLPRGIKRDAQLRKSIRDVGGLSLTRIASFRSLYQVQKAYRMRFHPEDPERNIPKRGDSRLEGFGQRVLDAMERMRENRVKQLASRIAEAALGIGDEAGINSKDGRQKKRPTERSRDSRFVSCHAVVIEDLTHYRPDETRTRRENRQLMSWSSSKVKKYLSEACQLHGLHLREVSPAYTSRQDSRTGAPGLRCKDVTVAEFMKSPFWRKQVNTARENRGKENNGNARDRYLLWIDEKISADVTKETDSFLIPSDGGEMFVSAFEDNKAQPASRRKKPSALQADLNAAANIGLRALLDPDWEGRWWYIPCDAATLCPDAKKFIGCKAVDPSKPLRVVAEEGAMSASGIGSKKSGRKRNVATDETRIVNLWRDPSSMPVHLDASGSGEWQGYHEYKDNVQSRVIRNLKARYKQTWRQEYPFVPQDEDTPF

SEQ ID NO: 61735 - protein, 1437 aa, Unknown
  Microbial Source - Accession No. Ga0186994_110
RGADPSDTFWRKALWQTHEAVNKGAKVFGDWLLTLRGGLDHTLADAKVKTRKGQPDRDPTDEERKARRILLALSWLSAESKLGAPADFIVASGTEAQDERNCKVLAALEEILKARGLDPQEIEAWKNDCAASLSAAIRDDAVWINRSKAFDDAVKSAGYSLTREEAWDMLERFFGSRDVYLAPAKVSEDESSEAEQEDKAKDLVQKAGQWLSSRFGTGQGADFCRMAKVYGKIAAWADNAQGGMTGNETIKNLAAALSEFNPASKDLQGVLGLISGPGYKSATRNLLTQIAAKSFVTQQDLASLKDRAIKDAQKCNQNTGSKGRRPYSDAILKNVEALCGFNYLQDGGPARHSEFAVMLDHAARRVSLAHTWIKRAEAERRRFEEDARKIELVPEPIREWLDHFCSQRSQELGALEPYRIRRRAVEGWKEVVAAWSKADCKTAEDRIAAARALQDDPEIDKFGDIQLFEALAAGDAVCVWHKDGDPAIDPDPQPLIDYALAAEAEFKKRHFKVPAYRHPDALLHPIFCDFGKSRWDICFDVHKNVQTPFPRALCLTLWTGSEMKPVPLCWQSKRLAHDLALGNSEKKAEASEVTRADRLGRAASDVGKRDVVNIAGLFEQADWNGRLQAPRQQLEAIAKRVDKHKWDETAKKMLDRLQWLVTFSARLQPNGPWYVYAKEHGLREDPKYWPYADANKTRKGHARLILSRLPGLRVLSVDLGHRYAAACAVWEALTVEQVKEACQAAGHRDPNESDLFLHLKRKMRKQKKGNQVEVEETTIYRRIGADTLPDGMPHPAPWARLDRQFLIKLQGEEDGAREASNEEIWAVHQMEGELGRAVPLIDRLIAAGWGITEKQKSRIETLKRLGWRPVERPELGDESDSDEEDLYRPSLSVDELMSSAVRTMRLALKRHGDRARIAHYLIADEKTKPGGIREKLDENGRIELLQDALVMWHDLFSSRGWQDDAAKQLWDDRITRLSGYKAPEEIGEGVSGVERKKKQRENREKLQVVAKALTQNVSLRKDLHNAWKKRWEEDDERWRKQLRWFKDWILPRGKAANDPAIHKVGGLSLSRIATLTEFRRKIQVGFFTRLQPDGTRAGIKEQFGQSVLDAIEHLREQRVKQLASRIVEAALGIGSENKHHWDGTKRPRERIADRRFAPCHAIVIEDLTHYRPEETRTRRENRGLMAWSSSKVKKYLAEACQLHGLHLREVSASYTSRQDSRTGSPGIRCRDVPVKEFMRSPFWRKQVKQAEAKQAENKGDERDRFLCDLNAMWKDKTVADWEKAGIVRVPLRGGEVFVSAAPASPAAKGLQADLNAAANIGLRAFTDPDWPGKWWYVPCDPVSFKPIPDKVKGSAAINLDVPLKGDVPPKDVPAASGDVTRKKSGKIKSRSKEVVNLWRDVSSREISTTGIAWEVYAAYQNRVEKRVIEILRKSKCP

SEQ ID NO: 61736 - protein, 1374 aa, Unknown
  Microbial Source - Accession No. Ga0187028_105
MPETTQRAYTLRLQGHDPKDASWREALWKTHEAVNRGAKAFGDWLLTLRGGLDHSLADEGAPGQTPTEEQRKQRRILLALSWLSVESENGAPQEYIVPHDRDNESGARQNWKTREALREILKNRGCRDDEIESWCHDCEPSLTSAIRKDAVWVNRSKAFDNAVQSIPNFSREEIWDLLGCFFVSSQAYLAPLESPKDDKPDASKKDSSKDLIQSAGQWLSRRFGRGKGLNFARLAETYEAIARWASVANPGDTNDLIADLAKTLNAETPELDGILKVVSGPGHKSKTRNLLRSLSAVNHITKDTLQRLKDTANEDAKKAKLKKGEKGHRAYAYKVLEAVEDACGFTYLQEGDRAKHCEFAVMLDHAARRVSSLHTWIKRAEAERRRFEIDTKKKDQLPPSVKEWLDTYCQKRSKETGAVEPYRIRRGAIEGWKEIVEAWSKAGTTTAEDRKHEARRLPDNPHIDKSGDIKLFEDLALEDALPVWHANGDPNNPPDPQLLIDYVEGSEAEFKKRAFKVPTYCHPDPLVHPVFCDYGCSRWNVSFAIQPVKKQKLSSEEKLPAKGLLLDLLHGTAIRPVALRWQSKRFARDLALNTTDSSDKPNEVTRADRFGCALAKCPSSQKIRIRGLFEEKYWNGRLQAPRPELTALAKRVAKYGWDKKARKLRNSLNWFITFSANLRPSGPWEEYTKYAEKAFSSNASAKPSVSRGGFWVVHASPNKRGKMAQLRLCRLPELRVLSVDLGHRYAAACAVWETLSKSAFEQEIHERKILRGGTGPNDLFCHTQHDTNGQSKVTIYRRIGADTLPNGTPHPAPWARLDRQFLIKLPGEEREARKASPTELANVEKLEKELGLKTSENRVKRIDDLMSDTLRTVRQALRRHSLRARIAFNLATLRDQSDGDEESQSKQKRDTRWNNTVKIWHSLLESNEWTDDWAKALWDELGPLSDPQKADDAEWLKLAAEKFYTRWQEDEQTWRERLRWLRRWILPRGSQAASQKGSIRHVGGLSLTRLATIKTLYQVLKAYHMRLKPDNSRKNIPAEGDEALQNFGQKILDDLEHMREQRVKQLASRIVEAALGLGRMKQVTIGKDPKRPREPVDQSCHAVVIENLTHYRPEKRQTRRENRQLMDWSAAKVKKYLKECCQLHGLHLVEVSASYTSRQDSRTGAPGIRCQEVPLTDFLKKNFWREQVKQAKQRLSEGKANARDRYLCQLNERWGNAPAPVTQTAIRLRIPLNGGELFVSADQNSPASKGIQADLNAAANIGLRAITDPDWPGAWWYVPCEANTFKPVKDKVAGSAAIDSNVSLKKDSPNSEKPASDRKSRTSKSMINLWCDTSSKSLSEKDQWQESAPYWEDVAARTINILQASLACSTTNSQ

SEQ ID NO: 61737 - protein, 519 aa, Unknown
  Microbial Source - Accession No. Ga0187073_104
MNLTKSYKFKLIVTPEQHIFLENYFLRYAKAVNFYIKIIQIIRRDYQWLTKKEQIEGECNNCRKKVLLVYRFLPENKLLCPKCYNLHAGDYSLRKILYATRQRKRGKYDVRDAVSLAGTEYALSFKRAVDILKAIRKQIGSMRKFIKNRKERLEMWQEVLNDEKARFVVPRLEGQKAVRYKHIKLKDNPSRGKTESQIKKEIVALSKTIIKTEKSLRGIKSNFRGDIVDLQNTAIKKIDEDGAEITLDGGKRKFGLMIGAVRNEKGRKWLSDILKKIKESKPTYPMLLKQKGNFYLHYPISIDVAEPEIKTKTNYRVMGIDRGVNQIAVSVILDEFQGKPHNIKFYSGRDLMRQKIKFQLIRKKFTGTKNVNRRRAKFGKKLNRISTYLLHYISKNIIDEAKKFKPIVIVMENLKMIQGAKRPKKGSAAQERKINYIMSNFSYRKLQSLLSYKALQAGIPIRLISPEYTSQLCSKCSKPGDRTKGHFKCLNEKCGLQMNADLNAAINIANSYFKHSENS

SEQ ID NO: 61738 - protein, 1548 aa, Unknown
  Microbial Source - Accession No. Ga0187107_1033
MAELLEKTQRAYTLRLQRASGKCDICGKDDCSCWREALWNTHEAVNKGAKVFGDWLLTLRGGLSHTLADEPPLSDDDIEKELKALKKEAKANERNEPSFDDAKRSAEEKREARIRNKRIVLALSWLSVESERGAPQKFFVKHQRNEETNERSKWETEEELREILKNRGLNRNEIESWIKDCKASLSSAIRHDAVWVNRSKAFDELINNLMTHDEVWDMLGFFFKDQKTYVAPAEGPKDSEDEAADSEEEEAKDLVKNAGQWLSSRFGEGKGADFARMAGNYGKISNLSSQIMPGVTGKEAIEKLAKHLEVRDLAGILDLISGPGYKSATRNFLKEIDNKKIVTTEDLEKLKELAIEDQGKCKSKIGLKGRRSYSDMIMKEVEDACGFTYLQQNGPSRHSEFAVMLDHAARRVSIAHTWIKRAEARRRQFEEDAGRLSKVPPIISDWLDKFCSDRSEISGALEEYRIRRRAVDGWDKIVEKWAKCSSKEERIKAIEKVQGECQANDDKFGDAQLFEALAEDDAICVWHKNGNPQEEPDPQPLIDYVAAKEAEYNKRRFKVPAYRHPDPFMHPVFCDFGCSRWDINFAIHRASQELSETTQKIERKKAELEKAENALSKVEKLNDITKISPAHKKRDECREVLAEAQRRCAWLMSPRALSMKLATGNNKVVDITTLCWQSKRLAHDLGLNTKDSSGEASDVTRADRLGRAASGISDKDPVKIKDLFEEAEWNGRLQAPRGQLEAIARRVEKHGWDEKAKRMLDNIKWLVTFSARLRPYGPWVEYTKSFSEDSFPKPLVGAREYFVKYSDNDSRSSLSKHILSRLPGLRLLAVDLGHRYAAACAVWETLSAKKFQDEIAGKTILRGGTDANAIYCHVEDEKDGKKRTIIYRRIGADILPDGNPHPAPWARLDRQFLIKLQGEDEKARMARRNEIKKVERMEGEFGRFRKAPNNSECPNDEQGGNASSPACVDESGLPKRVDELMSEAVRIMRLALQRHGRRARIAYNLTAEDKLLPGGRKEKMEPEERVALLAETLADWHEICESRRWKDDFASSLWDEYLKAFDADIEAIKNAIEGEKDAVSDDEEETARARRKKREKLIAVLKPIAQKLADDMPLCKEISKRWAAYWSEEDEKIKKWLLWLRRWILPRGKKFATVRSIRRVGGLSLTRIATIKSLYQVQKAFRMRPEPDDPRKNIPARGDESLEDFGAKILKTVEKMREQRVKQLASRIVEAALGIGSENYEEHWEKKRKRPRRPIDDPRFRPCHAVVIENLTHYRPEETRTRRENRQLMTWAAGQVKKYLAEACQLHGLYLREIQPAYTSRQDSRTGAPGARCQDVPVTEFMKSPLWRRQVKQALKKSKEQSADARVRLLCELDEYCEKHKADWKNRQPEKKAEEKEPLLRIPLKGGEIFVSSDVNSPAAKGIQADLNAAANIGLRAIMDPDWPGKWWYIPCERSTFKPAKDKVAGSSAISLDEPLKKDSETDSSGAKQKRRKSGKKGSEIVNLWRDVSSKPISADDGWREFEPYWNAVTAKVVEILRQQSKEKDWPF

SEQ ID NO: 61739 - protein, 581 aa, Unknown
  Microbial Source - Accession No. Ga0187121_108
MDKEIQTFFCEKCNKEINIPKNLIGKENAIEKAKSKHNHKEHSLILGIKFKIYPEKKDIEKLNNYFDEYAKAVNFAAKIIDKLKEQFFFIGQKNKEQTGKKWIFPIEKCDFCGEEKEIVYQSKRGKKICKNCYMKEFSEGEIRKKIYSTKGRKVNPSYNIKNATNKLCATHYNYAPREAFQLLDALKKQREKRIRRLKKDKIRLRQFEEMLEQEDKRYELPKKGKQREPRFIHISLKDRASEFEGKGYTIKKIKDKIKTLRRNIEKEEKSLRKKSPIEFKGNRIMLTNNLKFDFEKDMVRIPLTKELTKYYKFSGLNVANEHGRKFFEEKLKLIKENKPKYSYLIRKQINKDKENPVYDYYLQYTVEFLPEIKTEYKGILGIDCGVNTPACVVLLEKGKEKPSLVKFFSGKDILKLKIRRRKQLYFLKGKHHKIMKQKRIRPIEPKINQILHTIAKQIVGLAKEKEVAISLENLEKPKKGKYKQSRFIRYKLSLFNFKTLQNYIAYKAKKEGIKVIYVPPEMTSQTCSHCAIKGNIHADTKRPYKNSYSLFKCNKCGIELNADYNAAFNIAQKGLKSLNSI

SEQ ID NO: 61740 - protein, 1353 aa, Unknown
  Microbial Source - Accession No. Ga0187143_105
MEIKTKNRQKTIWSEFTKQYSLNKTLRFELKPVNRTAYFLKQNKIFEKDLTIDDSYNQAKFYFDKLHQKFVNEALLSDKVKEINLEEFAQNFFALREEVKKLKESQEREKTYTVENKINKLKNEYFKKIKLLLDRTANDWKEKYKERGLKFNKTDFKKNGTEFLMKSGVLKILKYEFPKEKEEEFKNNDWPSLLIEDKANPGNKVYIFDSFDNFTTYLLKFQETRKNLYKDDGTSTAIATRIISNFEKFLNNKKIFDEKYSTFWGKIGITKEEKEIFEVNYYYNCFIQKGIDKYNETIGQINRKSKEHRDKNKIDKSQLPLFKKLDKQILGEVIKERELITKTENETEEQCLIKRFKEFINQNKERIDKAKNLIKDLINSNFESEYAGIYLRRAAVNTIANRWFKNPTEFLLKLPQTSKSKENKESPKIKTFISLLDIKNALENFEGNKDSLGLIFKDRYYKNEQNENKPLEINNQESYWMQFLKIWNYEFSQLFEDKFNEKGVQIFWGYTENLEEQAERLNSFSRQKDEIQIIKNYCDASLKIYQMMKYFVLEVKNEKDVPVDYSTEFYNRFDEYYKDFEFIRYYNAIRNYVTQKPSNEHKIKLNFESGSLLTGFDKNKESEKLGIILRYRNSNKYFLGIIHKEHNKIFDSKNESKFIGDSDEDLYEKMELKLFPDPKKMIPKIVFANGNKKDFGWTQEIQDIKTEFKVFQENKKENKDIKFDKSKLAKLIEYYQNCLERAGYKKEFGFEWKKADEYQSMSEFNQDIEKKNYKIKFIPIKDSYIEEKVQSGELYLFEISNKDFVWPNQKKNIHTLYFLNLFSDKNIQKPIFRLGANAELFYRPKCERIVKEKRGKKEIIKYKRYTEDKILLHLPIEINYGCFKAPNTKQFNKKFLEFFNDHDDEINIIGIDRGEKNLLYYIVINRKGEILEHGSLNGINGVNYFEKLLEREKERLINRQSWEPVVKIKDLKKGYLSYVVRKIADLVEKYNAIIVLEDLNFRFKQIRGGIERTVYQQFEKQLIDKLSYLVFKDNRNPEEPGGILNGYQLVAPFTAFKDLGKQTGIIFYVSAEYTSKTDPLTGYRKNIYISNSASQKKIKDLINKLKDFGWDEKEHSYFFTYNQKDFDSSIDKEWTLFSKVPRVRREKDNKTGYWEYKPIDLNKEFKDLFEKYEINKESNDILSEIKSLIKNNEEILTQKKEFDGKSKNFYERFIYLFNLLLEARNTISFQVKLDTQGDELKLEEIDYGVDFFASPVKPFFTTSGIRFISKQNRDGKTEKEKKEEFTKENFPDFKNLFKECSPENFDSDGVGAYNIAKKGIILLERIKENPEKPDLYISKEDWDNFAIENALIK

SEQ ID NO: 61741 - protein, 1544 aa, Unknown
  Microbial Source - Accession No. Ga018764_10009485
MADENGREQPVVTTQRAYTLRLSGTDKNDNSWRDRLWKTHEAVNKGAKVFGDWLLTMRGGLCHTLAEADIPGKGKKPALRPTPQEIKNRRIVLALSWLSVESKCGAPESYIVPHDSNTATGERKYWKTVEALREILRSRGLTEERADEWADDCRDSLSATIREDAVWVNRSRVFDLAATKIGASLTREELWDFLQPFFANKHSYLEMDTVASATNGDSGTDTEESKVDSSDEKAKDLSQKAGQWLSSRFGTGTGADFSRFSKVYEVLAAGCQSIAAGVSGAEAINRLATAMEEYSPHSKDIEGILGLISGPGYKSATRNNVLPQINSLQRVSQQDLDRLRDACEKDAVQSRQRVGGKGSRPYANAILRDVEVACGICYAKTAGGPSRHWQYAVILDHAARRVSMAHSWIKRAEEQRSKFEIERNKLDHVPHDARAWLDAFCNRRSSESGATDAYRIRRSAVGGWKQVVAEWAALPATAENAGSELLSGPELARIRAARELQDTVEKFGDIQLFEALSATDARCVWQPDGKSDAQPLLDYVAGTDAISKRQRFKVPAYRHPDALLHPIFCDFGNSRWSIDYAIHRAPKELTHAKQLLEKKKAEIDKAELTLAKANGTAKRADISEKIKSLRAAFIQQQSKVACLDSRHAMTMGLWDGSRIEDTPLRWQSKRFASDIGQPLSAHSLPVSRADRFGRASVAAEDNSPVKPSGLFDLPDWNGRLQAPRRQLEAIAAMRDSAKLSAGEKQHLVAKRIHSIRWLVTLSAKLQALGPWFEFAGPRGLLEYRNGEVVLSPRSSKDSWRGLAFPFWHPHNLKGRGGAVRHVLSRLPGLRVLSVDLGHRYAAACAVWETVSTGQIQKACLDAGMEAPGPHPLYLHLKQIVDGKEKKTIYRRIGADTLPDGSPHPAPWARLDRQFLIKLQGENRDARPATSEEVAAVEQMENELGVVRQLKRKGQELLVDELVFDTLRTLRLGLRRHGTRARIAFNLTATKRIRPGGIQEVLDQEGRLSLLKETLLLWYEVYSGERWRDKPAEDLWNRHIQPLLGGTILQDTVNQEDIPSAAKRRKQREETSEKLRPVAEQIAKNDSLCRQLRVLWSAQWQTEDAIWRTRLRWMRRWLLPRGIKRDAQLRKSIRDVGGLSLTRIASFKLLYQVQKAYRMRPHPEDPERNIPKRGDSSLEDFDQRVLDAMERMRENRVKQLASRIAEAALGIGDEAGIHSKDGRQKKRPTERSRDSRFASCHAVVIEDLTHYRPDETRTRRENRQLMSWSSSKVKKYLGEACQLHGLHLREVSPAYTSRQDSRTGAPGLRCNDVTVEEFKKSLFWRKQVGAAEKNREAGNKGDARERYLLWVDEKISADETKETDSFLIPSDGGEMFVSAFEDNKTQSASRRKKPSALQADLNAAANIGLRALLDPDWEGRWWYIPCDAATFCPDTKKFIGCKAVDPSKPLRVVAEEGAISASGIGSKKSGRKRNAAIDGTRIVNLWRDPSSMPVHLDASGSGEWQRYHEYKNNVQSRVIQNLKARYKQTWQQENAFVPQNEDTPF

SEQ ID NO: 61742 - protein, 347 aa, Unknown
  Microbial Source - Accession No. Ga0190309_1003062
VEKDETIKLTVKAVIPPRDKGLRKLMREYKAYKKALIPKVREAVRNVIKDKSLRVYSQQKWMVDKKLNEYLKNLPFHPMPFHNQSVWIQEKEGVFWIHFKTKEGEAVCYLKVPEKYRGFVKKACGRDNPVLGQVELIEDKKYGWVNCHIVLRLPKPEPYKPKAWVGVDIGWNKLATSIACTVNPHLRFFKPTFHGKQFKTRIIQLRYLLKQYARKGKAWKKWDYRLKHTIKYAIGVVAKEIVSKAKKLKAGVAMEKLTFKSVTKGYLVPRYKLTIAVKTLCEREGVPFKLVPAKYTSIICPKCGYTNKKNRNGERFNCLRCGYKADADIVAAMNIAKRAITAPQMEG

SEQ ID NO: 61743 - protein, 591 aa, Unknown
  Microbial Source - Accession No. Ga0190334_1000016
VVKQTTFFCKECNKNINIPRNIIKKLESNHISQDQAIKKAKERHNKKKHSLILGIKFKLYVKNKEDKEKLNSYFEEYAKAVTFAAQIIDKIKSGYLPQWKKDKKLKRIIFPKGKCDFCGTKTEIGWISKRGKKICKNCYSKEYGENGIRKKLYATRGRKVNPSYNIFNATKKLAATHYNYAIREAFQLLEANRKQRQERIRRLLRDKKRLREFEDLIEKPDRRIELPMKTRQREKRYIHISQKDKINELRGYTLHKIKEKIRILRRNTEREERALRKKTPIIFKGNRIMLFPQGIKFDKENNKVKITIAKNLPKEFIFSGTNVANKHGRRFFKEKLNLISQQKPKYAYLIRKQTKNSKKITDYDYYLQYTIETVYKIRKNYDGIIGIDRGINNLACLVLLEKNQEKPCGVKFYKGKEINALKIKRRKQLYFLRRKHNRKQKQKRIRRIEPKINQILHIISKEIVELAKEKNFAIGLEQLEKPKKSRFRQRRKERYFLSLFNFKTLSTFIEYKAKKEGIRVIYIPPERTSQICSHCAIKGDVHTNTIRPYRKPNAKKSSSSLFKCKKCGVELNADYNAAFNIAQKSLKILST

SEQ ID NO: 61744 - protein, 1341 aa, Unknown
  Microbial Source - Accession No. Ga0190361_1000443
MNKQNTKQEIWSRFTRLYSLNKTLRFELKPVGKTADFLKQNKVFERDKTIDDSYNQAKFYFDKLHQKFINEALKKKNVRGLDLKDFADKFLQLKNEIQILKQKGERNKIYQTEKEIADLRSKYYRQIKSFLDKRASDWIESYRRKGVKLHKTDLKQNGTDFLTKAGILGILKYEFPKEKETKFVKQCWPSLFVDDKVDLGNKVYIFDSFNNFTTYLAKFQETRKNLYKDDGTNTAVATRIISNFERFLSNKKIFDEKYKNLKGIGLAKGQMKIFKHDYYYNCFIQEGIDKYNKILGEINKISKEYRDKNKLDKSQLPLFKTLDKQILGEMVKKKEIITKTENETEAQSFVKIFKELITKNKAKIPKAKLLIDDLTNGKFENDYEKIYLKRQAINIIANKWFRNPTEFLSKLPQSSKSRKDGESLKIKSFISFLDIKNGLEELDDERDYLGRIFKDKYYRDENNNEVLLNENVRESYYSQFLKVLKYEFESLFKDKFEIKTDKKEKQIFWGYTRELESKAEKLSSFTREKISLVKNYCDASLRIYQMMRYFSLETKSEKDIPVDCSTEFYNRFDEYYKDFNFIRYYNAIRNFVTKKPFDDDKIKLNFESGNLLTGFDKNKESEKLGIFLRRDNKYFLGIINKEHNKIFDEKKYPELKGKATDRYEKMELRLFPNPKRMIPKIVFADKNVKEFGLSENIKRIKEDMRVRKENKFSKDKLIKLIKYYQDCLKKGGYKKEFNFTWKNADEYQSLSEFYSDIEKNNYKIKFIKISDRYIDERVAKGDLYLFEISNKDFVWPNKKKNIHTLYFLNLFSDENLNNPIFRIGANAEIFYRPASLKPKKEIRGRHKKKIIKYKRYTEDKILFHLPIVINATKGSLKQRQFNKRLNQFIAKNKDRINIIGIDRGEKNLLYYTVINQQGEILEHSSLNEINGVNYFNKLVEKEKERQLNRQSWEPIVKIKDLKKGYISYVVRKIADLVEKYNAIVVLEDLNMRFKQIRGGIERTIYQQFEKQLIDKLGYLVFKDNRNSQSPGGILTGYQLTAPFTTFRDLGKQTGIIFYTTAEYTSKTDPLTGFRKNIYISNSVSNKEVIKLIEKMKIGWDKKEKSYYFIYNQKDFNSLIDKEWIIYSKVPRVRREYNKKSGKWDYKLIKPENLNQLFKELFEKWNFKNIKSNNLKFEILQRKEELAKNRHIIDDKEVNFFQRFIYLFNLLLQIRNTISLNFEFDSYSRRLKQIDYGVDFIASPVKPFFTTAGIIYLGKESNENKIEKDQKKILVGKNFADFEKLFKNCSSDGFDSDGVGAYNIARKGIMVLERIKENPDRPDLYISKEDWDKFVINNSLVK

SEQ ID NO: 61745 - protein, 541 aa, Unknown
  Microbial Source - Accession No. Ga0190361_1001609
MITLQARLQIENKNLLILENLMRRYCSAYRYAYNRLLEKKNENDVRKEIQKIFNLHSNYAESAVNEAKALIFSCKERGQNPKKVIFGGRLLFEKLSKKHLTGKKREKLKEKWKEKRQGVLYAIGRKHRKGNLNLRLVEIENNLYLRINTGKKEWIYAKIIRKVKRNKDKWIDFIQRLKLAEKTKEYFPYTVKILKRDKKFYAHISFEEILPEKLKITKENGIIGIDVNASPFHLALATSSKDGNLLSYKKISLHELINANKNKRKYLEWLTAHEVINYALKNNKAIAIEKLEGLKNEKRGSGRAKFRKRLQQFCYRNILEKIKILAKREGIEIIEVNPFYTSVIGKLKYSPLYNIDKDTSAAFVIARRALGFKEEIPENYKNLLKDEDFLSYAIAELEEKVEEIKEKKNKEKNKYKRNVIKTELKKLKNELNLLKKHLKDLKSGKREPATQQPVNLGKKQVRGKLSGLLKSWRVLSAALTVPYLEKFLQVNGTCRDFSPLKKLLIKGDWIRAVSRLVPDSGQGRNFYKFGKQLNIFEKLVS

SEQ ID NO: 61746 - protein, 340 aa, Unknown
  Microbial Source - Accession No. Ga0190361_1003780
METVKLTVRAVIPPRDKGLRKLMREYKAYKKALISKVREAVREVIKDKNLRIYSQQKWMVDKKLNEYLKNLPFHPMPFHNQSVWIQKKDGRFWIHFKTKEGEAVCYLHVPAKYQSLIEKASGENNSILGQVELIEDKKYGWVNCHITLRLPKPKPYEPKAWLGVDIGWNKLATSIACTCNPHLKFFSPTVHGKQFKTRIIQLRYLLKQYSRKKKAWKKWDYRLKHTIKYTVGVVAKEIVSKAKKLKAGVAMEKLTFKSTTKGYLVPRYKLTIAVKTLCEREGVPFKLVPAQNTSITCPYCGHKDKKNRNGERFKCRKCGYQADADIIGAMNVARGVINGL

SEQ ID NO: 61747 - protein, 390 aa, Unknown
  Microbial Source - Accession No. Ga0190361_1003780
MEKNETVKLTVNAVIPPRDKGLRKLMREYKAYKKVFISRVKEAVKPVIKDKNIEVYSIQKHLLGKKLTEYLKNLPFHPMPFGNQSYWLEEKDGNFWIRIKTKDGEAVCFLKVPSKYQHIMKKASGKTCPYQTNGGCEFATCPFNTPKMCSKINPHLGEMELIEDRKYGWVNCHIVLRLPKPEPYKPKCWVGVDTGWNKLATSIACAVNPHLRFFNPTFHGKQFKTRIVQLRYLLKQYARKGRAWKRWNYRLKHTIKYAVGVVAREIVSKAKKLKAGVAMEQLTFKSTTKGYLVPRYKLMIAVKTLCEREGVPFKLVPAKNTSITCPKCGYKEKKNRNGEWFKCLKCGYQTDADLAGAMNIALRALTATRMEGLESQLSTATYILGELTVL

SEQ ID NO: 61748 - protein, 350 aa, Unknown
  Microbial Source - Accession No. Ga0190363_1000125
MGSQPTIKITVKGVISPRDLGLGKLMREYVVYKKVLISRVKDAVRQIVKDKSITVYAQQKWMVDKKLNEYLKNLPFHPMPFHNQSIFIENRNGHFWIHFKTKQGEAVCYLRIPEKYYPLIEKACGTTFGENPVLGQVELIEDRKYGWINCHITLRLPKPEPYKPKGWLGVDIGWNKLATTILATKNPHLKFCNPTVHGKTFKTRILQLRHLLKEAQRKRNAIKKWENRLKNTIKYVVGFTAREIVSKAKRLEAGVAMENLSFKSVTKGYIVPRYKLIVAIKTLCEREGIPFKTVPAQNTSITCPYCEYTNDKNRVGKRFQCLKCGYQADADIVGAMNIAKRAYDSYPDGG

SEQ ID NO: 61749 - protein, 483 aa, Unknown
  Microbial Source - Accession No. Ga0194111_10067953
NKFVFTSGECDYCQKQNDISYVHSRSGKKICRSCYDKEFSVNAIRKKVYPTRGRKSNPNYNIFNATHKLSGTHYSYAVDEAFQLLEANKRQRQQRIKRMIKDKRKLREFEDIAKYSDKRYELPMKERQREKRYVHISQKDRANELKGYTMAKVYGKIKILRRNTEREEKSLRKKSPIISKGKRIMLYPQGVQFEREKNKVKVSISKDLPKEFEFSGTNVASAHGRLFFEEKLKEILKQKPKYSYLIRKQINKDKDSPKYEYYLQYTTEIPPKAEISYKGVIGIDRGSNPNLAVLAFLEKEKDKPSIVRFIRGSDIVALKVQRRKHLYFLKGAHNKKAKIKNIRLIEPRIQQILHTKAKEIVELAKDKNAAIALEQLEKIKKSKFRQRKIEKFRFSLFNFKTLSTFITYKAKKEGIRVIEVPPEMTSQTCSHCHSVDTQRPYKKPNAKFASYSLFKCNKCGVELNADYNAAFNIAQKGLKILNS

SEQ ID NO: 61750 - protein, 462 aa, Unknown
  Microbial Source - Accession No. Ga0207429_10023
MIGGINVAKRKRDKNAVVKTLKIELVDVLNYEPPPKKDGEEYSEKEKRRELIKELRRLQRKVAQASNYISREYFLWELKRREAEEKGIILNEKQELGTTLQNKGYRIAAEVLKGFNTENIAVLSSQLWENWKKRVSDVFNGSMSLPSYGQKQPIPINKKNYNIIPYKNNKYMIEITFYSPSEGRNRKLQFITANLNDYSQNIIKNILSQKYRKGSANFIIENNPNKNLSSQKIFFHISYEFIPQPQDESTENILGIDLGLKNVVAMQVYNPKKQEFEYIKYNDCIIEGGELVAIKRKIEALKHKKGKATKWKGEGNTGHGRKKKMKMVYSIGKKISQIKNTYNNKIAKYIIDFALKHQCKYIKMEKLTSHGFENTLLQEWRYYDLQTKIKNKAKENGITVLFVNPKYTSQKCSVCGYINSENRKTRDNFKCTKCDNEMDADINAARNIAVSEDIIKEDDEED

SEQ ID NO: 61751 - protein, 401 aa, Unknown
  Microbial Source - Accession No. Ga0207433_10006213
MEEQLKLCVRAVIPPKDVGLRKLMHEYVVYNKVLIPRVKQAVRQVIKDKNITVYSQQKWMIDKKLNEYLKNLPFHPMPFHNQSVWVQEKDGKFWIHFKTKQGEAVCYLHVPAKYHSLIEKACGEDNPVLGQVELIEDQKYGWVNCHITLRLPKPKPYEPKGWVGVDVGWNKLATSIACTCNPHIRFFNPTFHGKKFKTQIIQLRHLLKQFQRKDTNVNKWENRLKNTIKYAVGAAAKEIVSKAKKLKAGIAMESLTFKAVSKGYLVPRYKLMIAVKTLCEREGIPFKLVPARYTSITCPKCGVKHEKNRQGKRFRCLKCRYEADADVVGAMNIALKAFDSFPDGGENDVGFTPASKADRGLPREVGHVASPQAPMNDDSYKAGRKHNKIENEVRKEGLSRL

SEQ ID NO: 61752 - protein, 1008 aa, Unknown
  Microbial Source - Accession No. Ga0207433_10011113
MPQQPTTQRAYTLRLRGADPNETSWREALWQTHEAVNKGAKVFGDWLLTLRGGLDHALADTKVKGKKGKPDRDPSAEERKARRILLALSWLSVESKLGAPADFIIASGEETAEARNAKVIAALEEILRSRDVAEEAIGDVTKKPEDQPGTWIGDCAPSLTAAIREDAVWVNRSKAFDEAVKSIGSSLTREEAWDMLERFFGSRDAYLAPAKGSEDESSETEQEDKTKDLVQKAGQWLSSRFGTGKGADFCRMADVYKKIAEWADNAQADTTGNDAINNLAAFLSEFNPASNDLKGVLGLISGPGYKSATRNLLTQIAAKATVTQQDLARLKDTATEDARKCYQNTGSKGQRRYADSILKDVESVCGFTYLQEGGPARHSEFAVILDHAARRVSLAHTWIKRAEAERRKFEEDAKKIGQVPKAAKDWLDQFCLERSGVSGAQEPYRIRRRAVDGWKEVVTAWSKADCKTAEDRIAAARALQDDPEIDKFGDIQLFEALAEDDAVCVWHKDGDAAKTPDPQPLIDYALAAEAEFKKRHFKVPAYRHPDALLHPIFCDFGKSRWDICFDVHKNTKTPFPRTLCLTLWTGSEMVSVPLCWQSKRLARDLALDHGRQDLGSPKVTRADRLGRAASNVTENDEVKIAGLFEQADWNGRLQAPRQQLEAIARYVAKNGWDEKAKKMRDAIQWLVTFSAKLQPNGPWCAYAEEHNLNKDPQYWPHADTNKDRKSHARLILSRLPGLRVLSVDLGHRYAAACAVWEALSDKAFKEDLEGKKIIRGGTSDNSLYCHTEHEVNGKKHITIYRRIGADTLPDGTPHPAPWARLDRQFLIKLQGEEEGVREASNEEIWQVHQMECTLGRKTPLIDRLVAAGWGSTEKQKARLDALKNLGWKPVEKAETSEDADTEEEELSFRPSLSVDELMSSAVRTMRLGLKRHGDRARVAYYLITDEKTKPGGIKEKLDENGRIDLLQDALVIWHDLFSSRGWRDDAAKRLWDENIARLCGYKAPEEIG

SEQ ID NO: 61753 - protein, 1384 aa, Unknown
  Microbial Source - Accession No. Ga0207433_10012523
MTNNIKNQKSIWSEFIKQYALNKTLRFELKPVGRTEDFLKQNKVFEKDKTIDDSYNQAKFYFDKLHQKFINEALFSESVKSINLKDFTEKFLGLKSEIQKLKSEKKQEEANKKEKEVNDIRNDYYKKIKSLLDKKAEEWKKKYKDGGLKFRKTDLKQKGTDFLMKSGILGILKYEFPKEKEEEFKNKDWPSLFVEDKANPGNKVYIFDSFNATYLLKFQETRKNLYKDDGTSTAVATRVISNFEKFLNNRKIFEDKYINHWKEVGITEEEKKIFETDYYYNCFIQGGINKYNDLIGQINQKTKQYRDKNKIEKSELPLFKVLDKQLLGEVIKERELITKTENETEEDVFVKRFKEFVDRNKQRIPRAENLMNDLINEKFESDYYGIYLKRAAINTIANRWFKNTTEFLLKLPQASKSKENKESPKVKPFISLLDIKNALDDFEKEKESLGTIFKDKYYKTKESDEAPLNNDSQESYWKQFLKIWGYEFNQLFEDKFNEEGIKIFWGYAKELIEQAENLNSFSRKKEEIAVVRNFSDAALRIYQMMKYFALEAKKEDDIPLDYSTEFYNRFNEYYQDFKFIRYYDAIRNFVTKKPSSEEKIKINFESEELLRGWDISKIKGCLGIILIKDNEYYLGVVKKEKDKLFDYYENKNDTEKDIQRKNHLKKEIIAKPNEDYYIRVKYKQIANAGKDIYNLVLMPDGNAVRFTKKEKKEKYWPEEIKRIKKEGSFKNNKRDLVKFIDYFKKCASIYWKEFNLRFKSSEEYENFKEFTDSINIQGYKISLDEENENKIKSEYIEKQINEGNLYLFKIINKDFCKNKKQNSKKNIHTLYWEYLFSKDNLIKNEYPIIRLSGGAEVFYRKAFNVKKEPVVLKRGNSEKPALRENKPIFHLNRYLEGKYLFHCPIQINATAISNISNKVFSQKINNFISDKNEINIIGIDRGEKNLLYYTVINQKGEILAHKSLNEINGVNYLEKLIEREKERQIDRQSWEPVVKIKDLKKGYLSYVVRKIADLAEKYNAIIVLEDLNFGFKQKRTKIERTIYQQFEKQLIDKLGYLVFKDDRGSESPGGVLNGYQLVAPFTTFKDLEKQKQTGIIFYTNAEYTSKTDPITGYRKNIYISNSASQKTIKENLINKLKALGWDEKEKSYFFTYNQKDFGSPISKEWTLYSKVPRVRREKNNSNGYWDYQPIDLNEKFEDLFEKYGINKKSSDILSEIKELIKNNEEKLIQKQEFDGKSKKFHERFIYLFNLLLEARNTMSLKVKLDKRGNEIKLDEIDYGVDFFASPVKPFFTTAGIRFIGKQNEDKKIEKQIKEKFAEENFADFKGLFKDCSSDGFDSDGVGAYNIARKGIMILERVKQNPQKPDLYISKEDWDDFVLKNAIIK

SEQ ID NO: 61754 - protein, 1239 aa, Unknown
  Microbial Source - Accession No. Ga0207433_10020534
LLGLDPATTDFADCAKRVLRNNGATAEARAAALFQLLQEANASANASDLNQMCVSRLPWFNITLTGKLNRQRLNQMCVSRLPWFCTPKGQLAATPKTVVAQQENAMLAIIRDVHEAAPADLKTVAQRLEPGYFVTQFPKQQMTGDEARAEAERLFAACQKKFKELAEYEDGYRQCLDALGPNLSLPRLGRKPKGAYPYAVVFKLMPTNATWECFKRVTASLYKRAQKGVVSPVSADSIADVRTNDEPLFEYFTNLALVRPPGNKDRAVWFEFDLAAFIEAIKSPHQFFQDTIKREQAVAQIKAKLDAMDGQGRAASGEEDALPGFEGDDRITLLRELVTDTLGYLAEADASTSPGGKIEYSIQERTVRGFAEVKRRWRDLVEKGKATEDALLKVLAEEQTEHRDDFGSATLYRELAKPKFQPIWRDPGTQPWHADDPLRAWLEYRELGRELEDKQRPIRFTPVHPVHSPRFFIFPKKKGGGRFGTVHEPGQLRVMAGIVAQTQHGWEPVPVRITYAAPRLRRDQLRDDVETDLESRPWLQPMMQALGLPEPDTADFSNCRVTLQPSAPDDIQLTFPVDVSADKLTTAIGKAARWAKQFNLFPDGDNFYNASLRWPHEKKPSKPPVPWHEALDNFSVLAADLGQRCAGAFARLEVRANDDFAGKPSRFIGETPGKKWRAALVAAGMLRLPGEEQTVWRPGATGPNFHTELSGSRGRMARPHEADDTADLLRAFDCPEESLMPADWRTSLSFPEQNDKLLVAARRYQSRLARLHRWCWFLTDEKKRQTALDEIREAEDMPAADDPQLTDKLRALLLQKQAALPGLLVRLANRILPLRGRSWQWETHPDKADCHLLTQTGPALPDVWIRGQRGLSMQRIEQIEELRRRFQSLNQMQRREIGGKPPIRRDDSIPDCCPDLLDKLDQIKEQRANQAAHMILAEALGLRLAPPPADKRQLRASRDVHGQYVKSREPVDFIVIEDLSRYRSSQGRAPRENSRLMKWCHRAVRDKLRELCEPFGIPVVETPAAYSSRFCSRSGVAGFRAVEVGPGFDREFPWMMLKDREDEGEPVRQLILQVATLNQGRDGKPPRTLLAPLAGGPIFVPIVDKLNGADIQPALAQADINAAINLGLRAIADPRLWSIHPRCRTQRQGDQMLTREKRKFGETGQPLAVHRADGVKPDDTRNPNFFADISGSLPAWESATLDGQHLLSGRCLRSEIKKRQWQRCAEINDRRMNRWMKGE

SEQ ID NO: 61755 - protein, 591 aa, Unknown
  Microbial Source - Accession No. Ga0207433_10021674
MTETLEILETPGETGRDEEKTVIVRQYGLLPPVDWDQDCQEHLWFQNRLWNTLVELERKHREDYFRLTGEDPELREIEDVLKALVEEKEALIGEKKALRQAARKKAGVDTAAQDLRIAEIRPEIRKLAGLAKEKRKEVRERLKPELDRLEEKRREAVKSARNASGLWWGNYNAVCASYETARSRALKSGAELKFHSFDGTGRFTCQIQGGMTVAEFFSGDRAAIVSADPVSPDAFWHPSRGERRRAARTKLRMTVFTTKDEKGHYVRRILTFPMILHREIPSDALIKQVVVSRKRVGTEFRWTVTITATRSGPPAVRADNAGLCGVDLGWRLVPEGLRVASIADAKGVRHIVLPEKMLRRMDHVEDLKSQIDQDTNRLLLWFRSRWPEISESFPEEIRERFLRHVRSPKVSARHLSGSVLAWRDNHGDFRPDLLAALETWRKSNKRLTQEMDNLRDKLSAQRTDLYRNEALRIVREHSVVGVEDFDLREVVKLEMPDGEKTTQPAAARANRVRAAVSDLRNWIRIQAAKTGSTVVRIPSADTTRACRTCLHVNRAGNPEDLIWKCDGCGAVWDQDENAAKNILRTVEVANG

SEQ ID NO: 61756 - protein, 1189 aa, Unknown
  Microbial Source - Accession No. Ga0207433_10022806
MLPFGAGALIIILNMQKGYNLHKKRIDLLNGEILRTIKYPLKPLNENSEKNKKQFELQIINDDLKIRGDLNLNDYLNYTFKNNHIYNLFDFWIDSLKCGVIWQPSFNNLKNLIEKIYLNKTISEEIFDNSIPEIKKFFDKNKFIENFILRTGIRENKSKKSFEKDLIKSLNDEFNKEEINKEAQDLIDKIINTFFNENKLKKLTIEEQNNLWLNKFNIDKSKLKTKELKYNYTFFIIPELIKFKENNLENLLNIRYEFIKNKNLNIEILQEILGLENNFNSFSNYFNEIIKNLQNDEYNLIYEDFISFYKFTNEEKEKILQSLKYLSEKSKQLGSPQILNLSWADYRSILGGKIQSWFTNYLQRKEKLEEQLNSLKENINKTKEYLLENFQENTDLKEIIYFLDKLFELSEVSKINNLFFDIHSTCKLKINNFFQKNIKQNEDDTVESNENLKGIFEKIYKPLNFYGQSRRENNIKIINSLQTVELGIIYTKKILNFLKNDLDFNKEENFEEIYRKNLNFLWNKLKENSLNSKNFKSKYKEIIIKNLNSYSNIKFEKIIKRPSYYVFYKSIYSKGTNLQIEFNKEINFKNIFIENINELYNFLINLEDKEIITDKNLLLDWIELSKNISSYFIKFTNIEKINLKEIFKDKDLNFFSNIAKYFETFGNVVEKQGLSYFVQSIFFSEFKGAATLYTKNKYLAKYNIQIIHSNEKFPLYYYSNNLKNHNKLLNPKDLIREKHNYFVSLKKIKILKNKDLEFLLLNKDNFQKIYNSFEDNKNDLLKLESSFYQIQFLEKFIYKPKNWENSKIELSEWSFILEKEYEIKWDLENKIPILNEIQNSKKNKLYIAIPFKISSYQKEYEEIKKSKENYILGIDVGEYGIGWVLINYKNKELKIINKGFFVSKNIAKIKDEFSKIQKKSQKGIFNESSNLISEIRKNAIGELRNKIHSVFIFYHSKNICYEYSINAFETGSGKTTAIYKSIKKSDTLSIIDADKKEQMHIWGKKLNKEIEIGKNLSSYASSYICSKCGKSLYQLKETDLENNEIKIIEREGNILKIKTPYGNVYAYSSKKEHQVDFIFNKTKSSFKELQKIMKDFARPPLNNNSEVIRKFTNLKENEIDILHQKRGSSCVFVCPFCLHVSDADIQAALMMSIRGVINNETKSKGEKIDYFQKNLEFLNELKEKPVIDL

SEQ ID NO: 61757 - protein, 396 aa, Unknown
  Microbial Source - Accession No. Ga0207433_10030792
LETIKITVKATIPPRDPGLRKLMREYTVYKKVLIPRVREAVKEVVKDRAVAIYADQKWLVAKRLLEYAKNLPFHPMKFSNKSYWVEWSEGFLLHVKTADGEAVCNLNVPLKYRSLLQAASGKACPYKGKCKPCPFNTPKMCDKINPHRGEMELIEDNKWGWVNCHITLRLPKPQPYEPKGWVGVDVGWNKLATSIVCTRNLQVRFFNPTFHGKTFKTRIIQLRHLLKEYQRKSRSVKKWGNRLKNTIKYAVGVVAKEIVSKAKKQKAGVAMESLTFKPVSKGYLVPRYKLMVAVKTLCEREGIPFKLVPAQYTSITCPKCGYVDSKNRNSEWFKCLKCGYQTDADLAAAMNIALKALNSSPNGGENGVRHALTPKTDEATRLRGAECCDPHKGDEQ

SEQ ID NO: 61758 - protein, 615 aa, Unknown
  Microbial Source - Accession No. Ga0207433_10045901
MLALKLKLDPTSEQMTVLDKMFWKWASICSRISAGKGKVTLEKLAPSESVTGIWFSKTQLNQAKTDVSDLVSALKKSAKQKEKSLGRDEERAREIREAIDHPESRDVNPERASNFRIKAWVQKTGNLSQKYHTIKYWQGQLKRLENAIQKRKQTIETIKKGRIHFKPTRITLHQNSFQISFGKNKLLLKPFHKSPSAQPPLEVPIITYPQQPLVGHNGGKSSQRSLEFLEHGILEFLAFALDKRFFGMNDAEKMLLKAKKPEKLLIKEAKLAKKKEAFNSKIKEVQKMLGRELDDNEKKILLEESKRFFKDIEAYRPNADYIKLLKKLADELFRKEDYFSPNKYPILVRKPINKYKVKKFSNLKPIDWEYFLQLSYEPFGAEPIAAKTVMGVDRGVKHLLAVAIFDPNTKTFTFNKLIENPVIGWKNRLKRLRKAIQRLERRTRVKTGEHILENQLKIKLKSIENRIKNLYHNISANIVKIAKDNQSVIVFERLEGRGLKQHGRSKGKRMKALNYFLSNFDYGKIASLIKYKADKEGVPVFDINPAYTSQNCAKCLLESGNLSDSEKNYYRDKNNSKIGYCKKHGYIDADLNAARTIAVCYDKGLNEPMPFDSRK

SEQ ID NO: 61759 - protein, 319 aa, Unknown
  Microbial Source - Accession No. Ga0207433_10075234
MRVSSLYRTVIIRLYPTEQQEKLLLKAEKEVLKFLEISRFEFQKMLYHKICEEIGISKRSLSLLVQRFTGSMGEKAILPFDDNAKFVNDNGIWFLEVQLFAGKGNRIRIPLAKTEVPYYSVLDELDGLPIVITRENSDWFAYVSIPVSRASNGLIVGVDFNYRKWVASPYKGKPFFFDVGEYVEKIDRLQRMASRFQSRGEEEKVKECYHLIRETVKLAHGNFLSGIKERFGVCTIAMEDIEKMYKMIEEIDSKMTNNWLNTKTALRQFILRAMAKGFEVVEVDPKDTSKTCHKCGNPVKIYGKHKRLASCEFCGYRDY

SEQ ID NO: 61760 - protein, 316 aa, Unknown
  Microbial Source - Accession No. Ga0207433_10075916
YSLSLLAQRFTGSLGNKAIIPLNTAYNARFICENGIWFLEAQLLKGRGNRVKIPVAKTENKYYAAIGELDGLPLYVTREDDKWFAYVSIPVNAENNGRVIGVDFNVMEWVVAPADGGPVLFFDASWYSREIDRLQRLRAQLQSKGDLEGVQAACKSMLDIVKLAHGNFLARIQEKFGVCVIGMESVETLYKLTEKDNAMINNWLYSKTALRQFALRAMAKGFEVVEVDPKDTTRICHRCGAPVKINGRRGRSITCPSCGLTNYNRDLNAARNIARKAAEEWAKRVESRKQLEKLEPIAIVANGGGKDENKPEDEST

SEQ ID NO: 61761 - protein, 368 aa, Unknown
  Microbial Source - Accession No. Ga0207433_10082276
MNDLIKFAVTCGIDPRDHGTLKLMKEYKIYKKQFLSKVKNAVNQVVKDKNVYVYSIQKFLLEKKLLEFVKNLPFHPMPIGNQSYWLEKSTFKTPIGEYPCVNLHVKTKDGEAVCKLIVPKKYKDYVLEATGKSCPYFHDGKCEFERCPFGTPKMCKKINPHRGELELIEDLKNGFIRAHIVLRFPKPTPYEPEGWLGADVGWNKLAASIIYKKNPGFFAPSVHGKDLKTRIIQLRHKQKELMRSGKISEVWENRLQNVIKYAVGKTAKEIVSKAKKHRVGVAMEDLNFQSVTKGFLIPRYKLMVAVKTLCEREGVPFKLVPAKSTSITCPKCGCVDENNRNGERFKCLSCGYEADADIVGAMNIAKKA

SEQ ID NO: 61762 - protein, 837 aa, Unknown
  Microbial Source - Accession No. Ga0207747_1007959
SRAIRGWTEIVKKWMKLDPSAPQGNYLDVVKDYQRRHPRESGDFKLFELLSRPENQAAWREYPEFLPLYVKYRHAEQRMKTAKKQATFTLCDPIRHPLWVRYEERSGTNLNKYRLIMNEKEKVVQFDRLICLNADGQYEEQEDVTVPLASSQQFDEQIEFSSEDTGKGKHGFSYYHKGINYELKGTLGGARIQFDRDHLLRRQGVKAGNVGRIFLNVTLNIEPMQPFSRSGNLQTSVGRALTLKNFQVIAFKPKELTEHIKESEKNAPALGVESLQTGLRVMSVDLGQRQAAAISIFEVVSEKPDDNKLFYPVKDTDLFAVHRTSFNIKLPGEKRTERRMLEQQKRDQAIRDLSRKLKFLKNVLNMQKLEKTDEREKRVNRWIKDRGREEENPVYVQEFEMIRKVLYSPHSVWVDQLKSIHRKLEEQLGKEISKWRQSISQGRQGVYGISLKNIEDIEKTRRLLFRWSMRPENPGEVKQLQPGERFAIDQQNHLNHLKDDRIKKLANQIVMTALGYRYDGKRKKWVAIHPACQLVLFEDLSQYAFYDERSRLENRNLMRWSRREIPKQVAQIGGLYGLLVGEVGAQYSSRFHAKSGAPGIRCRMVKEHELYITEGGQKVRNQKFLDSLVENKIIEPDEAWRLEPGDLIRDQGGDKFATLDERGELVITHADINAAQNLQKRFWMRTHGLYRIRCESREMKDAVVLVPSDKEQKEKMETFFGNGYLQPLNQENDVYKWVKGEKIKGKKTSSPSDDKELVSEILQEASVMADELKGNRKTLFRDPSGYVFPKDRWYTGGRYFGTLEHLLKRKLAERRLSDGGSSKRGLSNGTDSDSNVE

SEQ ID NO: 61763 - protein, 1283 aa, Unknown
  Microbial Source - Accession No. Ga0207868_1000002
MNRFINKYSLSKTLRFELEPIGKTIENIQNKGLLIKDEQLAESYKKMKKTIDGFHKYFIELAMQNVRLTKLEAFADLYFASPERKKDEKFKEELKKVQDELRKEIAHGFKTGAAKEIFSKLDKKELITQLLENWINTQPEKPYFDESFKTFTTYFGGFFENRKNIYSDKEQSTAIAYRMIHENLPKFLDNIRVFGQIKNIPELYENANLLFQEIKNDLNINSIDEAFELKYFNEVLTQKQIDLYNLIIGGRVPEEGKSKIRGLNEYVNLYNQKQKDKSKKVPKFKMLYKQILSDREKTSFVPEKFQSSEEVTSAINSFYHCNVISFQPKDKPDAENILEKIQDLLAALKDYDLNKIYLRNDSQLTFISQKIFGNYAVLGDALNFYYDNVMHPGYEMEYKSANERKKKKLEEEKQAFIQQDYLSIGQLQDALDKYIPEIDDSVDWKRNYTTSCIADYFKNHFNAEKKEGEEKEFTLPANISAKYSCVKGLLENYPKDRELYQDKKAIDNIKLFLDALLELLHFIKPLILRADIALEKDAAFYGQLEPWYDSLKELIPLYNKVRNYATQKPYSIEKFKLNFENSTLLDGWDVNKEKDNSGVLFIKDGHYYLGIMDKKHNKIFRDIPKATSERTYRKINYKLLPGASKMLPKVFFSDKNTSYFSPDEEIQRIRNHGTHTKNGDPQEGYEKLDFNLNDCHKMIDFFKSSIQKHKDWKNFGFRFSPTYTYDSIDAFYREVEAQGYNITFTEIDESIIDRFVEEGKLYLFRIHNKDFSPFSKGRPNLHTLYWKAIFSPENLKNVIYKLNGQAEVFYRRKSIQPEQMVIHKSGEAIDNKNPLTGKKQSTFHYDLIKDKRYTVDKFQFHVPITLNFKASESNIINYEVLQYLRTQPDVHIIGLDRGERNLIYLSLINQKGELLYQEPLNALKSDKFNVVTNYQELLARREKERDMARKSWGTIENIKELKEGYLSGVVNKIATLMVKHNAILVMEDLNTGFKRGRFKIERQVYQKLEKMLIDKLNYLVFKDKSEDEPGGLFKALQLTNKFKSFKEIGKQNGFIFYVPAWNTSKIDPTTGFVNLFYIHYENMEKARAFFGKFQSISYNHDKGYFEFAFDYNDFTTKAEGCRTNWTVCTHGDRIRAFRNPEKNHQWDYKTIHITEEFMALFRKYGIEFSGNKDLREIITGQKDAAFYKSLLDLFRLTLQMRNTNQDWDYLISPVLNENGEFYDSRKADNHLPQDADANGAFHIAKKGLMWLKQIQQFEGDNWKKLDLDKTNKGWLRFAQGYQF

SEQ ID NO: 61764 - protein, 536 aa, Unknown
  Microbial Source - Accession No. Ga0208151_102415
MSSKTSSDKKNGKHSRQKESDNKRSLTVRLNLSMEQQIYLTSLIKAYTSIAKKLHEEARAKFMELTNGEIKNIKELKDVKKKFNSWFNEYFKTQRKWITDSLGSNISDQLFQFLMAQYKNFFANYENFFEHKVDGRPSFPSLPELFQIRDRGVEVDFDKKILIIKLKGKQLRLKFQSDRILYHGDPGAVTIKKVDGKFYAYIPFDFNPKFNEEKKGAIDIGLSNFFAAVTEDGDVILVKAKQYTYIYNMYKQRIKELDRMIGNIRKHTLKMYVTPPKSFRYHPLLGFTNNREVSKILISLYTSRYDEKRGKKKKLTREDMTNIVKKIRKVNYSLRIKRLNFMKVDGHIKLFPKKSRFMNDVYRDLPMLHKLEYERRKLFEKRDRTLTHIRRTAINALLRILKERGVTRIVVGYPRYINKNRNELTVNLFQYRKTINDLKIIGERYGIKVEELEEYGTSIRCSICGEEHKNGRIERGLYRCEKTGKTINADVNGALNIFYKAFSKMPKQLKKIETIKLTSSPPQRDEVSHLLSYRKL

SEQ ID NO: 61765 - protein, 1459 aa, Unknown
  Microbial Source - Accession No. Ga0208195_1004385
MPQQVKPPVTQRAYTLRLRGADSNDQSWRDALWQTHEAVNRGAKAFGDWLLTLRGGLDHTLADTKVKGGKGKPDRDPTDEERKARRILLALSWLSVESKLGAPEGFIIASGTEAAEDRNAKVVAALEEILKSRNVATNEIDEWKNDCSASLSAAIRYDAVWVNRSKAFDEAVKSIGSSLTREEAWDMLERFFGSRDAYLAPAKGSEDESSETEQEDKAKDLVQKAGQWLSSRFGTGKGADFRRMADVYNKIAEWAGNPQTSTTGNEAINNLAAALSEFNPASNDLQGVLGLISGPGYKSATRNLLTQIAAKATVTQQDLASLKDKATKDAQKCNQNTGSKGKRPYSDAILKNVEAVCGFTYLQDGDSARHSEFAVILDHAARRVSLAHTWIKRAEAERSRFEEDAKKVDQVPEAAKDWLNNFCLERSGLSGAQEPYRIRRRAVDGWKEVVTAWSKADCKTAKDRIAAARALQDDPEIDKFGDIQLFEALAENDAVCVWHKDGDAAKAPDPQPLIDYALAAEAEFKKRHFKVPAYRHPDALLHPIFCDFGKSRWDICFDVHKKVQTPFPRALCLTLWTGSGMVSVPLCWQSKRLARDLALGQDAQNDGSSEVTRADRLGRAASNVTKSDEVKISGLFEQADWNGRLQAPRQQLEAIAVVRDNLSLSDQERERRMSGLMDRIRWLVTFSAKLQPQGPWCEFAEKLQLRINPQYWPHADTNKDRKSHARLILSRLPGLRVLSVDLGHRYAAACAVWEAVNAEQIKVACQAAGHREPKESDLYLHLKRKVTKQKKGNQVESEKTTIYRRTGADTLPDGKLHPAPWARLDRQFHIKLQGEEERVREASNEEIWAVHQLEAELGRTVPIIDRLVKAGWGQAGKQKTRLEALRELGWTPAKEAQGSDETEEGEPRKPSLSVDELMSSAVRTMRLALNRHSDRARIAHYLITDEKTKPGGIKEKLDENGRIDLLQDALVMWHDLFSSRGWRDIAARQLWDDHITRLSGYKAPEEIGEDASGVERKTKQKENREKLHDVAKALAQDVTLRGALHDAWKKRWEEDDGRWKKQLRWFKDCVLPRGKHASDPTIRKVGGLSLPRLATLTEFRRKVQVGFFTRLHPDGTRAETGEKFGQSTLDALEHLREQRVKQLASRIVEAALGIGSEGGKGWDGAKRPRQRISEPRFAPCHAIIIEDLTHYRPEETRTRRENRQLMTWSSSKVKKYLAEACQLHGLHLREVSASYTSRQDSRTGAPGIRCQDVPVNEFMRSPFWRKQVKQAEAKQAENKGDARERFLCDLNAMWKDKTVADWEKAGIIRVPLRGGEVFISADPISPAAKGLQADLNAAANIGLRALTDPDWPGKWWYVPCDPASFKPTSDKVKGSTAINLDVPLKDVSAVSGDVTRKKSGKAKSQSKEVVNLWRDVSSREILTTGVAWEVYSAYQNQVQARVVDILRRSACPKNSREKQ

SEQ ID NO: 61766 - protein, 1546 aa, Unknown
  Microbial Source - Accession No. Ga0208357_1002034
MIAVDSGKEQPIVTTQRAYTLRLNGADKNDNSWRERLWNTHEAVNRGAKTFGDWLLTMRGGLSHTLADLGIHGKGNKPERKPTQQEINNRRIVLALSWLSVESEHGAPKDYYVPHDLDTNTGERTNWKTIEALREILKCRGVSNEEIENWLAACKDSITATIREDAVWVNRSNAFDNAMKVVGESLSREELWDLLEPFFASKQSYLELNTATDVQQEQSDENAEESKELSPDKAKDLSLKAGQWLSSRFGTGKGANFQKFAEVYDALALQCKSIKPATSGTEVCKCLASAVSQFAPHSQDLNGLLELISGPGYKSATQNTLKRINALQSVSGEDIQKLRGNCEADAAKSKQKTGSKGNRPYADVILREVEAACGITYLGTSDGPSRHWQYAVILDHAARRASMAHSWIKRAEEQRSKFEVERNKLNNVPVDAREWLDAFCAQRGSDSGAKDAYRIRRGAVDGWKQVVAAWVDSLGATENAGSELLSEAEALRIQAARELQDSVEKFGDIQLFEALARTEAKCVWTTNGKTDAQGLLDYVAGTDAIAKKRRFKVPAYRHPDALLHPIFCEFGNSRWSIEYAIHRAPAGLTKAQQLLEKKRTEIAKADLALAGATGTPKQTLIEEKLEKLRSAFKQQDAEVAWLGSHHAMTMGLWDGRHIQDTQLLWQSKRFGSDIGQPEVAAPLLVSRADRFGRAAVAIKEYSSAIPFGLFDLKDWNGRLQAPRRQLEAIAAIANRTNLTAEQKKQLVSKRISSIRWLVTFSAKLQSQGPWLEYATKHDLFEKRNGEIVSSPAQTRDAWRGIAFPFWHPGNPKGKGSAVRHVLSCLPGLRILSVDLGHRYAAACAVWETLNSEQIQEVCGNSGTEAPGPLALYLHLEKVSNGRTRKTIYRRIGADRLTDGSLHPASWARLDRQFLIKLQGEDRDARPATSEEIAAVDQIESALGFVRQAQRTGSDLLVDELMSDALRILRLGLRRHSDRARIAFNLTATKRPFSGGREEPLDKDGRIGLLQETLLTWHELNVADRWKDDVAEEMWHQHINPLLEDQVSIEVDNQDGSVTSARRRAQRELLIQKLKPIAIHLENNDSLCRQLQSLWNAQWQAEDRAWRARLRWIRRWLLPRGVKRDKDSHKSIRHVGGLSLTRIASFKVLYQIQKAFHMRPCSEDLKRNIPDRGDNRLEGFGQSVLDAMERMRENRVKQLASRIAEAALGIGSETDRRNKNGTQNKRAVEQSEDSRFAPCHAVVIENLTHYRPDETRTRRENRQLMDWSSSKVKKYLSEACQLYALHLREVPAAFTSRQDSRTGSPGRRCNDVKISEFASLSYWRKQVKAAEENQKKGNNGNARERYLLWIDKKISSGQSKQTDSFLIPSDGGELFVSAHKTGESQTFGKRKKLATLQADLNAAANIGLRALLDPDWKGAWWRILCDPTTFIPDKKKYAGSITIETSKALRVMAKVKLDVLMSADKAKQSAQNKGKRSNADGNRLMYLWRDPSSQPVHPDVLDGGEWQFYPEYKNGVEDRIIRKLLKSYDRTSRQDNQFVPGDEDIPF

SEQ ID NO: 61767 - protein, 505 aa, Unknown
  Microbial Source - Accession No. Ga0208429_100128
MSESKRALIVKLNPTRDECVCLISLIKAYTAIARKLNNDAYAKFMELTTNGLIENIKQLKDIKKKFYSWYNEYFKTQRKWITDTLGSNITDQLFQFLRGQYENFFANYENFFKHKIEGRPSFPTLPELFQIRDRGVEIDFDKKVLTIKLKGKRLSLRFQADRILYHGDPGSVTIKKIDGKFYAYIPFDFTPKFEEGKKGAIDIGLTNFFATVTEDGDAILIKAKEYTYVYNMYKEKIKELDRIIGKIRKHTLRMYITPPKSFKHYPFLGFTNNRQVSKIITSLYTSWYDAGRAKKKRLRREDMTSIVRKIRKVNYRLRITKLDFVKLNGHVKLFPKKSQFVKDVYKDLPILHKLEYEKKKLFEKRDKTLMHIRRTAINALLRFLREKGVTHVIVGYPYNINKNRNELTVNMFQYRKTINDLKTIGERYGMKVDEIVEYNTSITCSICGEVHKNGRIERGLYKCEKTGKMINADVNSALNIFYKAFSKMPKQLKKIETIKLTFSQP

SEQ ID NO: 61768 - protein, 499 aa, Unknown
  Microbial Source - Accession No. Ga0208429_100584
VGQQIYLTSLIKAYTTIAGKLNRDAYAKFMELTANGVVENIKQLKDIKKKFNLWFNEYFKTQRKWITDTLGSNVTDQLFQFLHGQYENFFANYENFFKHKVDGRPSFPSLPELFQIRDRGVEVDFDKKILIIKLKGKQLRLKFQSDRILYHGDPGAVTIKKMDGKFYAYIPFDFTPKFEEGKKGAIDIGLVNFFAAVTEDGDVILVKAKEYTYIYNMYKEKIKELDRIIGKIRKHTLQMYIIPPKSFRHYPFLGFTDNRQVSKIITSLYTSWYDVERAKKKRLRREDMTSIVRKIHKVNYRLRITKLNFVKLNGHVKIFPKKSPLVRDIYKDLPILHKLEYEKKKLFEKRDRTLRHIRRTAINALLRFLRERGVTHVVVGYPYNINKNRNELTVNLFQYRKTINDLKIIGERYGIKVDEIVEYNTSITCSVCGEVHKNGRIERGLYKCEKTGKMINADVNGALNIFYKAFSKMPKQLKKIETIKLTSSPSTRLFAPLTT

SEQ ID NO: 61769 - protein, 508 aa, Unknown
  Microbial Source - Accession No. Ga0208429_100770
MPSNTDSKRALTVRLNLSTGQQIYLTSLIKAYTTIAGKLNKDAYAKFMELTPNGVVENIKQLKDVKKKFYAWFYEYVKTQRKWITDSLGSYVSDQLLHFLDAQYKNFFSNYENFFKRKIDGRPSFPSLPELFQIRDHGVEVDFNKKELMIKLKGKRLSLRFQADKLLYHGEPGSVTIKRVDGKFYAYIPFDFTPKFEEGKKGAIDIGLANFFAAVTEDGDVILVKAKEYTYIYNMYKEKIKELDRIIGKIRKHTLRMYVTPPKSFKRYPFLGFTNNRQVSKIITSLYTSRYDVGRAKKKRLRREDMTSIVKKIRKVNYKLRITKLNFVKLNGHVKLFPKKSQFIRDIYKDLPILHKLEYERKKLFEKRDRTLRHIRRTAINTLLRILKERGTTHVVVGYPYNISKNRNELTVNLFQYRKTINDLKIIGERYGIKVDEIVEYNTSITCSVCGEVHKNGRIERGLYRCDKNGHVINADVNGALNIFYKAFFKMPKQLKKIETIKLTSSSP

SEQ ID NO: 61770 - protein, 989 aa, Unknown
  Microbial Source - Accession No. Ga0208461_1008711
MQQYDNFINHYAIQKTLRFELQPIGKTREHIQKNGIIEHDEALEQKYQIVKKIIDRFHRKHIDEALSLADFSKDTAMLKRFEELYWKKNKNENEKNEFVKIQSDLRKRVVSFLEGKVEGDARFAKVQQRYGILFDAKIFKDKEFISTACDDIEKDAIEAFKRFATYFTGFHENRKNMYSADEESTAIAYRVINENLPRFLENKARFEKIQHTVDSKTLNEIATELKPVLEKNKLETIFTLNYFQNTLSQAGITYYNTILGGKTKENGEKVQGLNEIINLFNQKNKDTMLPLLKPLYKQILSEEYSTSFTISAFEKDNDVLQAIGSFCNDCIFYAKNNVNGKAYNLLQTVQAFCNSIDTYNDNRLDGLHIERKNLATLSHQVYGEWNILRDALQIHYEAYEQKDNGNNNNYLESKTFSWKALKDALTTYKSLVEEAQDIDENGFIAYFKDMKFKEEIDGKTTSIDLIENIQTRYKSIETILQEDRNNKNNLHQEKEKVATIKGFLDSVKYLQWFLNLMYIASPVDDKDYDFYNELEMYHDTLLPLTTLYNKVRNYMTRKPYSVEKFKLTFEKSTLLDGWDKNKERANLGVILRKGNNYYLGIMNKKYNDIFDSIPGLTTTDYCEKMNYKLLPGPNKMLPKVFFSKKGVQFYKPSQEIIRLYNNKEFKKGDTFNKNSLHKLINFYKESIAKTEDWSVFQFKFKNTNDYADISQFYKDVERQGYKISFDKIDWEYILLLVDEGKLFLFKIYNKDFSPYSKGKPNLHTIYWKNIFSHDNLNNVVYKLNGEAEVFYRKKSIEYPEEILQKGHHVNELKDKFKYPIIKDKRYAEDKFLFHVPITMNFLSKGEPNINQRVQQYIASTSEDYHIIGIDRGERNLLYLSLIDATGKIIKQLSLNTIKNENFNTTIDYHAKLDEKEKKREEARKNWDVIENIKELKEGYLSQVVHQIAKLMVEYKAILVMEDLNTGFKRGRFKVEKQVYQKFEKMMIDK

SEQ ID NO: 61771 - protein, 1440 aa, Unknown
  Microbial Source - Accession No. Ga0208609_100002
MPQQDKPPVTRRAYTLRLRGTDPSNTSWRKALWQTHEGVNKGAKKFGDWLLTLRGGLDHTLADAKVKVGKGKPDRDRTDEERKARRILLALSWLSVESKIGAPVGHIIASGEEVAEDRNSKVVAALEEILKSRGLANSEIKEWKNDCSASLSAAIRDDAVWVNRSKAFDDAVKSTVGSSLTREEAWDMLERFFGSRDAYLAPVKISEDESSEVEQEEKAKDLVQKAGQWLSSRFGTGKGADFSHMAKVYERIAAWTDNAQVGTTGNEAINNLAVALSEFIPASEDLKGVLGLISGPGYKSATRNLLKGLDTKTAVTQQDLESLKDKATTDSLKCEQNTGSKGQRPYSDAILNGVEAACGFTYLQDGGSARHSEFAVMLDHAARRVSLAHTWVKRAEAERRRFEEDAKKIAKVPTPARNWLDSFCLERSLASGALEPYRIRRRALGGWKEVVAAWAKSSCSSCEDRISEARKLQDDPEIDKFGDIQLFEALAEDDALCVWHKDGYPAKATDPQPLIDYVLATEAEFKKRDFKVPSYRHPDALLHPVFCDFGNSRWDICFEIHKNRQSPNPNALSVTLWTGSEIKPVSLRWQSKRLARDLALDQEAQGNGASEVTRADRLGRAASNVTKNDEVNIAGLFEQKDWNGRLQAPRQQLEAIAAVRDNLSLSAEERNRRMSGMMDHIRWLVTFSAKLQPKGPWLDYATTNDLKLDQKNGEIVATPSNSKNEWRGLAYPFWHSDNQEGRKGLAKHCLSRLPGIRVLSVDLGHRHAAACAVWEAVSAEQVKKACQIAGHEAPKASNLYLHLKRKATKQKKDNQVVIEETTVYRRIGADTLPDGTQHPAPWARLDRQFLIKLQGEEEGVRKASDEEVREVYQLEAEVGRTAPMDADDGEVRKPSLPVDELMSSAGRTMRLALKRHGDRARIAHYLITNEKIKPGGIKEKLDEEGRVDLLLDTLVMWHNLFSFHGWQDDEARQLWDNHVAKLSGYKAPERIGEECSGKSRKNKQQENREKLRDAAKALAKDITLRKALHEAWKKRWEDDDERWKKQLRWFKDWILPRGKHASDPTIRKVGGLSLTRLATLTEFRRKVQVGFFTRLQPDGTKAEIKERFGQSALDALEHLREQRVKQLASRITEAALGIGRMRRPAGGKDPKRPGVSVDEPCHAVVIENLTHYRPEETRTRRENRQLMTWSSSKVKKHLSEACQLHGLHLREVSASYTSRQDSRTGAPGLRCQDVPVDKFMLSPFWRKQVEQADAKRAENKGDARERFLCELNTMWKDKTVADWKKAGAILVPAKGGEIFVSASQNSQKAKILQADLNAAANIGLRALTDPDWPGKWWHVPCDPVNFKPIPDKVKGSAAIDPDTPLKDTSVLSEGVTGKKSGKIKSQSKEVVNLWRDVSSKEVSTEGVAWEVYSAYQNQVQVRVVNILRRSACPKDNWEGQ

SEQ ID NO: 61772 - protein, 536 aa, Unknown
  Microbial Source - Accession No. Ga0208683_103187
MPAKTSSNKKNGKQSRQKDDNKRSLTVRLNLNADEQIYITSLIKAYTTIANKLNKDAFAKFKELSNNGEIKNIADLKDIKKEFYSWFNEYFKTQRKWITDSLGSNISDQLFQFLMAQYKNFFANYENFFKHKVDGRPSFPSLPELFQIRDRGIEVDFDKKILIIKLKGKQLRLKFQSDRILYQGDPGAVTIKKVDGKFYAYIPFDVNPEFHEGKKAAIDIGLVNFLASVTEDGDAILVKAKQYTYVYNTYKQRIKELDWMIGNVRKHTLKMYVYPPKSFRHYPLLGFTNDRRISKIIISLYTSRYDDARGKKKKLTREDMTSIVKKLRNVNYRLRVRRLNFMKVDGNIKLFPKKSRYMNDVFQDLPILHKLEYERRKLFEKRNRTLRHIRRTAINALLRVLKQKGVTHIVVGYPRYINKNRNELTVNMFQYRKTINDLKIIGQRYNMKVEELEEYRTSIMCSICGQEHESGRIERGLYKCQKTGKTINADVNGALNIFYKAFSKMPKQLKKTETIKLTYSPPKTNEVINPLYYRKL

SEQ ID NO: 61773 - protein, 383 aa, Unknown
  Microbial Source - Accession No. Ga0208683_103849
EVDFDKKILIIKLKGKQLRLKFQSDRILYHGDPGAVTIKKMDDKFYAYIPFDFTPKLEEGKKGAIDIGLINFFAAVTEDGDVILVKAKEYTYIYNMYKEKIKELDRIIGKIRKHTLRMYVTPPKSFKCYPFLGFTNNRQVSKIITSLYTSRYDVGRAKKKRLRREDMTSIVKKIRKVNQRLRIAKLNFVKLNGHVKLFPKKSPLVRDIYKDLPILHKLEYERKKLYEKRDRTLRHIRRTAINTLLRILKQRGTTHVVVGYPYNINKNRNELTVNLFQYRKTINDLKIIGERYGIKVDEIVEYNTSITCSLCGQVHKNGRIERGLYKCEKNGNVINADVNGALNIFYKAFSKMPKQLKKIETIKLTSSPPQRGEVFRPLNYRKL

SEQ ID NO: 61774 - protein, 517 aa, Unknown
  Microbial Source - Accession No. Ga0208683_104403
MLSNADSKRALTVRLNLSDKERVYLTSLINAYTSISRKLNKEAYTKFMELTANGVVENIKQLKDVKKKFYSWFYEYVKTQRKWITDSLGSYVSDQLLHFLDAQYKNFFANYENFFKRKMDGRPSFPSLPELFQIRDHGVEVDFNKKELMIKLKGKHLSLRFQADRLLYHGDPGGVTIKRVDGKFYAYIPFDFNPKFEEGKKGAVDIGLSNFFTAVTEDGDVILVKAKQYTYVYNMYKQRVKELDRMIGNVRKHTLKMYVTPPKSFRYHPLLGFTNERKISKILISLYTSRYDKKRGKKKKLRKEDMTNIVKKIHKVNYRLRIRRLNFMKMDGHIKLFPKKSKFVKDVFQDLPILHKLEYEKKKLFVKRDRTLRHIRRTAINTLLRDLKERGVMHIAVGYPHNINKNRNELTVNLFQYRKTINDFKIIGERYGMKVEEVEEYDTSITCSICGEVHKNGRIERGLYRCEKTGKMINADVNGAVNIFYRTFSLMPKRLKKIETMSYPALKAFRPLEPPQI

SEQ ID NO: 61775 - protein, 1280 aa, Unknown
  Microbial Source - Accession No. Ga0208940_1001448
MQQYDNFINHYAIQKTLRFELQPIGKTREHIQKNGIIEHDEALEQKYQIVKKIIDRFHRKHIDEALSLADFSKDTAMLKRFEELYWKKNKNENEKNEFVKIQSDLRKRVVSFLEGKVEGDARFAKVQQRYGILFDAKIFKDKEFISTACDDIEKDAIEAFKRFATYFTGFHENRKNMYSADEESTAIAYRVINENLPRFLENKARFEKIQHTVDSKTLNEIATELKPVLEKNKLETIFTLNYFQNTLSQAGITYYNTILGGKTKENGEKVQGLNEIINLFNQKNKDTMLPLLKPLYKQILSEEYSTSFTISAFEKDNDVLQAIGSFCNDCIFYAKNNVNGKAYNLLQTVQAFCNSIDTYNDNRLDGLHIERKNLATLSHQVYGEWNILRDALQIHYEAYEQKDNGNNNNYLESKTFSWKALKDALTTYKSLVEEAQDIDENGFIAYFKDMKFKEEIDGKTTSIDLIENIQTRYKSIETILQEDRNNKNNLHQEKEKVATIKGFLDSVKYLQWFLNLMYIASPVDDKDYDFYNELEMYHDTLLPLTTLYNKVRNYMTRKPYSVEKFKLTFEKSTLLDGWDKNKERANLGVILRKGNNYYLGIMNKKYNDIFDSIPGLTTTDYCEKMNYKLLPGPNKMLPKVFFSKKGVQFYKPSQEIIRLYNNKEFKKGDTFNKNSLHKLINFYKESIAKTEDWSVFQFKFKNTNDYADISQFYKDVERQGYKISFDKIDWEYILLLVDEGKLFLFKIYNKDFSPYSKGKPNLHTIYWKNIFSHDNLNNVVYKLNGEAEVFYRKKSIEYPEEILQKGHHVNELKDKFKYPIIKDKRYAEDKFLFHVPITMNFLSKGEPNINQRVQQYIASTSEDYHIIGIDRGERNLLYLSLIDATGKIIKQLSLNTIKNENFNTTIDYHAKLDEKEKKREEARKNWDVIENIKELKEGYLSQVVHQIAKLMVEYKAILVMEDLNTGFKRGRFKVEKQVYQKFEKMMIDKLNYLVLKDRQATQPGGSLKAYQLASSLESFKKLGKQCGMIFYVPAVYTSKIDPTTGFYNFLRVDVSTLNSAHSFFNRFNAIVYNNEQDYFEFHCTYKNFVSEPSLQKNVKSSKMHEYNNLKDTTWVLCSTHHERYKKFKNKSGYFEYKPVNVTQSLKQLFDEAGIDYQAGADLKEAIVTGKNTKLLKGLGEQLNILLAMRYNNGKHGNEEKDYIVSPVKNNYGKFFCTLDGDASLPVDADANGAYAIALKGLMLVERMKSNKDIKGRIDYFISNNEWFNYLIAKNTLNKSK

SEQ ID NO: 61776 - protein, 580 aa, Unknown
  Microbial Source - Accession No. Ga0209012_1000842
VPFGKKRSDKVAIVYEYGCLPPEGGLPAVAERQLVLADDFWNSLADIDRRHRAKMREILDDGELGKLNAHITSCKARIEELRGQIKGVNQRERRNAGVDANTKAEIARLKAEVKATAARIKEIKPEHIAKQKPLLEENDALRQAAVKRARQWFSDRGLYWGTYNAVLRSYETAHKVLLKSGEQMQAHRYTGEGRWVVQIITTAGEKPTTAEDLATGTMVQIDPVDFSDWKHISRGERRRRARTKCRIRVGSEGRAPVWLELPCVMHRPLPEGAEIVGADVTRRLVGPARWEYRLHLTLRVPAPVPADAAKPAIGVDIGWRALPNGGTRVAYAVGEDGSRKEVVCPDDILAGLAKSSDLRSLRDEKMNRIKAFLRDVIPGLDSADLSEQTEHLAMWKSPKRLIRLYRWWKEHRVEGDTEAFGRLHEWYYHDYWHLYQYEDDMRQQVLARRRDMYRIAAKEIAERASVVVIEEFDLRKFAQEDQPEDGEDNKIQRARRVAVAPSEFRIALRQACAARGVRVVEKPAQNTTRVHVVCGQVVAADYAADVTVRCPRCGVAYDQDANAALNLLGAGRGESTPAAS

SEQ ID NO: 61777 - protein, 1546 aa, Unknown
  Microbial Source - Accession No. Ga0209012_1001252
VANAKVKTTTRSYTLSLNAPSDTTDRSPLWHRIFRTHYAICCGAREFGKLLLDLRGGLPTSLAQLGEGIAENDRRQTQRGTRRILALGWLSVEDLDHARNDPHRVQDTAPGSPLDQDLAEKILRKILITKGIKSEEEQSNWISDCLPALTANIRPDAVWVNRAESFAQWQRGTQPGAQPPTPEEAQQILFSLCGESLVTLTLPEQPAAAGQKQPDQETSPDPEEQTDRPPAAPSADDEMDPSNASRGIFGDLFGENAEGKRSRSQGKDNFACAVRDFLCANPTPSADAITEFREKQKPREPNPPGPEKYPPEVSTSGAPTAVAKRYRKLLVCAGLWPKSADEDGSSRNSAKTKFADPKEPQKTEIQINALDLIDACNQAAPADDSGTSPKAGRVFAPAWASNIAEKVASATQMPANAKSLNEFKRLMFALAARRFSQTQSWTRRNEAERHMAAARQDAAVARLREIDPDHKAQDWLRGYEQRRADQSGSNGEFRITRRMIGEAEAVFKAWAGTNSAAERELKTVAVQTTAEKFGDAALYSEIARNTAAEAVWRSGSAPEILDQWVKLRKAQSDQQRTRVPRFCHPNAFRHPTWCEFGESSKPGVWYAWNPKSKPRKPEVGGEGDGTRRLWVLLPDFNSGIGQAVPLRWRSKRLSKDLGEALQPSDAPIPRADRVSIAAAGLNLEGANGVPARYRPSLPFSENTKGWNARLQANRTALLHLESKWDAEAATWRDGGRSLLALKWFTTFSPELAMSEGPGRAIHPKLGWNSEPHSDLNRAQKRGGNAKLILSRLPGLRVLSVDLGHRYAAACAVWETLTTEQMNAACQAKNHTQPAESDMYVHLAHPTERVVKSGRKKGQNLIQTTVYRRIAADTLPDGTPHPAPWGRLDRQFLIKLQGEQRPTRAASKNEADLANALFHRLGLRSDADSENKSRAVDKLMARTVRVATLGLKRHARRAKIAYALDPNTKAIPGMGGSSAAFTPGDEPHIHLLTDALFDWQSLATDAKWDDAHARSLWNHHIATLPGGFHLENPTPRDESAHEPSRQRQRSGDDALRATLKPIAEKLSKADRQEVHAAWKKYWGDSDGQSAIVPKVLQGQRGPEKTTPSASASGWHGKIRWITDWIMGKYLEGCTGHAWKHDVGGLSVSRITTMKSLYQLHKAFAMRATPEKPRGAPEKGESNLGAAQGILTAMESMRQQRVKQLASRIAEAALGAGIERRSDNGRELQRPRERVDDPRFAACHAVVVEDLTNYRPDEMQTRRENRQLMQWASSKVKKYLSEACQLHGLYLRGVPAGYTSRQDSRTGAPGVRCGDIPVEELMAAPRWRRQILTAEKTRRENNTGTARDRYILTLDEKYRLLTAEQRKKTPPARIPVKGGDLFVSADPDSPAASGIQADLNAAANIGLKALIDPDWPGRWWYIPCDATTHKPSPERTRGSAAVDCDVPLGPDSTGTPEDRDAKPKKNQRNSKIAGRGQSAIINLWRDPTHLPIKENPSAWCESKKYWNQVEHNVVKVIESKGQKLTQTAEAATGESASSPPIAPTDVPW

SEQ ID NO: 61778 - protein, 508 aa, Unknown
  Microbial Source - Accession No. Ga0209012_1015334
MSKNKHNKRTLTVRLNPTRDEQVYLISLIKAYTSIAGKLHTDAYAKFMELTTNGLIENIKQLKDIKKKFYSWYNEYFKTQREWITDTLGSNVTDQLFQFLRGQYENFFANYENFFKHKIEGRPSFPALPELFQIRDRGVEIDFDKKILTIKLKGKRLSLRFQADRLLYRGEPGAVTIKQLDGKLYAYIPFDFTPKFEEGKKGVIDIGLTNFFATVTEDGDVILVKAKEYVYVYNIYKEKIKELDRIIGKLRKYTLRIYITPPKSFKRYPFLGFTNNRQVSKIITSLYTSWYDVGRAKKKRLRREDMTSIVRKIRKVNYRLRITKLDFVKSNGHVKLFPKKSPFVRDVYKDLPIFHKLEYERNKLFEKRDRTLRHIRRTAINTLLRILRERGVTHVVVGYPYNINKNRNELTVNLFQYRKTINDLKIIGERYGIKVDEIVEYNTSITCSVCGEVHKNGRIERGLYKCEKTGKMINADVNGALNIFYKAFSKMPKQLKKIETIKLTSSPP

SEQ ID NO: 61779 - protein, 1484 aa, Unknown
  Microbial Source - Accession No. Ga020918_1000172
MPDEALVNGSTAGTDLMVVTQRAYTLRLQGVDPQDHSWRDALWKTHEAVNKGAWAFGDWLLTLRGGLDHSLADAKVKGGKGNPDRDPTDEERKARRILLALSWLSVESKKGAPEKYRLDKQSSARSNLNPEEALREILKGRGLGKSEIESWVQDCSASLSAPIRDDAVWVNRSKAFDDAVKSVGCSLTRDEAWDMLERFFGSRDAYLAPAKGSEDESSETEQEDKAKDLVQKAGQWLSSRFGTGKGADFSRMAKIYEEIANRAGKAQPGMTGDKAIADLATALSKFSPTSNDLQGVLGLISGPGYKSATRKLLKRFRDKTPVTQEDFQNLQDKAREDAQKCKNKTGSKGHRPYADAVLRDVESVCGFTYLQDGGSARHSEFAVMLDHAARRVSLAHTWIKRAEAERSRFQEDAKKVDQVPEAAKKWLNNFCLERSRAAGALEPYRIRRRAVDGWKEVVAAWSKPDCKTTEDRIAAARALQDDPEIDKFGDIQLFEALAEDDAVCIWHKDDDPANPPDPQPLLDYVAATDAEFKKRHFKVPMYRHPDELLHPVFCDFGNSRWNICFDVHKNTKTPFPRTLCLTLWTGSEGMKPVPLRWQSKRLARDLAFGQDTRKDGASDVTRADRLGRAASNVGKNDAVNIAGLFEEKHWNGRLQAPRRQLEAIARYVEKHGWNEKAKNIRDAIQWSVTFSAKLQPNGPWCAYAKEHGLRKDPQYWPHTEVNKDRKGHARLILSRLPGLRVLSVDLGHRYAAACAVWEAISTRQFQQNIEDKKILRGGTDAESLYCHTEHTTDGKKHTTIYRRIGADTLPDGKPHPAPWARLDRQFLIKLQGEAEGAREASNEEIWAVHKMETVLGRSVPLIDRLVAAGWGSTEKQKARLDAIKKLGWVPIKRADASEDADTEEEEELAFRPSLSVDDLMSSAVRTMRLALKRHGDRARIAFAMTAAYKPMPGDRRYYFTESKDLSATEDATARNSKHIEFIQDALLLWYGLISSRGWRDEAARQLWDDHVAKLHGYKAPEEIGEDVSGAEREKKQKENREKLYDVGKALAQNESLRKTLHHAWKTRWEEDDGRWKKQLRWFKDWILPRGKYASDPSIRKVGGLSLTRLATLTEFRRKVQVGFFTRLKPYGTRAETKEQFGQSTLDALEHLREQRVKQLASRIVEAALGIGSENKQHWEGGKRPRARSKDPRFAPCYAVVIEDLTHYRPEETRTRRENRQLMSWSSSKVKKYLAEACQLHGLHLREVSAGYTSRQDSRTGAPGIRCHDVPVKEFMRSPFWRKQVAQAEKKQDEGKGDARERFLCVLNAKWKGQPEADWEKAGAVRVPLKGGEIFVSADQNSPAAKGLHADLNAAANIGLRVLTDPDWPGKWWYVPCDPVSFLPVKDKVEGSAVVKPDQPLPKSAQAQSGDGAKDKKKPGKRGASKSKESKKVVNLWCDISSSPLECREEWKEYAAYQNEVQSRVIHILEKQIKRLRQATARGVQ

SEQ ID NO: 61780 - protein, 1226 aa, Unknown
  Microbial Source - Accession No. Ga0209101_1000507
MKNFFQLFTNQYELSKTLRFELRPIENTAELLKKNKIFEKDKKVYEYYQKTKKYFDKLHCEFIDEALVNTSLPNKDYSIYDKLFFEYKKDKENKKIYKALNEHAKKLRTNIVKDFEKTAEKWRDEYILSIKDEKSQKKLKQLEGLDLLFKTEVFDFLKKKYPEAQIEGNSIFDSFNKFFTYFDNFHQSRKNFYKDDGTASAIPTRIIDDNLPKFLENKKIFEEEYKVLNLSREEKDLFRLDFYNKCFTQTGIENYNEIVSKINSKVNKYRQKNKKSKIHFMKELFKQILSKRSKQATEQDTSISIENDSQVFEVLQDFIMETKNCNRMAKNILETFIQHQEEFDLQKVFLKGSNVTRISDMWFTSWFAFGDLLPKNSTGKKLANFISFQDIKNALEKTEIQDVFKKKYAKYNKESFYDQFLQIFDYEFHKALNDCEKNIVEAEKMMKVDKVYSNKKGILRNGKNGEKQKEIIKDFADSALSIYQMMKYFALEKGKKPVTDMDEDPRFYNDYKDWCEKSRTLLYYNEFRNYLTKKPYAEDKIKLNFEKSTLLMGWSANEEGNLQYYSSILRKDNKYYLGLMSSASTFNINKKEAFETRDGFYELMNYRQLKSTTIYGSLYKGEYKKEYRKDKETLTNQELIERTKKILEKQKFSYPQLEVILDKKYKAAEDLAKDLGNIVLYNIGFVKISKRYVNNLTNENFYLFEISNKDFLNKKKKGNVNLHTKYFQLLFDKKNLESKKGAILKLSGGGEVFYRKATKNLPKKKDKKGKEIIDRKRYAEDKILFHLPIVLNIGFKDKQINSKVNQVLATQRKARIIGIDRGEKHLLYISVIDENANILKIKSLNTIDVPNKKEPDDYHKLLDEKEKERDDERKSWHTIENIKELKHGYISQVVNEIDKIIFECLDERILPIIVFEDLNIGFKRGRFKIEKQVYQKFELALAKKLNYLVSKEKGNYLNAFQFTPPVNNFQDIHKKQVGIIFYIPASFTSAICPVCGFRKRLYGFTFKNINQVKKLLAEHEFNIFYDGKRFNFECLASKENEKKENKNGLYTEIFLNKKLFFNSDIERLFNKKSKDNKKWETISFIATEELKKLFEGKIDLKRNIMDQILAGDFRAEFYQQLIFIINRILNLRNCHAVEHRDFIACPSCGFHSEKNYEKLKSRYAGKEKFEFNGDANGAYNIARKGILLIKKIRQFAKSNNIEKLMPYDHLQIDMQEWDKFCAKNKS

SEQ ID NO: 61781 - protein, 1202 aa, Unknown
  Microbial Source - Accession No. Ga0209101_1006392
YKSATRNLLGQFNNKTAITQDDLKRLAETALADKVKCETNSRPKGERAYANSILHDVESACGFTYRVDKGEQPVPVSDYSHYANDYRWGPANHSEFAVMLDHAARRVSLAHTWIKRAEAERRQFEENAKKIDKVPKVAREWLDSLCAERSIVLGALEPYRIRRRAVDGWKHVVAAWSKSDCKTAQDRITAARLLQEDPEIDKFGDIQLFEALAEDHAVCVWQRDGEAGKTSDPQLLIDYALAAEAEFKKRHFKVPAYRHPEAFWHPVFCDFGQSRWKICFDVHKNRQSRRQRACANRISRKICFDVHKKRQTLRLSLEVWTGSKMLDMPLCWQCKRLARDLALGQDHKKDRSCQVTRADRLGRAVSNVARNQEVQILGLFEQEYWNGRLQAPRPQLEALGRYIEKHGWDAKAQKSCRAIRWMISFSPRLQPAGPWGKFAEKLQLNPNPKYWPHAEDNKDRGSRSKLILCRLPGLRVLSVDLGHRYAAACAVWEAVDAEQVKEACQAAGHREPNENDLYLHLKKRTTKQKKGSQGVVEETTIYRRIGADTLPDCTPHPAPWARLDRQFLIRLQGEEDEARAASNEEVWAVHKLEAELGRTIPLIDRLLGAGWGQTEKQKARLKALRELGWTPANKCQAFNSTDETELRRPSLAVDELMLDAVGTLRLALKRHGDRARIARYLITDERTKPGGVKEKLDENGRIELLQDALIIWHGLFSSPRWRDDAAKQLWNEHIAKLVGEQNLVEVSEDASGSERRTKQKQNREKLREAAKALVDDVALRQALHDMWKRRWEEEDREWRRRLRWFKDWVLPRREQARKAYSRPAETGSSSHPKRRARYAAIRRVGGLSLTRLATLTEFRRKVQVGFFTRLKPDGTKAEAKEGFGQSTLDALEHLRAQRVKQLASRIVEAALGVGRIRRFPGVKNPKRPDTPVDKPCHAIVIENLTHYRPEETRTRRENRQLMTWSSSKIKKYLAEACQLYGLHLREVTAAYTSRQDSRTGAPGLRCQDVPVKEFMRSLFWRKEVAQAEKKLTAGKGSSYERLLCELNQRWKDNSPGDGKRAELLRLPHKGGEIFVSAAPDSPAARGLQADLNAAANIGLRALTDPDWPGKWWHVPCNAVTFRPVEDKVKGSAAVKLDQSLRQVAHPQSKDPGAKKSKEIVNLWCDISSLPLEHREWKLDWEPYPAYWNNVQCRVIRVLQGKV

SEQ ID NO: 61782 - protein, 1268 aa, Unknown
  Microbial Source - Accession No. Ga0209102_1000334
MTKRKSRLAGYRLHKERILFAGGQIIRTIKYPLTPSYPTEEMTQFLKDFEEAVIADDLKIRGDLNINDYLTYTAKGKPLYTLFDFWVDSLRNGVIWMSKGTMLIDFLATQYNINSPFDNVWKKASPRITSFFKKDEFKEIILCDPVRSSSTKNSFHKRITGYLKDHLKVKNGDSYTIVSNDAQKVVEFIVHSFFNNEGKLILEGEEQFKFWKKEYNLDKAIIESAKPKGKYADITFVIIPELISNLNPKQSLEDLINKRDVWLQGRRFDKEDKSLLSILGLSDNFNGFSNFLGVVLRDLQKENGNKEVLYDAQKTVFPLLGNSKDEVLEALDFLSQKAKLLGVTSLPLVNGWHEYRSIFGGKLKSWFTNSQKRKEELDGQISRFKESLFKARNYLQTENFGEEANKEKEDILSFLSLLENFFTDEKRSIKVEENYQLFEPLLALVKRRLNFFYQRYIQKEGDETKVNELGHFKGLYEKIYKPVAFYGYAAKKVNKKFVNQTFPILEDGIENIEKLISYLQNSFSVQETFEEVKQGKEEIDDPYRKLLQFFWNKYLEDSINSHLFAEKYKDILKGNIEDNEWEKVIDKTKKGKYVFYKSPYAKGSLEEIPIGTSNYLEQLQISILELSKFILSYKKDILLSDVGLLLDWVELSKNVISILLRFNTKKTYRIDDLRLDNFSQAKRYQELFKHGDYPKNEFSFIIQSLVLSEIRGAATLYSKREYIASYSVQVVGSDSKYRIYYIPKEKISITPDVVKSRPESSERKQLMGPHYYAVALGKVLEKKKSEIFNSIALFKKNIKAIFLPESSLRGVFRLSSSPYQLQFLDKFIYRPFGWENIDVSLSEWSFIVEKRYTINWDLRSKKPKLLPVTDTERIKKNKVYIAIPFNLIPSKEVRQAAPLKTIAKGKETREKDLSRLNFPIMGVDVGEYGLAYCLVKIIFDKNTYKILAIELVSDKKEAFGFIEDRNIGNIKDKFAEIQHRARQGSFDEEDTVITRVRENAVGHLRNRLHVIVTLQRSSSVYEDSISNFETGSGRTTKIYNSVKRADTESDTNADKMTHNHVWGEKTKWVGRNVSAYASSYTCVSCLKSLYQVRKEDLSKMRITQRGGRIVTISGPHGDIKGYVSKEEKYNLGYHFRETDDELKNFRKIVQDFARPPVGDHSEVLKKYAKQILEKGKIEEWRKRRGNSSIFICPFCQYITDADVQAAFMMAIRGYLRFSGIVPSRGNKKDQDQEQEDEKTAGESFLEQTQRQLGDVNLSKILEAFSLKI

SEQ ID NO: 61783 - protein, 343 aa, Unknown
  Microbial Source - Accession No. Ga0209102_10036881
YKPSDGRFWIHFKTKEGEAVCYLHVPAKYHSLIEQACGEDNPVLGQVELIEDCKYGWVNCHICLRLPKPEPYEPKGWLGVDTGFRKLATSILATPCIALRSTGHTSSELKGVAESPSFGAHGSIAFTHEHKAQGNSGLKPASINGDCLKLSFSHPTFHGKEFKTWIIQLRHLLKQYARKGKAWKKWDFRLKHTIKYAVGVVAKEIVSKAKRLKAGVAMENLTFKATTKGYIVPRYKLMIAIKTLCEREGVPFKLVPSQYTSITCPKCGYADDGNRSNERFECLKCGYKADADIVGAMNIALKAFDRTADGAVNGMGLDPIPKGEGALRLQAAGCCNPPKADER

SEQ ID NO: 61784 - protein, 652 aa, Unknown
  Microbial Source - Accession No. Ga0209143_1000788
MLKLELKGDPNSLKFLDNLFNEYKRLVRIADSFVYYLYPYYANINEQEKLERLNKLIMSMERKAIIKRRKDKKLEDKISKELRYTYSHSDHLKTLLHIYIKYAKQYYGIDIKHAHLDMQGGLADIMHSNAENAYKHRTIPNLRRRLINVMPIRVSKRPLAENRRNKDNNKYYQRDAEFIFKNGKIMLRIGSKRNGLTFKITKRFNDDDRLSMFIKAIQGNDGLTIGDPCYLVRKDADNGYRYYIMVSISKNVNVKALYEASKNKSKIRIVGVDSNISKYIATMFCVEVDKENKEFKLVNAKGIDSKDYINAVKKYEEERRKLQQGRMKGKINKKKGSRYKEKEDYTIKNRCGDSERIDLRRQLIGYICNQILEFADKNDADIIVIEDLEGLNKELKTLKIIKKELGKLYNDVNSKGNNAIDDKINEINKKYNNKIRRPLLELLNKIKEYSKNKDRIKVAKYILKYKQGIERRISLLSIMAYYQFKQELEVDALWNGKLLYIIDPKYTSQQCLRCGHTNKLNRITQRQFKCIKCNFGMNADFNASANIALRFATKILKLELELKQGESSSMMTITNATTPLYASINAGSKLGVVIANNNTDGSVASTMSSVASILQGCYEGRSPCSRGQTEQSCSAKRLVTLDEFIEQRGNGG

SEQ ID NO: 61785 - protein, 667 aa, Unknown
  Source - Accession No. Ga0209143_1002248
MLTITRARTKKITKTMLKLELKGDPNSDSMKFLGNLFNEYEQLVRIADTFIYHLYPYYANINEQEKLERLKELVKSLDEKAIRKNKRRKREPQEAEEEQTPTETEAKHTYTHSNLLKTLLHRFIKYTKQYYGIDAKYAWLEKQGGLADLMHSNAESAYKHRSIPNMRRRLTNVMPITMSKSPLDENRKDKKNNGRYYKKDAEFIFENGKIMFRIGRGKHKVTFKIATRFNDAERLGMLIHAIQGDNGLTIGDPCYLVRKETYNGYRYYIMVSISKNVDVKALYEASKNKSKIRIVGIDSNISKYTATMFCIEVDKENKEFKLINAKGIDSNDYINAVKKYEEERRKLQQGRMKGKISKKKGSRYKEKEDYTIRNRCGDSKRIDIRRQLIGYICNQILKFANENDADIIVIEDLKGLNKELKHLRIIKKELGRLYNNVNSKGNNAIDDKINEINKKYKNKTRRPLLELLNKIKEYSKNKDRIKVAKYILKQRQIIERRISLLSMMAYYQFKQELEVEALWNGKLLYTINPQYTSQQCLRCGHTNKLNRITQRQFKCIKCNFEMNADFNASANIALRFATKILKLELELKQGESSSMMTATNATTPLHASINAGSKLGVVADTSSGVASILQGCCEGRSLFMRGQTKQSCSAKRLATLDKFIEKRGNGG

SEQ ID NO: 61786 - protein, 493 aa, Unknown
  Source - Accession No. Ga0209143_1006289
IFENGKIMFRIGRGKHKVTFKIATRFNDAERLGMLIHAIQGDSIFTIGDPCYLVRKETYNGYRYYIMVSISKNIGKKALYEASKNKNKIRIVGVDFNISKYTATMFCVEIDKENKTYKLINAKGIKSKNYINAVKKYEEERRKLQQGRMKGKKQKKKGSRYKEKEDYTIKNRCGDSKRIDLRRQLIGYICNQILEFANENDADIIVIEDLKGLNKELKHLRIIKKELGKLYNNVNDKGNNAIDDKINEVNKDKKYKNKIGKPLLEILNKIKEYSNAKDKVKVARYILKQRQIIERRMSLLSIMAYYQFKQELEVEALWNGKLLYTINPRNTSQQCLRCNHINKLNRITQRMFKCIKCNFEMNADFNASANIALRFATKILKLNLKQEQGESSSMMTVTITNATTPLHASINAGSKANEQGYCYCNDNGNLVRNGSVAPTMSSVASILQGCYERRSLFMRGQTKQSCSARRSIATLDEFLEQKGNVFAMKGNGG

SEQ ID NO: 61787 - protein, 964 aa, Unknown
  Source - Accession No. Ga0209162_1014546
MDKKITGYRLHFKRILFSGGEIVRTIKFPLSSTSLSSGKNDLINNFESQLINDDLKIRGDVNLNDYLIYEFSSKPIYTLFNFWIDSLKSGIVWADKPASLIDFINEFYLIKSPYDLVWERATEEFKKYFDKKSFKEILISGPIRKTKNPSKKESFKKRIISCLKDEYVIKEGNSLSVESPEVLKFINKIVNSFFDEDGNLILEGKKQDNFWLNEFGIDKSIIQKTKPEGELKDITFVIIPELIVDSFNKEYEVDSLIEKRRVWLKKRFNKEKEIEKNLQLILGLSNNFNGFSNFLGKGLRAFQGGKILMVFGAMSKINPSVKNQENKEKVLESLNFLSDKSKFFTPRPALNIVKSWADYRTFFGGKLQSWYSNGIRRKNELKVQVKEIYEFLTKTADYLAAKISFNDENERYAIKEFELINLKINRLKQFIENENFDISSEDGYLIFDTLLSSLRTQLNLYYQKYLSSEEDNIRDNKDLKGIYQKIYKPIAFFGKATKRKNKKVIEETVPIIESGINNLFSLMKKLEKTFLPKNTFSKVKNKNEDEETILRNLVDYYQNKVSHKMLNSLTFVNKLEEVMKSVVEENDWDRLHSNKYVFYKSEYQKGALELIPLKKGSWIDIFEKIILEMTSYLLTFDLTGLLKDKKILLDWIEIAKNTLAKLIRFNTCDVFTLDELNLDLRNFPKAMDYIKIFKITKVDKNELNFIVQSFILSELKGAATLFSKEKYLAKYNVQVIDADKKFKLFYKPNDGFIEREVNRKNLLKPHQYFVALDKIEDKKIKEKANFLLLTKEDIKPVFIKEENFSKLYKISSSFYQIQFLDKFIYMPEEFKDLGIRLSEWNFVLEREYKIDWDLYTKRPKMTFIENSKKNKLYLSIPFNVFYKSKKKDVSLSKVISNRLSYPILGIDVGEYGLAYLLAEFSDKKIKILKKGFIEDRNIANIKDKFAEIQLKARTGIFNEEDTTI

SEQ ID NO: 61788 - protein, 1553 aa, Unknown
  Source - Accession No. Ga0209171_10000726
VPKRVRTQTRSYTLRLAAPTGVAEWLPLWDRLFRTHYAVCRGAAEFGELYLNLRGGLSPDLADLRDPTVAEGRWEYVRRGRRRMLALGWLSVEDKRSATTHKFRLPQVQPGQTLSDDEASSLLREVLTTKAVRDDTLQKEWIRDCIGALTARIRPDAVWVNRAAAFRKWQEEHPSCANEMAEQARIILFNMCGSDFVNLALPEDKAIDGNVDLEDSEEAEPNDEVEKGELVGEQQNPSNASRGVYSDLFGGDSVKKVARSKGKQTISAKLATFLRSRDRCCPIRDQIIQWRQENGLPPFDTVSSNPYPPEVTSSGAPTAVAKRYRKLLVSLGMWPQSNDEDGKPRQQAETRYVKSVAGELPDTKKVQVNALDLLAACDEIKESEKDNDRVFNPAWAVSIARRLSEVSGLNSTDKSATEFKRLMFAIVARRMSQTQSWIKRNEVERHKATVRRDAVLDRLRLLDLTQKAQNWLRNYEQVRGETSGAIAGYRITRRAIAECDEVIASWKDTTTGEDRDKQTAEMQARSEKFGDANLYYDLARDTLAEAVWHAPDGSPSSEILKEWVKFRQAEYDQGRLKIPRFCQPDPFHNPTWCEFGGTSKPKVWYAWNPRTRPSKPEQSGETDGSHRLWLLLPDWGKNQTLPTAFRWSSKRLWRDLGGDTIYVEEIPRADRLGVAVAGLPATARDGEMRHYRPAYPFSEDAKGWNARLQVARDALSEMERAWDEDRKQWLDGGLALKRLRWFVTFAPSLAVAEGPWGKLRAKLKWKKFPPAEVNERQKRQGSAKLILSRLPGLRILSVDLGQRFAAACAVWEALSTEEFRNECNAARAKPGFDVTVTDLYTTIAGPGERSKGASRKAQAEGRDSFRPTTLYRRIGEDFLRDNKTGKLTDGAHPAPWARLERQFLIKLQGEELPARAASQDIEMEMVERFARRVGFENADLKLPRRIDELMARTVQIARLGLERHGRRARIAHALDPQTHSVFGIGGKEIPFQQGDETHVKLLTEILFDWHALASEGKWNDVKARELWNVHVSALSVGSRIENPTSGAAADDDRTRLEKRKDDDVLRERLKPLAKVLAETDRAAMHTAWKNRWEDDDGLERDESDYEHDKKGGITKAKRQTSGWHADLRLFTDWIMGWHLPGVTSKLWTRNVGGLSLTRIGTMRSLYQVQKAFAMRARPQNPRGAPEKGESNTGVAESIRVAMERMREQRTKQIASRIVAAGLGMGGHWKHAEVWQRTPDGTREAKKKYVWVEEQSPKYKPCHAVVIEALRNYRPDELQTRRENRALMNWSANKVRKFLEEACQLHDLHLREVVPNYTSRQCSRTGLPGVRCDDVRVEEFLTAPWWRKRVKSAYNRKAKPAREHPYDAEHQMLVALDERWPECQKVPEALRTDYERKVKSANPIRLPRKGGNLFVTAIPWSCAANGHRPCSRCRSFRALQADLNAAANIGLRALLDPDFPAKWWYVPCGANDGKPAKDKVSGAVCFGLMPKFVEVSEAKRDYVNAWRDPSSRPFPDCDNKWSETSKYWNGVRSRVITTLRVFNGLVPDTSTIDA

SEQ ID NO: 61789 - protein, 1181 aa, Unknown
  Source - Accession No. Ga0209172_10015399
ADKATVTQADLTKLNETAAADKGKCETNTGSKGRRPYSDAILKDVESVCGLTYRVDENGNAVSVSNYSLYGDDYNWGSARHSEFAVILDHAARRVSLAHTWIKRAEAERSKFEEDAKKVDQVSKAAKDWLDKFCLERSGMSGALEPYRIRRRAVDGWKEVVAAWSKSSCSTSADRIATARALQDDPEIDKFGDIQLFEALAEDDAVCVWHKDGDAAKAPDPQPLIDYALAAEAEFKKRHFKVPAYRHPDALLHPIFCDFGKSRWDICFDVHKKVQTPFPRALCLTLWTGSGMNTVPLCWQSKRLARDLALGQDAQNDGSSEVTRADRLGRAASSVAKSDEVKISGLFEQADWNGRLQAPRQQLEAIAVVRDNLSLSDQERERRMSGLMDRIQWLVTFSAKLQPQGPWCKYAQDQKLGLNIDPQYWPHAGENKNRKGQARLILSRLPGLRVLSVDLGHRYAAACAVWEAVSTETFRKEINGKNILRGGSGKDDLYCHTKHDAESKKHTTIYRRIGADTLPDGEPHPAPWARLDRQFLIKLQGEEEGAREASNEEIWAVHQMEIALGRSVPLIDRLVAAGWGCTERQKSRLEELKKLGWKPLPAAEPTGDESGEDEGADVYKPSLAVDELMSSAVRTMRLALKRHGDRARIAHYLIADKKTKPGGIKEKLDENGRIELLQDALVLWRDLFSSRGWRDDAAKQLWDDDITRLSGYKAPEKIGEDVSGVERKKKQKENREKLRDVAKALAQDVTIRGKLHDAWKKRWEEDDGRWKKQLRWFNDWIFSRGKAADNSTIRKVGGLSLTRLATLTEFRRKVQVGFFTRLHPDGARAETKEQFGQSALDAIENLREQRVKQLASRIAEAALGVGRMKRPRGGKDPKRPDIRVDEPCHAVVIEDLTHYRPEETRTRRENRQLMTWSSSKVKKYLAEACQLHGLHLREVSASYTSRQDSRTGAPGTRCQDVPVKEFMRAPFWRKQVAQAEKKQAESKGDSRERFLCGLNAMWKDKAVADWEKAGAVRVPLKGGEVFVSADRISPSAKGLQADLNAAANIGLRALTDPDWPGKWWYVPCEPASFRPVKDKVDGSAVVNPDQPLRQSAQAQSGDAAKDKKKRGNKGAGKSKEVVNLWRDISSSPLECIEFGEWKEYAAYQNEVQCQVIRILEEQIKDRDRQPHEGSKEDDIPF

SEQ ID NO: 61790 - protein, 1304 aa, Unknown
  Source - Accession No. Ga0209201_1007464
MMRSSRWAAHSRARRHGICWNASSEAVMLIWPQRKSPKMNLQRKSKRRKRRTSSRRPDNGSAAGSTGKGADFSRMAAVYGKIAAWADNAQAGTTGNQAINKLAADLSEFTPASNDLQGVLGLISGPGYKSATRNLLNGLATKTTVTQQDFGSLRDKAADDAQKCKQNTGSKGQRPYSDAILKDVEAVCGFTYLQQDGGAARHSEFAVILDHAARRVSLAHTWIKRAEAERRRFEEDTQRLANVPGPVKAWLDSFCSERSATSGALEPYRIRRRAVDGWKEVVTAWSKSSCSTSADRIAAARALQDDPEIDKFGDIQLFEALAEDDAVCVWHKDGDAAKAPDPQSLIDYALAAEAEFKKRHFKVPAYRHPDALLHPIFCDFGKSRWDICFDVHKNVQTPFPRALCLTLWTGSGMVSVPLCWQSKRLARDLAIGSNATNAGYVEVARADRLGRAASNVTKSDEVKISGLFEQADWNGRLQAPRQQLEAIAVVRDNLSLSAQERERRMSSMKDRIRWLVTFSAKLQPQGPWCEFAKTNQLRIDPQYWPHADSNKTRKGQARLILSRLPGLRVLSVDLGHRYAAACAVWEAVNAEQVKKACQVAGHEAPKASDLYLHLKRKATKRKKGNQVVVEETTIYRRIGADTLPDGTQHPAPWARLDRQFLIKLQGEEEGVREASNEEVLKVYHLEAELGRTAPIIDRLVKAGWGQSGKQRTRLEALRELGWKPASEAVVSDGMGADEGEVRKPSLSVDELMSSAVRTMRLALKRHGDRARIAHYLITDEKTRPGGVKEKLNENGRIDLLQDALLMWHDLFSSRGWRDDVARQLWDNHVAKLSGYKAPEEIGEESSGPERKKRQKENREKLHDVAKALAQDVTLREALHDAWKKRWKDDDERWKKQLRWFKDWVLPRGKHASDPAIRKVGGLSLPRLATLTEFRRKVQVGFFTRLQPDGTRAETKEQFGQSALDALEHLREQRVKQLASRIAEAALGIGRMRRPMGGKDPKRPNGRVDEPCHAIVIEDLTHYRPEETRTRRENRQLMTWSSSKVKKYLAEACQLHGLHLREVSASYTSRQDSRTGAPGIRCQDVPVKEFMRLPFWRKQIAQTEKKQAEGKGDARERFLCDLNAKWKGKSEADWEKAGVIRVPVRGGEIFVSASRDSQGAKSLQADLNAAANIGLRALTDPDWPGKWWYVPCDPASFRPIKDKVEGSAAVKPDQALRQSAQAQSGDAAKDKKKRGNKSAGKSKEVINLWRNISSSPLECIEFGEWKEYAAYQNEVQCRVIRILEEQIKGRDKQLHEGAKEDDISF

SEQ ID NO: 61791 - protein, 577 aa, Unknown
  Source - Accession No. Ga0209207_1001084
MIKAFKYGMLEPVAGFDKAAIDVLYLRNKLWNSLVELEKAHRERYRTLITGSDDELSKIQARLDQIEAERAELVKRKRQARAMVRSKKVDTSEHDDRIDMLMAERNDLRTKAKDIRLQVKEKVKPAIADLEKERYEAVKHLIHEAGLWWCNSETVIAAYDLARVKAMKENAELRFRSFDGSGKFAVRKTGGFALSDLVSGKLSFARLEALPDANFAHLSERGKRSRARHHLTMTILTYKDESGKLCRHEVTWPIILHRPLPPEGMIKFIHVQRKRIGKDFQWTCSITMEVDEIQKTPIDHPSRAACGIDIGYRLVKDGLRVAVIADTSGKIDHLTLPQDWIEKMDHVESIQGHLDNSNDLAWGELKALLKSMHDYPESIAESIGRLLKAGDRTPVRGMRALHWRLRNEPETMPEVLSILDTWEAETCRREREMHRLRRKLINRRKDLYRNFAYKVANRYVLIRIRGLSLKKLAAVNLEDGSDNQMPQAVRNNRTRASLSELTLCLQQAAVKAGADFEKVFDVNSTTTCSTCGNQNLKMDREDIYFRCEKCDTLHDQDENAAKNLLRKEFYLAEQAVM

SEQ ID NO: 61792 - protein, 403 aa, Unknown
  Source - Accession No. Ga0209207_1006579
MKLVQRHLIKPNNQFYQEIDKLTFLSKNLYNCGIYLCRQAFFKGEKIPSQNQLYHQLKGGIDYRLLPSKVSQLVLKQVEKTFKSYQSAVKEYKQNPSKFTGKPKLPRYKDKVKGRNIVTYNYQAISVKYLKKGLVNPSKTSILIKTDIKEILEVRLIPKRGVYLVEIVYEKPEKETIISDNSAYIDLGLNNLAVLTSNKKGFQPKLICGRALKSCNHYYNKRIAQLKSQLNDQQKTSKRIQSLTLKRNNKVDYYLHTASRYIINNLLENNISLLIIGQNKNWKQGIKLGKKNNQNFVNIPHDKLIQQLTYKAQLVGIKVITTEESYTSKCSFLDLEPVKKQEKYLGKRVKRGLFEASNGYLYSADVNGSLNIGRKVVGESVFDRDSIVRFVVNPLRVKSYKAS

SEQ ID NO: 61793 - protein, 526 aa, Unknown
  Source - Accession No. Ga0209224_1000001
MSSKTTSDKKNGKRLGQKESDNKRSLTVRLNLSTEQQIYLTSLIKAYTTIARKLNNDAYAKFVELTTNGVVENIKQLKDVKKKFNLWFNEYFKTQRKWITDTLGSNVTDQLFQFLRGQYENFFANYENFFKHKIEGRPSFPTLPELFQIRDRGVEIDFDKKILTIKLKGKRLSLRFQADRLLYHGEPGAVTIKQLDGKFYAYIPFDFTPNLEKGKKAAIDIGLINFFAAVTEDGDVILVKAKEYTYVYNMYKEKIKELDRIIGKIRKHTLQMYITPPKSFKRYPFLGFTNNRQVSKIITSLYTSRYDVGRAKKKRLRREDMTSIVKKIHKVNYKLRIAKLNFMKLNGTVKLFPKKSPLVRDIYKDLPILHKLEYERKKLYEKRDRTLRHIRRTYINTLLCILKERGVTYVVVGYPYNINKNRNELTVNLFQYRKTINDLKIIGERYGIKVDEIMEYNTSITCSICGEVHKNGRIERGLYKCEKTGKMINADVNGALNIFYKAFSKMPKQLKKTETIKAKLHLLNVN

SEQ ID NO: 61794 - protein, 398 aa, Unknown
  Source - Accession No. Ga0209225_1002268
LDSETIKLCVKGVIPPRDPDLRKLMHEYSVYKRVLIPRVKQAVRQVIKDKSIAVYAQQKWMVDKKLSEYLKNLPFHPMPFHNQSVWLEEKDGRFWIHFKTKQGEAVCYLHVPIKYHSLIEKACGEDNPVLGQVELIEDKKYGWVNCHITLRLPKPEPYQPKGWLGVDVGWNKLATSIACTCNSHLRFFNPTFHGKEYKTRIIQLRRLLKDYARKGKAWKKWDYRLKHMVKYAVGSVAKEIVSKAKKLKFGIAMEKLTFKSTTKGYLVPRYKLMVAVETLCEREGIPFKLVPAQYTSMTCPKCSYKDDKNRVGERFRCLKCGYQADADIVGAMNISLKALTDAQMEGVMPQASGLRLKGLGLKPKPLGHVARPLRGMSDDLCKATRKPSKIESEVKKEG

SEQ ID NO: 61795 - protein, 633 aa, Unknown
  Source - Accession No. Ga0209399_10016114
ESPLHEPSRWKRRVLEHCSVLVSNATAALLAFIRERLVVTPDVEDATKIASADLAFEVGKEHASRIAALLAQVKHDRETGERLPFSNAYRFTACEPVPGTDRFRVVARLADGTWRERKLKRGGVRRTHGINCIHATTGFQQLLATYAAPKLLHVVPPALRAGVCQEVAQQVLSYLGQLESSKVRGDVAFPTVEDRDPVRRRQAYEDAIDALVADLTPFSYAKLRDKFPGEYAADDPRGDRLIVDDPRWFAVTTTPDPHPIPLLFSQGSAVRLLEGSTSFDAGVSKRNRHRGSSTASESVRQSRPDAVQRKGTTGLRQWYAAIPLLDADDDALRAIAAAAHERSGRQLDLALHPLPLDGGVRWRRRERDVLVPLSGDRKRLERILRNPNLHIAWSRLVQKRTGWVLQLTVRIPMQPAVEHRRVLGVSFGIDAVATWSLVDEDGVELEHGALAPNEQILTFLREKRQLEWDQEKGRWIGKQRFAMQLESIAHGVANTLLAIAEEHHAVLAVEDVSWVKKAGPNHAQNVLFTAWNFGQLRRILSYKSPMVGRGDPVTVSDYVVSYTCPTCGACRKPKQKPDHADTWRDGDTLSCRSCGFQGVLSPSDRARRVTANGLTIWQDRWQRSDERNGTETS

SEQ ID NO: 61796 - protein, 372 aa, Unknown
  Source - Accession No. Ga0209410_1010848
LELIKVTVPAVIPPRDYGLRVLMKEYKAYKKALISRVKRAVIDVIKDKSIRVYAQQKYMVERKLTTYLKNLPYHPMPIHNQSYWIEKENGSYRVHIKTKHGEASCLLIVPKKYRFLIERAIGKSCPYKANNNMCVFKECPFNTPKMCDSINPHLGQMELIEDTKYGWVNCHIVLRLPKPKSYEPKGWVGVDVGWNKLATSILATANPHLRFSNPSIHGKALKTRIIQLKYLMKQYARKGKSWKKWNFRLKHTIKYTVGVVAKEIVSKAKKYKAGVVMEDLTFKSHTKKWLIPRYKLMVAIKTLCEREGVPFKLVPSKYTSIRCPKCGHIDKRNRRDKRFRCVRCDYKADADIAAAMNIAAIGMGLAPIPKSS

SEQ ID NO: 61797 - protein, 1241 aa, Unknown
  Source - Accession No. Ga0209467_1000554
MQNKETFEKFTGLYELSKTLRFELKPIGGTKDLLSKNYIFEKDILVRENYLRAKKYFDCLHCEFINEALEKMSFEENDYQEYENLYLAYKQEKNQKNFKAWNDYVKKLRTKIKDNFTTIAIVWRDEYSKIVSDEKLQKKIKKISGIDLFFKKEIFGLLIKKYGEEEGAKIINLETGETETIFDCFSKRFSTYFINFHHSRQNFYKDEGIAGAIPTRIIDDNLTKFLDNRKIFQDKYGVLDLSEEEKIIFSLTYFNQCLTQVGIEKYNNQVARLKSKINEYRQKTKEKLPFLKELFKQILTEKNKQGTEQDEFIIKNDEQVFEILNNFLKEVKENNLKAELIFNKFIEKQNEYLLDKVFIKGNNINTISNKWFLNWSIFGSLLPKNRGNHNKVADFVSINQIKQAFDNPELPKDQKLLFKKEYFELKVVFENKNAFENFISIWQYEWNKSLDICNSSIIDVKKMIEEDKKYTNKKGVLKNCKKGELQKELIKDFSESALSVSQMMRYFELKKGKNSVNDLDEDANFYNEFNEWAEDDKVWLYFNEFRNYLTKKPYKEDKIKLNFEKGTLLMGWSANEDGNLQYYSSIFRQGGQYYLGIMSSASTFNLNKEEAFNIEDGFYELMEYNQLKSTTIYGSLYKGEYKTDYKTDKKILSDQELISRVKVILQKQEKHYPQLKEILKQNYETANDFAKVLGDLVLYNISFTKKVSKKYVDDLTQKNFYFFQIVNKDLISKGEKGKSNLHTRYFELLFDEQNLYNNQGLALKLSGGGEIFYRPKSLDDKKEIQTKKNKILLNKGDKAIEKKRYSEDKILFHLPIVFNAGLKNKQINFKVNQFIISQTKQRIIGIDRGEKHLLYVSVIDENGKVLETKSFNKIEVPNKKEPDDYHQLLDKKEKDRADARESWQEIENIKELKQGYISQVVNEINKLIFSYLEEEVLPIIIFEDLNIGFKRGRFKIEKQVYQKFELALAKKLNYLVSKVKENYLEALQLTPPIQNFQDIKKQTGIIFYVPASFTSAICSVCGFRKRLYGFLFKNIEQAKKLLTDHQFKIVYDGGNFNFECLASQENKKKTKNKNELFLEKELADKLIFSSDVERLINVRSKNNKGWETIKFDAKVELEKLFEDKIDLQGDIMEQILAEKLEANFYKQLMFIINTLLKLRNSHNVEDRDFIACPSCGFHSDKGFQGKEFNGDANGAYNIARKGVLISEKIRQFAKEGDLEKLKIIEDLQIEMREWDKFVQNN

SEQ ID NO: 61798 - protein, 1510 aa, Unknown
  Source - Accession No. Ga0209507_1000982
MAMQTIVTQRAYTLRLKGSDPQDQSWREALWQTHEAVNKGAKAFGDWLLTLRGGLCHTLERLPDITDSEIDSEHERAKHDAKENNKSEPTREDIAKKLHVKREQENQPDAIRDRRILLALSWLSVESERGAPAEYIVAHDLDKQSGKRSNWKTVEALKEILKKRGVDDEKEIQEWEKDCRESLAAHIRDDAVWVNRSQAFEEAARSTGISLTHDAIWDMLERFLGSAGTYLEPADISDDEASGSKNEESKDLVQKAGGWLCDRFGTGKGADFGRMAKAYDAIADWASEARTEASGTEIVAALASALKEFNPKSNDLPGLLRLISGPGHKSATRNLLRQIDGQSLVTRQNLDKLKEMAIDDAEKCRKREGSKGRRPYSDTILKDVESACKFTYLTDNGAARHSEFAVMLDHAARRVSLAHTWIKRAEAARRKFEEDARRMDSVPSETRTWLDEFCVERSGASGAQDQYRIRPRALGGKTRKAWKAIVQAWAKPDCQAEEDRVEAARLIQAEWDDDEKFGDIQLFEALADDDALCVWQKDGDSAKSPDPQHLIDYVLAADAIQKRHFKVPAYRHPDALLHPVFCDFGTSRWDIGFAIHEASDGVCKAKKNVERKKNAVQKAERSVKKASGNRQKEAKAQDELKKRQADLAEAETRMAWLSNMHALSMTLWTGSMVKSEPSLLWQSKRLTHDLAFDQGKPDGKVLEVTRADRLGRAAGNVPVNVSVAIAGLFEQNDWNGRLQAPRSQLDAIAARVAKHGWDAKAKQMRNHLRWLITFSAKLQPSGPWVKYAAGVPEDAVAKPFVSRKGDYAVRHQGNDTREGHAKIVLSRLPGLRVLSVDLGHRYAAACAVWETLSPEQLKAACQAVGHEPPRDGDLYLHLKNGEQTVVYRRVGADAIEAVDEGTGKVKTISHPAPWARLDRQFLIKLQGEDREVRRAIPAEVAAVQELEKTVGRESPDRRYLRVDDLMSETVRSVRLALQRHGRRARIAFNLTASKKLLPGGREECLTDEGRAALLADTLADWYALLTGKGWTDEWAKQQWETHVVPFLQSAALPQIPEDAETTPKARRKYRADLTEKLNPTAVSLAKNESLCRKLHCLWATRWREDDAALRKRLRWLRDWILPRGRAEDNRAIRHVGGLSLTRIATIKSLYQVQKAFRMQPEPDDLRKNIPSKGDDTLRDFGRSILDVMEHMREQRVKQLASRIAEAALGIGRMKRPKGGKDPKRPRARVDEPCHAVVIENLTNYRPEETRTRRENRQLMTWSSAKVKKYLAETCQLNGLHLREISANYTSRQDSRTGAPGIRCQDVTIKEFMQSPFWRKRVAQAEKKQAEGKGDAHERFLCDMNAKWKDKPEADWERAVAVRVPLKGGEIFVSANAESPVAKGLQADLNAAANIGLKALLDPDWPGRWWYVPCDPTTFKPAKDKVAGSTAICLDKPLKSVSAVQDMDGPEKKRGKAGEKSREIVNLWRDVSSHPIDSDEGWRESRDYWGDVEKRVLDILRESVEKDSIPF

SEQ ID NO: 61799 - protein, 1489 aa, Unknown
  Source - Accession No. Ga0209513_1002134
MADGKPPTFPRTYTMRLCPPDEGQADRNGLWDKLFATHYAVNAGARAFGEFLLDMRGGLSPDLSRMGLDRIKDDAKRRLALAGRRRMLALGWLSVEDDHGAGDHPHALPESSGQPLPRDVAEKLLRQILETKGVTDRATVDEWCDDCLGALTAAVRDDTVWVNRAESYRNLDSGPSPDQAFKILERLLGKNFLDLSLGKETRTRDRHRGQLGTDEGEDGEDKEEWRTTAASGNDPSENARQLICDLFGTGQKGDFRKTAGFAAKVKNWVNSLGDYKNCDQPSLENRIRETFRSVFSGGEYPSFPSKELKKSRPKPTSLYPQECVSGKKPGKLARRVRKLLVYLKVWDQMPGVEDGTIRDNRLHALVNEIDSACDEEIKKDRTDLKAPSWAPALLSRLEKASGIKLASRQQGSPSAGEFRILFAVLAARRLSQTQSWTRLNEMTRHEAQSDLDSAKSEIDRLDPKGKARGLLERWEDRRRQESGTRGEYRITRAAISALDDVLEAWATSTGPEERIGLLPEVQSRAEKFGDASFFEWLARTDNECLWKHASTGAISGEIITNWVKKREAEAAISLVKVPRYCHPDPFLHPVWCEFGNSKPDVRYFLRNELGQTNKRRKNSQHSEDLRNVELLLVNDRSGTVGMERLRWASDRLWKDLGVAATQSSDALARNDRLSRAALGLSTGSYRPIYPFTGQAKKWNARLQVDRNALEELRGLWDNRTRKWTDEGRRAHQVRWFLSFSPDLKASAGPWHRFVENNRDILNDLSTRPYKDKKTDELRVPLPWGKLNRKENRKGRAQLVLCRLPGLRVLSVDLGHRHAAACAVWETLSTAQINQLCYQHHQPPPGPSSLYHVYETSIPDTDGCTGEVRKLKRLKPKQFIYRRIGPDRVNGREHPAPWARLVRQFVIPLQGEKDEPRWPTEEEKRLAHTLRLTLELPESKVERPVRFDELMSGIIDMLERGIDRHKKASRVAYNLTAREIVEPGGKLVPVDGTDRYEVISSALKDWYSLASSPGLYSNFAREIWNAKCAGLKGGRPVPAETAADEPEKVSFSDLAKGLAESEHLTRELHDLWAGKWHENQPKWRPLLKEIRRRLVPSSGFARNNKRLLRHVGGLRLDRITLFQRFHRLQLSYRDCPPPEESGIKKGAENSTHEHFGQRLLDDIDRMRENRVKQLASRIVEAALGIGREPADSKRRREQTPGRGDHAPCHAIVIENLAYYRPSEEQTRRENRQLMSWSSARIRKYLQEACLLNGVLWYEIWSAYSSRQDSRTGAFGLRCRDIPVASFVDPQGFLRDHLRRVKLANSPEATMLRELEARWNAATRVWKVSPDEAWQLSDDGRRWAWAGPKPQMVGDRRKVPDPVRIPWRGGEIFVSSNERSPAAKGVNADMNAAANLGLRVLLDPDWPGAWWYWPARLTGKGRVPVDETCKGSACFPAGYEIETGESKEETVNLWRDITCASIESGGWQEYAGYSAQRRNAVINILRKHNGL

SEQ ID NO: 61800 - protein, 449 aa, Unknown
  Microbial source - Accession No. Ga0209542_10001012
MAKGKKKEGKPLYRAVRFEIFPTSDQITLFLRVSKNLQQVWNEAWQERQSCYEQFFGSIYERIGQAKKRAQEAGFSEVWENEAKKGLNKKLRQQEISMQLVSEKESLLQELSIAFQEHGVTLYDQINGLTARRIIGEFALIPRNWQEETLDSLDGSFKSFLALRKNGDPDAKPPRQRVSENSFYKIPGRSGFKVSNGQIYLSFGKIGQTLTSVIPEFQLKRLETAIKLKKFELCRDERDMAKPGRFWISVAYEIPKPEKVPVVSKQITYLAIGASRLGVVSPKGEFCLNLPRSDYHWKPQINALQERLEGVVKGSRKWKKRMAACTRMFAKLGHQQKQHGQYEVVKKLLRHGVHFVVTELKVRSKPGALADASKSDRKGSPTGPNWSAQNTGNIARLIQKLTDKASEHGGTVIKRNPPLLSLEERQLPDAQRKIFIAKKLREEFLADQK

SEQ ID NO: 61801 - protein, 447 aa, Unknown
  Microbial source - Accession No. Ga0209542_10007289
MAKGRKKEDKPLYRAVRFEVFPAPEEVALLFRVSENLRYVWNTALRDRQKSFEDFLKPIYEKIGQEKKRAQEAGFFDLWKDEICKDFNRLLRERDIPVNFISNKKSLLLELREVFKQHTITLYDQINELTQKRKDGEFGSVPRNWQEETLDSLDGSFKSFLALRKNGDVDAKPPRARADENGFYKIPGRYGFKVYEGKFQLSFGKLGQTLTFPIPEFQQERLAAAVKLKKFELYRDERNMAKAGRFWISIAYEIPKPVSLPLGNNVVFLSIGASRLGVVSSFGEFCFNLPRPDYHWKPEINVLDERIAKTVKGSRKWKKRIAARARMFAKLGHQQKQHGQYEVIQRLLQYGVHFVVTELQVRSKQGALADASDPTRGNSPFGANWSAQNTGNIGRFLQKLTDKAVENGGTVIKRKAPALSLQERSLTDDQRKILIARKLRDEFLAEK

SEQ ID NO: 61802 - protein, 722 aa, Unknown
  Microbial source - Accession No. Ga0209669_100016
MIGRVKLSTILILKLKYQNKQLYTRLRLSLISTQATARATTKVKAKKLTKTMLKLELKCEPNSLKFLDNLFNEYEQLVRIADSFIQHLYPYYANINEQEKLERLKELIKSLDEKAIRKNKRRKRELYEEEEQATTAKTKTETKHQYTHSNLLKTLLHRFIKYAKQYYGIDAKYAYLEMQGGLTDLMHSNAESAYKHRTIPNLRGLSNVMPIRVSKRPLLENRRSKDNNIDEYYQRTAEFIFNNGKIMFRIGSKRNGLTFKIAERFNDVERLGMLIDAIQGKNGLTIGDPSYLIRKDTDNGYRYYIMVSISKNVDVKVLREAVNNKNKIRIIGIDSNISKYIATMFCIEVDKENKEFKLVNAKGIDSKNYINAVKKYEEERRKLQQGRMKGKINKKKGSRYKEEEDYTVKNRCGDSKRIDIRRQLIGYICNQILEFANKNNADIILIEDLKGLNKELKTLRIIRNELGKLYNNVNDKGNNAIDDKINEVNKDKKYKNKIGKPLLEILNKIKECSNNNKNNTKVAKYILKQKQMIERRIFLLSIMAYYQFKQELEVEALWNGKLLYIINPKYTSQQCLRCNHTNKLNRITQRQFKCIRCKFEMNADFNASANIALRFATKLKLELELKQGESSSMMTITSATTPLHASINAGSKASEQGYRYNNANLVRNGSVAATMSSVASIALQGEGERRFPCLRGQTDEPCSAKRSIATLDEFLEKKGNGG

SEQ ID NO: 61803 - protein, 679 aa, Unknown
  Microbial source - Accession No. Ga0209669_101200
LSSKTKIKKITKTILKLELKCDPNSLKFLDNLFNEYEQLVRIADSFIQHLYPYYANINEQEKLERLKELVKSLDEKAIRKNKRRKREPYEEEEQTITAKTKTETKHQYTHSNLLKTLLHRFIKYAKKYYGIDTKYAWLEKQGGLADLMHSNAESAYKHRSIPNMRRRLTNVIPIRVSKIPLAENRRNKDKCNDDKPYERDTAFIFENGKIMFRIGRGKHKVTFKIATRFNDAERLGMLIHAIQGDSIFTIGDPCYLVRKDTDNGHRYYIMVSISKNVDKKALHERIENKSKIRIIGIDSNISKYIATMFCIEVDKENKTYKLVNAKGIDSKNYINAVKKYEEERRKLQQGRMKGKISKKKGSRYKEKEDYTIRNRCGDSKREDLRRQLIGYICNQILEFANENEADIIVIEDLKGLNKELKHLRIIKKELGKLYNDVNSKGNNAIDDKINEVNKNKKYKNKIRRPLLEILNKIKEYSNNKDRIKVAKYILKYKQRIEKRISLLSIMAYYQFKQELDVEALWNGKLLYTINPKYTSQQCLRCSHTSKFNRITQRQFKCIKCNFEMNADFNASANIALRFATKLKLELELKQGESSSMMTVTVTNATTPLHASINAGSKVGVVANNNTDGSVAPTMSSVASILQGCYEGRSLFMRGQTKQSCSARSIATLDEFLEKRGNGG

SEQ ID NO: 61804 - protein, 1184 aa, Unknown
  Microbial source - Accession No. Ga0209750-1000252
MFNKKKGYRLHLERIIYSGGEITRSIKYLLASHSDSQKNKELLNNFSQDLYNDDLKIRGCLNLNDLVNNNQIYNLADFWIDSLRAGVIWQSSASSLIDFIKRLNHQETIGEKIFNNANERIKRFFNSEKFIKEIILSEPKRISSKKQAFYNSLFDILKDEFKKQEKNEKIIIDNKAEQLIKEIVDAFYSNDGVFLMEGEEKQNKFWQENFNIDKNMIKKEKEDILKDVGDITAFIHPPLIILKGDVSQLIDERKKYFSEKDLEEILGLSDNFNAFSHYFNKFFLLLYQDKQEKIFECYQKIFSFSQEDRKRIKDALDFLLEKSKLLGLPKIVNSWSDYRSVFGGKIKSWFSNYLNREDKAKKQEKKIKEGLEKVNKFLLDFIQKNQVDSDLQQEIKFYYDKLNQFINSYQNQEFFHQQELFLLFSDLLAEYREKLNRFYQKYLSDKEKEEKKVDEFPLFKDLFEKYEGPISFYGKTKLEDNKKIIDLTFKTIKVGLNLIRRLLIDLYNSSDFKNSDNNNQERDLRRIFEFLLNKIPATKTFREKYLSILKDNFDQQTYKEMTLKPSRYTFVENIYSRENRKLIELPSKNFEELLSKIIKDLTDFSLSFKNDDLFVDIYLLSDLVELAKTLISLVINYSNKSQFDSYKNELIDDTYQKAKKYLETFKISFFNSKKEANYFYQTRVLSELKGAVALFSKKYYQAKYNIQILKSNEIFPLFVKFSDLLKKEEINDINKLKLIFKKPYRYLIALKKIKFKKKQQQSSVIHLDKKNKDLVLISPQDEDFLFKLTSSFYQLQFLDRFVYPVKKWLNVDITLSEWSFILEKKYKINWDFNNGKPEFSEIDSRLYLNIPFKIKAINQQKILKPKELFLGIDVGEYGVGYALVNFKDEEIKIIKSGFIRSKNIASIRDKYRLLQDRSKKGVYFSSTNVVQEVRENAIGEIRNQIHDILIKNNADLIYEYNISNFETGSGRITKIYDSIKKSDVYAENEADKSVIQHVWGIKKSIASHLSAYGSSYTCSNCGRSIFSFSENDIFSSKVIKRDGNIITIQTPKGEVFAYSKDKKFNIGYSFSQEKNKEEMKNLFMKIVKAYVRPPLLKSEVLLTQKKLDREFLEKFKKERGNSAIFVCPFFDCQSLADSDIQAAFIMALRGYLKKKKGKDINYLEESLNYLQNFKGKINFSNLLH

SEQ ID NO: 61805 - protein, 660 aa, Unknown
  Microbial source - Accession No. Ga0209827_10659006
VNGTETRDPTAVAEIKRENRVRVYRYGAREPLDVELVREQLRLAHQYRNVLVAIELTRRAEIDAALARLAPDLASVEREIGEPEREADPESGTPATEATGLLGEIAAAESAVRARRVKERGRPKDVGPLKSLRARLKSARARRKDLRAALFASPAWESERTRIEDANLLRCKAARAACGVYWGTYLAVETAARSFRRGPPPRFCAWRRRKDRLAVQIQGGLSISDLLSGEDTQARLVAEGRGARCCDGCRARVRRERRGQPEPTDARPCSCASLPPPSARRTDHATLWLRVGSTESSGPVWARVPIAYHRPMPPDARIKWIFLLRRSVGVDDVWSVSFVLERESWGDPERSSTGAVGIDVGWRRLEDGALRVAVWSGSDGREGEVALPAWWLREQRRVESIHGERDRIFDVARGALSAWLAGREGLTELLLEARKTLHAWRAQARLASLALRWRASRMEGDTETLSALESWRARDKHLLTFESHLRAQLQGSRRDLYRRVAADLSRRYATVVLEDMDLRTWHRLGPVEDGGSVEEDAARRYVRDACLSELCGAIEDRVREVRRVDPAGTTATCHACCRTQDVESLVHVCAGCGLRWDQDVNAARNLLAASGSVVSWGQESLAPVVRAGYSEDRNQRRRETEAGWAAARRAGREAAQNKGS

SEQ ID NO: 61806 - protein, 378 aa, Unknown
  Microbial source - Accession No. Ga0209980_10011112
VYIHSVEIRKTYRYRLYRSKRDKHLVRQIELAADIWNHFVALTRRYYSLYGSYPGYYRLKRHLAKLKKRNKGHWYGLGSQAAQNVIERLDRSYQRLFAGKGGRPGFKKRRKYPSFTLTQAGWKYLGGNRLRIMGHTYKFALSRPIDGQIKTLTIKRDRCGDLWVCFSVVQEAEPTIAQTGDAVGMDFGLRDLLTLSTGEQIESPQHLKQSLRELARLQRSLSRKQRGSNNWREACRDVAKLHRKIANQRRDFHFKTARRLLERYDIVAIEDLNLDGMKRLWGRKVSDLGFHQFVGILSHLAAMNGKQAVKIDRYFASSKTCSGCGWVKQDLTLADREWACAACSCVHDRDRNAALNIRDRALSHVVGDVRPARQAVAV

SEQ ID NO: 61807 - protein, 384 aa, Unknown
  Microbial source - Accession No. Ga2100049_1040060
MDTIKICVKGVISSRDKALQVLQKELKNYKKVLIPKVQKAVRKIAKDRSIKVYAQQKWMLDKKITGYVKNLPFHPMTFHNQSVWLERTEKGHFLIHFKTRQEEKEAVCHLQVPKKYRNQIEKACGKDNPVLGQVELIEDNKYGWINVHTTLRLPKPKPYEPKGWIGVDVGWSKLATSILVTANPHLHFTNPTVHGKDFKTRIIQLKYLLKQYARKGKSWKKWSFRLKQTVKYAVGTVAKEIVAKAKKHKAGVAMENLTFQSQTKRWLIPRYKLMIAVKTLCERKGIPFKLVSPRNTSITCPKCGYINAENRNGERFNCRKCGYQADSDIAAAMNIAAIGMGFTPMSKGVRLNAEASGHVARPLSTDETDDLYKGRCKPNIIEER

SEQ ID NO: 61808 - protein, 362 aa, Unknown
  Microbial source - Accession No. Ga210051_1028938
METIKFCVKSVISPKDKALQILQKEFKNYKKVLIPRVQKAVRAVVKDRNVKVYSQQKWMLDKKITEYVKNLPFHPIAFHNQSVWLERTEKGYFYIHFKTKQEEKEAVCYLRVPTKYHNQIEKACGKDNPVLGQVELIEDNKYGWINVHIILRLPKPEPYKPKGWVGVDIGWNKLATSILATANPHLHFTNPTVHGKDFKTRIIQLKYLLKDYARKGNAWKKWDFRLKQTVKYMVGTVAKEIVTKAEKHKAGVAMEDLTFQSQTKRWLIPRYKLMVAVKTLCERKGIRFKLVSPRNTSITCPKCGYINAENRNGERFTCRECGYQADADISAAMNIATIAMGFTPVAKEVRLYAEASGDVATP

SEQ ID NO: 61809 - protein, 641 aa, Unknown
  Microbial source - Accession No. Ga210057_1032582
NIDFYAPSSEILKIRKHSSHTKNGSPQKSFEKSEFKVSDCHKMISFFKKSLQKHPEWNCFGFRFSPTKTYGAIDEFYRELKNQSYSISYIPFDKNLLMEYIDQGKLYLFQIWNKDFSKHSKGKPNLHTIYWKALFDPKNLKNVMYQLNGEAEMFYRKKSIKNPKIHKANEPIKNKNPNNPKKESVFGYDLVKDRRYTVDKFQFHVPITLNFKATGTGRINDTVLRFIKNNPEVNIIGLDRGERHLIYLTLIDQKGNILKQQSLNIATRKIPASKKFNIETNYHELLDNKEKERDKSRKDWRVVENIKELKEGYISQIVYDISKMMVKHNAIVVMEDLNFGFKRGRFKVEKQIYQKLEKKLIDKLNYLVFKDKAENEIGGLYCALQLTNKFESFKKLGKQSGFLFYVPAWHTSKIDPTSGFVNLFNTRYESADKAKRFFNNFENIRYNKDRDYFEFEVKEYSKFNPKADGTRQEWVICTNGDRIKTSRNPSKNNQWNNEKIVLSDEFKNLFKKYKIEYEKDLKNSILSQTEKTFFEKLLNLFKYTVQMRNSVTGSEVDYIISPVMNAKGEFYDSRKAGGDLPKDADANGAYQIAKKGAWVLNQIKAHEGKDWKKLNLAISNKEWLQFAQAGEGSIYGKIQNN

SEQ ID NO: 61810 - protein, 606 aa, Unknown
  Microbial source - Accession No. Ga214474_1011027
MASKSIEAKVICRGNDQYTAEQKKQFLWLTHQTFNEGVRKVLPYVFKMKRGELGEEFQAIYYAISTSQDAIGKLEAIVNPEWKTKKIGKSQPDQWRQLLQYREIEREFREKIKSEGGKSTKKFRRELKKAKARLAKEVGQKDIWAAAAAILRQRQNLLFNRDKVLPNLPSEFRRKIYEMTIQLMHGNQELIANWEDEHAEWLMAREKWEEENPEYIKVRPILERFEKEQGKVKGSRIRWLAYLDYLSSHSQLAAWRGGKAEIIPLTSEERKSFRKPRQHFEAFFKKNPEIAELDKKHNYYQREFARTQSKRSRHLDGFKHKPTFTLPSATQHPAWYSFKKNATYDNLDLGNGSIDLKLLTGEGENIRGKITYQFEADSRLKRFRKVGTKDKGGKAKSYLYADPILDKERKAEIKGIKLIFRPARPDGIPYLVFTCDIEDEKPTVKIWKEDTPEESNKASTAKKKSKRVYPPELVTLAIDFGQRHLGAITVCKNNKCQPEPISFLPGYLKKKKGYESKPVKAWLATIPGLSFNALKMHELEISSGMSRRFKDPTSKRQAGAEGKTSRTRRIPEDEKSWAGLRDHIAGMKEDFYKKAAHLIVQTALQN

SEQ ID NO: 61811 - protein, 1124 aa, Unknown
  Microbial source - Accession No. Ga255343_1026926
TLRGGLDHALADTKIPVSKGKDKSDRDPTKDERKARRILLALSWLSVESKRGAPARHIVAHDLDEQSDTRSNWKTVEALKEILKHRGLGESEIQLWVEDCSASLTAAIRDDAVWVNRSKAFDEAVESLDSSLTRDEVWDMLERFFGSRDAYLAPGEDSEESSETEQEDKAKDLVQKAGQWLSSRFGTGKGADFCRIAKVYSRIAAWAGKAEVGMTGAAAIANLAAALDKFSPPSKDLKGVLNLISGPGYKSATRNLLNKIVDEINITEKDLEKLKKAATEDKRKCKANTQSKGQRSYANAILKDVEDVCGFAYRNDKDGRPVSVVDYPKYGDNYSWGPARHSEYAVMLDHAARRVSSTHTWLKRAEAERRRFEKDAKRMNSVPCSVKAWLDTFCMERSEAMGALEPYRIRRRAVDGWDKVVRAWAGCQTEAERREAVHTVQSECQANDEKFGDAQLFEALADDDSCGVWLLSDGDSENSPDPQPLIDYVLATDAEFRKRHFKVPAYRHPDALLHPIFCDFGLSRWDIKFAVHEARKNTTRKTQDAMSDDDPHALSMTLWTGRAIESRRFRWQSKRLTHDLALDETRQREDGASEISRADRLGRAAAGVSPHGAVRIAHIFSDKMIWNGRLQAPRGQLNAIAARVADHGWDAKAKQMRDHLQWLITFSARLEPVGPWIEYKTGFPDDAPAKPFVSRRGDYAVKHQSNDERKGHAKLILSRLPGLRVLSVDLGHRYAAACAVWEALSAEQATEACQAAGHEPPKDSDLYLHLKSKETDGKVRTIIYRRIGADTLPDGKPHPAPWARLDRQFLIKLQGEDRQARKASPAEIAAVEELEKAVGRKPPDRRSMQVDDLMAEAVRTMRLSLRHHGRRARIAFNLTAGKKLLPGGREEVLTDGTRADLLADTLADWYDLFTGQGWGDEWAQQQWEAHVTPLLQGTALPQAPEDDEATFKARKKYRANLIKNLQPAAESLARDASLCRQLHCLWATHWRENDAALRKRLRWLRDWILPRGKAKDDRAIRHVGGLSLMRIATVRLLSQVQKAFHTRSEPEDLRKNIPPKGDDALSDFDRSLLDTLEHMREQRVKQLASRIAEAALGIGREHVFPTKKEREKKCWCGKVHDKKD

SEQ ID NO: 61812 - protein, 1493 aa, Unknown
  Microbial source - Accession No. Ga0255346_1002844
MPQQAKPPVTQRAYTLRLRGAGPSDISWRKALWQTHEGVNKGAKAFGDWLLTLRGGLDHTLADTKVKGGKGKPDRDPTDEERKARRVLLALSWLSVESKLGAPEGYIIASGEEAAEDRNGKVVTVLEELLKSRNVPNNEISEWKNDCSASLSAAIRDDAVWVNRSKAFDDAVKSVGCSLTREEAWDMLERFFGSRDAYLAPVKGSEDESSETEQEDKAKDLVQKAGQWLSSRFGTGKGADFCRMADVYGKIAAWADNAQADTTGNDAINNLAAALNESTLASNDLQGVLGLISGPGYKSATRNLLNQLATKTIVTQQDLANLKDKAIKDAQKCNQNTGSKGKRPYSDAILKNVEAVCGFTYLQDGGSARHSEFAVILDHAARRVSLAHTWIKRAEAERRRFEEDTQRLANVPGPVKDWLDSFCSERSGTSGALEPYRIRRRAVDGWKEVVTAWSKSSCSTSADRIAAARALQDDPEIDKFGDIQLFEALAEDDAVCVWHKEGDAAKAPDPQPLIDYALAAEAEFKKRHFKVPAYRHPDALLHPIFCDFGKSRWDICFDVHKNAQTPFPRALCLTLWTGNGMVSVPLCWQSKRLAHDLALGQDVQNDGSSEVARADRLGRAASNVTKSDEVKISGLFEQADWNGRLQAPRQQLEAIAVVRDNLSLSDQERERRMSGMMDRIRWLVTFSAKLQPQGPWCEFAEKLQLRINPQYWPHADTNKDRKGHARLILSRLPGLRVLSVDLGHRYAAACAVWEAVAKGDFEKECSNAKGKGAEIHYGPDGCKPEDAIYAHLVWPEKASNSATKKAKTEGRDKFHPVTIYRRIGADTLPDGTQHPAPWARLDRQFLIRLQGEEEGVREASNEEVWKVHQMEAELGRTAPIIDRLVKAGWGQSGKQRTRLEALRELGWKPASEAAGVSDDMDADEGDDRKPSLSVDELMSSAVRTMRLALKRHGDRARIAHYLITDEKTKPGGTKEKLDENGRVDLLQDALVMWHDLFSSRGWRDDAARQLWDEHVAKLSGYKAPEEIGEEFSGPERKKKQKENREKLHDVAKAMAQDVTIREALHDAWKKRWKDDDERWKKQLRWFKDWVLPRGKHASDPTIRKVGGLSLPRLATLTEFRRKVQVGFFTRLQPDGTRAETKEQFGQSALDALEHLREQRVKQLASRIAEAALGIGSEGGKGWEGNKRPRQHINDPRFAPCHAIVIEDLTHYRPEETRTRRENRQLMTWSSSKVKKYLAEACQLHGLHLREVSASYTSRQDSRTGAPGIRCQDVPVKEFMRSPFWRKQIAQAEKKQAEGKGDARERFLRDLNAMWKDKTVANWEKAGVIRVPVRGGEIFVSASRDSQGAKSLQADLNAAANIGLRALTDPDWPGKWWYVPCDPAGFRPIKDKVEGSTAVKLDQALRQPAQAQSGDAAKDKKKRGNKGGGKSKEVVNLWRDISSSPLECIEFGEWKEYAAYQNEVQCRVIRILEEQIKGRHKQPHEGSEEDDISF

SEQ ID NO: 61813 - protein, 1505 aa, Unknown
  Microbial source - Accession No. Ga0255355_1000451
MATENGKEQPSVTTQRAYTLRLCGLDKHDNTWRDRLWNTHEAVNKGAKAFGDWLLTMRGGLCHTLAEVDIPGIGKKLARNPTQQEIKNRRIVLALSWLSVESIHGAPESHLVSHDLDTVTGERKNWKTVDALHEILRSRHLCEEEVNQWVVDCRDSLSAKIREDAVWVNRSKAFDLAKARKGASLSREDIWDFLQPFFGNNYSYLKMKTAVTNTSENSEADSEESKDEPSEEKAKDLSQKAGQWLSSRFGTGTGADFCRFYEVYDAMAKHCQNIQAGVSGAAVCGSLADALHGFSPSSRSINGILELISGPGYKSATRNVLQQINNMQSVSQLDIDRVRDASEKDAQQSREKVGGKGSRPYANAVLQDVEAASSITYHNAGNGPSHHWQYAVILDHAARRVSMAHSWIKRAEEERSKFEIEKDKLQCVPSDARAWLDAYCARRSSESGAIDAYRIRRSAVDGWKQVVAEWAALLAKAKNAGSEPPSEAESARIQAARKLQDTIEKFGDIQLFESLSLPDAKCVWLTNGKPDAQPLMDYVAGTDAVSKKQRFKVPAYRHPDAFLHPVFCDFGNSRWSIDYAVHRAPEKLARAQQLLEKKKEELTRAEQALSKASDPSKRSSIEKKLKTLNVAFKQQEAEVLWLESHHAMTMGLWNGSRIEDTPLLWQSKRFGSDIGQAGAEHPLVASRADRFGRAVAMAKDNAPVVPSGLFDLADWNGRLQAPRRQLDAIAAIHDRTDLSVEEKRQLVAKRIRTIRWLVTFSAKLQSRGPFIAYAAQHGFDWRYGAHGIENKSREGLAKLVLCRLPGLRILSVDLGHRYAAACAVWETLSAAQMQNACLEAGMEAPSQRTLYLHLKHFVNGKEKKTIYRRIGADTLPDGSPHPASWARLDRQFLIKLQGEDRDARPATCDEVVAVEQLETELGYVRPIKRKGREHLVDELMSDALRTLRLGLQRHGARARIAFNLTATKRTRPGGIQELLDQESRIGLLTETLLEWNELYAGERWADELARDMWNKHIQPLLGGTILQETNNQDVTPSAAKRRMQREETREKLRPVAKQIAENDSLCRQLNVLWSTRWQIEDAAWRMRLRWMRRWLLPRGINRDPQFRKSIRDVGGLSLIRIASFKSLYQVQKAYWMRPHPDDLRRNIPERGDSSLTSFGQRVLDAMERMRENRVKQLASRIAEAALGIGDETSVNAKNGRQKRPTERSNDPRFAPCHAVVIEDLTHYRPDETQTRRENRQLMSWSSSKVKKYLGEACQLNGLYLREVPPAYTSRQDSRTGAPGLRCNDVTVAEFYTSRFWRKQVEAAEKNQKDGKKGDARERYLLSIDERIRSEANDRDVFRIPVKGGEIFVSACGQDGGSNANRKAPPGLQADLNAAANIGLRAIFDPDWEGRWWYIPCDATTICPVAKKFNGCKAVDSSKPLRIVAEKVAVSSSGIDEKRSGRKGIALTDGSRIVNLWRDPSGAPIRRDVPSNSEWQDYAEYWNKVQSRVIANLRKSYGLREI

SEQ ID NO: 61814 - protein, 475 aa, Unknown
  Microbial source - Accession No. Ga0255811_11272827
MDEPRITKVLKLHILKPADTLTWKELGDILRDTRYRVFRLANLAVSEAYLHFHLWRTGKNDLFERRTVGRLNRELREMLEKEGVSKENLDMVSNTGALPANVTDALAQYKLRAITKTAKWNEIIRGKCSLPIYRLDMAIPVRCDKKDQRRLSRTKDGDIVVELMVRQRPYPKVMLATQRNSLGDGQRAILDRLVDGADGYRQRCFEIKEDKRTRKWHLFVTYDFPVTTSARVSEERVVGVDLGYSCPLYAAVNTGFARLGRRHFVALAGAVRSLQTQTMRRRREIQRGGNVTTGGQSARAGHGRKRKLAPIEKLEGRIDAAYKTLNHQMSAAVIKFAGDNGAGVIQMEKLEGLAAELTGTFLGERWRYEELQRFITYKAAEAGIKIRMIDPRYTSRRCSACGHINEKFTRQFRDTEGEKGRVTRFICPECGYTADPDYNAARNISTIGIEDLIQQQRIKQGLTQNDKEGGKTNSK

SEQ ID NO: 61815 - protein, 1554 aa, Unknown
  Microbial source - Accession No. Ga0255812_10127107
VYTGGQGLPLHAGNRKLCFEKFHNQEIASLAAMSFKGAVLHVSSENRKEMDMTQQNRPSVTQRAYTLRLYGANSEDASWRKALWLTHEAVNNGAKTFGDWLLTLRGGLDHTLADAKVKGAKGKPDRDPSIEERKKRRILLALSWLSVESKRGAPAAYIIATGREITENRNSKVVAAFEEILKSRGLTDTEIAEWRSDCTASLSATIRDDAVWVNRSKAFDDAAKSVGRSLTREQLWDMLDPFFGSRDAYLAPTKSSEDDSLEEEQGEKAKDLVQKAGKWLSSRFGTGEGADFSRIADVYEKITAWADAFQVGKTTTGDEAIKNLAAALSEFKPVSNDLTGVLRLISGPGYKSATRNHLNSLFGKKRINQEDIQILKTKAANDAQQCRQNTGSKGYRPYANAILKDVEDACGFTYRTDKDNKDVSVSDYSKFEDGYRWGPARHSEFAVMLDHAARRVSLAHTWIKRAEVERRRFEDDALKREQVPENVKKWLDDFCWKRSEASGALESYRIRRRAVDGWKNIVGAWSKAECRTMEDRITAARALQDDPDIEKFGDIQLFEALAEDDAVCVWYKDGDPAKEPEPQNLIDYALAAEADYKKRQFKVPAYRHPDALLHPVFCDFGESRWDISFSVHQQERNKSKLNNKKMITQGSPLRGLSLTLLTNIGIKPVLLCWQSKRLARDLALVSNADKGHVVNVSRADRLGRAASAVTENDTVAIESIFEEKKWNGRLQAPRRQLEAIAAVQNNSRFSAEERARRIQRMRERIRWVVTFSARLQPQGPWCEYAEKHRFKPDPRYWPHAEINKNRKGYARLILSRLPGLRVLSVDLGHRYAAACVVWEAVDAAHIKEACRAAGRESPNESDLYLHLKTKGQDGKERITIYRRIGADALPGNTPHPASWARLDRQFLIKLQGEEEGAREASNEEIWAVHRLESGLGRVAPLIDKLIAAGWGGTDKQKARLEALKQLGWSDRTAAASAGAGAEADEESGGIVPSLAVDELMSSAVRTMRLGLKRHGDRARIAFYLVTEEKTMPGGVKNKLDEQGKIDLITDALILWHDLFSSRGWCDDAAKKLWDDYIAKLSVYRALEEGDKDDSGSERRKQKDENRRKLYNVAEALLQDTDLQQRLHNAWKKRWEEDDEWWKRQLRWFRDWLLPRGKHTRDPGIRKAGGLSLIRIATLTEFRRKVQVGFFTRLRPDGTREEIKEQFGQSTLDALEHLREQRVKQLASRIVEGALGVGSESPRHWDGCKRPRRCINDQRFAPCHAVVIEDLTHYRPEETRTRRENRQLMIWSSSKVKKFLSEACQLYGLHLREVSPSYTSRQDSRTGAPGIRCQDVSVCEFMRSPFWRKQVKKAKAKQDKNEGDAREKFLCDVDALWNDKTAADWVKAGFIRVPINGGEIFVSADPNSPAANGLQADLNAAANIGLRALSDPDWPGRWWYVPCERADFRPVKDKVEGSAVVKLNQVLRQPTQGKKDGINKKKKDGDSRVVATNEVVNLWRDISSLPLESAEAGEWKEYAAYTKEVQYRVVNILKKQIQGRCGQPHDRHREDDISF

SEQ ID NO: 61816 - protein, 1154 aa, Unknown
  Microbial source - Accession No. Ga0272446_1000057
LHEDFICQSLEKANIDFSEYLRLFENLLELKGKKQRETDKELKIKIETTIKNEEEKKKKLEEILRKKICELYQITAKEWNNKFVDEKGKPLFKKKSYDILTEAPILKFLEMIYRDDKEKISIIHKFHGFFTYFTGFNQNRENYYSDKELSTGVANRIINENLPKFCQNICKFSKSRELFESEQELKKHFDIFELKYYNNALTQDGIDKYNGCIGEFNHFVSHYNQQHKNKTRLQSFNTLFKQIGSLKKKKEFIFEIDEKDNTLEKVLNQFVDQSARVNKKKKILKLSCILCSTEDLNGIYINKKSISEVSRMVLANWDTLSQELVEAEVWHLNKETEYPKEKENTSLQEIVDSLKGKESLFKEEFQKFDEKNRFLSALTHLLKLKFDFYESNLTKLKILLEKKSDLRKKESKDVIKGFCDSAIDLIRFVRLFSVKTPPENINTDFYNLHKEILEDPDYPVFKWYDAIRNNLTKKPYSLDKIKLNFDKGNLLGGWTDSPIGNTQYSAFLFRKESEYFLGICLNTRLFDENKNPHAYKKDGKMEKMVFTQLDAKTIYGSIYRGKYKSKYSDDKKVMSDSELIDRIKSILESQKKHYTKLDKIIQTKFDKATDLARVISTNKFYSLNFVNISEEYLRSSTVNADKPLYLFKITNKDFSKKDKSKKDNLHTKYWKVLFENKDNIIKLNGQAELFFRPASIKEKDKVKVETFEKKRIIDHAIKHARFARDHYEFHVPITLNFGCGEYKKITDKVRDLVKSKKAGMNIIGIDRGEKHLAYYSIIDPNGNILEQGSLNKDLLGKDYAQKLEKIAKERQEARKNWEEITRIKDIKEGYISQVVKRIADLAVKYEALIVFEDLNIGFKRGRQKIESSVYQKLELAIAKKLSFYVSKESEENEIGSVTKALQLVPPINNYGDIKGKQFGIILYTRANYTSQTDPLTGWRKSIYIKKGSNQYIKSQILDNFSDIYFDGEDYVFVYKDDNDKEWRLYSGINGRPLDRYRGKKGKSQNTWIIEKQDHVKILDTLFSKFDKKRSIHAQIKEGIELTKDSPNVTSYESLKYAIDLIMQIRNTGIEESDKDFILSPVRNEDGIHFDSRKAKKDQPDSGDANGAYNIARKGLLMCKRIIESEKPDLFIKEKEWDKAASNWDKEFVRQKWTM

SEQ ID NO: 61817 - protein, 1321 aa, Unknown
  Microbial source - Accession No. Ga02722446_1000164
MFDQFTNLYELSKTLRFELKPVGKTRENMNEHLKYDEVLKTFMADQKIEDAYQTLKPVLDALHERFINDSLELDEVKNIDFSEYLEKYRDKDLKNKDFEALERKLRVKFKKLYEKVGENWIAKAGFNDKGKPVFKEKSFKILTEKGVLDFIKKNADNFTFVSKEQLEGAIKVFENFFTYFTGFNRNRENYYETGKEAYTAVATRIIHDNLPKFCDNLIVFESRSKDYLGAYELLKGRGLSLVTKEGRPLMPIVDNIFRIDYFRKCLSQAQIEEYNKQIGNANFVVNLYNQVFSGNSDFKKLLSFKLLYKQIGCGKRRSFFVELTHDTIAEADKARGEGKKAFSVEELVLLAKQAGEIYFQGKSDDGIINTVPELLDYLEKKSDYRGIYWSKTAINTVSGKYFANWFDLKNKFKEAKVFEKNKKGSEEEVKIPDVVELEDLFSVLNEWSDWKTTLFKSSIMQDAKKRELIEKSPNASTALLSLLFADIKDHAECFIDEANEVSQVKDFKKEENKILIKLWMDHALVVCKMLKYFLVREDKVKKVKGALMDATIVEALNNILSGQVEVDKNGKKIAAEVDWFEWYNYFRNYLTKKPQDDAKKNKLKLNFECASLLGGWSDGQEKEKGAVLLKKDNFYYLGILKKKNLFDTEKENNPVYQNPTFSAGRLILANLKFSTLAGKGFLYEFGKAYGDMGAEDPDKAIKCLKKIIKDRYEEKYPLLARIAATHYSDKKVFDKDIQETLKECYVCRFEPVSWIKVEEYVDDGELYLFQIYSKDFATNNTGKNDLQTLYWKAIFDEYSSFQLNGRGEIFYRKQAIKEKIVKVGYEGKPWVIADKRFTLEEGKFAFHCPIKINYKAKNYSQPKFAFSEINKIINDGFGKFSNIYFLGIDRGEKHLAYYCLVDQNSKIIEQGSLNMPFVDASGNPRMVKTERKFIQEDGKEQLEIVECKDYNELLEARAGNRDYARKNWQVIGTIKELKEGYISQVVHKIAGLCANKEHPVFIVLEDLNTGFKRGRQKIEKSVYQKLELALAKKLNFLVDKNAKLGEVGSVTKALQLTPPVNHYADIKNKKQVGVMLYTRANYTSQTDPKTGWRKSVYLKPGSEENIKNQILEQFSDILFDGKDFVFVYADANTGTEWKLYSGINGISLDRFTVKKGVKNEWCIEKQDIVEILEGVFSKFEKNRSFLSQIKDEGRELTKISDHTAWESLRFAIELIQKIRNTGITSRDNDFLLSPVRDSAGNHFDSRVYLDKEQRGEKIDLPSCGDANGAYNIARKGIIMWEHINRGYRPYVSDDEWDAWLAGVTNWEKWREGNEKLLKYNK

SEQ ID NO: 61818 - protein, 1174 aa, Unknown
  Microbial source - Accession No. Ga0272446_1001728
MQNYKITKTIRFKLEANPEQTEALLNQVEKSNQAFDLVFFTSKLKNFADGMRDYLMFQKGKEPEKWQFRKNFTIKKDWLKVYAKEELANIKQKQKEEQDKKSRRQPIQLNEGAKEIIQKSLGEVYAIYQELIQDVSKELNERARRERTGLLLKRLQEKNNLPLLCDLTEHISSGNETDNSIYELLKEKEMLQKELLQGIAEFLPAQSSGLPIAKATFNYYTINKKPTDYAQKIEEQLKELSISDYSKKIQINSKLFLGNDNFKKVMEDIRNRLKKDNITHLLFGHVPASISLGYEYRSLRQILKNIKAEQKKKFNELMMEDDFTYDKLKKEQDLYLFTSIKKEQFDEYLDKTRKIQELADKINDKSLSKEEKENLTSKKQTIAKKRGELLRDKFIDWKKFMEIYRSVAQKHGKILASLKGIEKEKVESQLLKYWALILKVNAQYKLVLIPRDKVQDAKKWIENHKNNKKTDTQELPQLYWFESLTFKSLQKLCWGHAETDNNEFRKNIISIIPKNKNNKPYTGEHEFEGKEQDKINFYKKVLQDKYTRDVLHLPFAQIDKEIISKNFDTLEDFKITLEKICYRRQVILNQDAEETLTKQFKAQILNITSLDLSRKSNESALKPHTQIWKNFWSDSNEKQHFDIRLNPEITITYRKPKPSRVHKYGKNSQNYDEKKKNRYLNPQFTLVTTMSEHCNAPQKNLSFITEEELKKEIDTFNQKFREKNQIKFAIGLDNGETELSTLGIFVPDFNKNTNEERLAQLRKVQEYGFEALTIKNLNYAERDYNGNPRKMIDNPSYFLNKSLYMRTFIKTEQEYERMFAEQFEKKHLLSLDLSAAKVICGHIVTNGDTRALFNLWMRHAERLIYFANDHIKEETAKKVLIKTIQELLPAEKEKLAESISKEKKYAKLSEQEKLRYFTWLFEDRKLYSFNEEENKKFNDILERKGNYAIGTVFSVTYLGEELVDVKSVFDIRLIFKKREEFYSILSEEEIMKELSRYNTNRTSHDLSNQELDLKLKTYKETIVANAIGVIDFLYKQYKQRFGGEGLIVKEDFDTPKIQEDLERFSGNIYRILERKLYQKFQNYGLVPPIKSLLSLRNQKVALDSIFNLGVVSFANPDKTSQQCPVCLEGKLYHGKKCDKCGFRATMMHSNDGIAGYNIAKRGFNNFQSLLPLKQ

SEQ ID NO: 61819 - protein, 1267 aa, Unknown
  Microbial source - Accession No. Ga0272446_1001728
MKNFIAKYSVSKTLRFELKPIGKTLENIQKNGLISKDEMLAENYKEMKKTIDEFHKEFIHKTLSNASLDKENLKEIAELYTAPAEKRKEDNYKNQLKAYQKALRKEIVDHFKNDELFKNLFAEKLIKNHLQGFAQQKGLRFYSEFNNFTTYFVGFHENRKNIYTDEDKRTSIAYRLIHENLPKFIHNIAVFEKIQEKKIPLTILENQFMSKLGNDTLADVFRLEYYNCLLTQNSIDFINQLIGGYVNENQEKIQGLNEYINLYNQQQKDKKDRLPKMKMLYKQILSDRESISFLPQSFKESQEVLDAIRDYYLSNLLEYRAEDKEEPENVLEKIQERLSHIADYDLSKIYIRNDKAITDISQTIFGHWGLIHSALEFDFRQKNVGKKTTQKQEEDVEKYLKSDYYSIAEIENALISYKESTQNEKLVEVFNKTSHPIADYFKTYFKAKEKSKEGKEYTLIANIQAKYTCVEGLLNTDYPKDKKLHTDKDNLRNLKAFLDAILELLHFVKPLIISKNDFLEKDENFYSSIEPYYKQLELLIPLYNKVRNFATQKPYSTEKIKLNFENSTLLNGWDKNKESDNTCVLFRKGEDFYLGIMNKKYNKIFENVPKPKSDTTFLKMEYKLLPGANKMLPKVFFSKKNIAYYAPDSEILRIRNHSTHTKDGEPQKGYEKQAFKLEDCHKMIDFFKSSIEKHPEWKNFNFTFSNTQSYQSIDEFYREVEEQGYSISFVEVDEEYINQCVNEGKLYLFQIYNKDFSKNKKSKGKPNLHTLYWKALFDPENLKDVIYKLNGEAEVFYRKKSISAENIIVHKAQKPIENKNPLNLTKYSIFQYDIIKDRHYTEDKFLFHVPITLNFKSKKGKENINQEVLDYLKENPDVNIIGIDRGERHLLYLTVINSKGQILHQESLNTLKNETYNIQTDYHALLHEKEKDRDKARKEWGVIENIKELKEGYLSAIIHNIAKLMVQYNAIVVMEDLNSGFKRGRIKVEKQVYQKFEKMLIEKLNYLVFKDVPNYEPGGLYNALQLTSKFESFEKLGKQSGFLFYIPAWNTSKIDPTTGFVNLFGGIKYESIHQAVNFFEKFQSIRYNTKEAYFEFAFDYNDFTTKAEGTKTQWTVCTHGERIINFRNTEKNSEWDSKTVQLTQQIKNLLNEYHIAYEQGQDIKPAITAQNDKKFFEELLKQFKNTLQMRNSVINSDVDYLISPVMNAKGEFFDTRKTDSTLPQNADANGAYHIAKKGLLHVQQIIDGVKKTDLTNKKWLKFVQNNL

SEQ ID NO: 61820 - protein, 583 aa, Unknown
  Microbial source - Accession No. Ga0272446_1001929
MKVVEFKLQLTDDQASKVDTWLNQLRWVWNEALRRVNEERQRYYRKQVNEDGTFGKVEDTGEVWQVWYNKEIKEKAYCCHIADKTRYADYAPCCEIRPYRHQQYANLKELKKWARNAATQKCNPDKPWLKDIPSCFSDFVARDLIKAWEQALSKTNPARYPRFKGNRDTLRSLTDENGHDHLRKDIRGKRNWLVKLNNKLGFMRIIGKHDRFPKDFTVVRICKRASGYYLQVTSKDLEDKTLKRNDRPVGIDVGLKFIVATDQGRVVEPKRYARVAERRLRLLQRKAARRRDAVQKLEGCKGKNLEKVNQQIALLHENIKYRRRQFNHKLSTKLVREYGAIAVEKLQLKNLMRRPEPKLKENGTGYARNNAAAKSGLNKSFADAGLGQLLEMLKTKAEAAGRLFKEVDPSYTSQECSNCHEQVKKSLSTRTHVCPSCGFVEDRDVNAAKNILEKANFSSDYRCWDKREVKPASASSVEGQQESDSGSLDLGKELRAEDALRLTQSQKNNDHLLVEVNSPSKEAVIPTGSGLDEVRLLQQMHVNSETSTPLASEAVIDQVKASTPKPKPRKVKRCLQNQPEAPT

SEQ ID NO: 61821 - protein, 979 aa, Unknown
  Microbial source - Accession No. Ga0272446_1017314
MAELDPTQRAYTLRLQGQRREDYSWSDALWATHEAVNKGVKVFGDWLLTLRGGLDPGLAERPVKDKKGERPPEDKERKNRRILLALSWLSVESEQGAPEKYIVASGRDLTSERIEKVKTAFHEILKCKGLDENQIQAWTTDCLPSLSAAIREDAVWVNRNKAFEDAKRQYDITDEDVWDILEPFLGNVDAYFFIKDLPADDQDESAEESSGGGEEPKDLVKQAGQWLSSRFGTGKGADFDRMSAVYEKMAELTSRLEGEMTSGAFFESLAEHLSEFNPDSSEPQAILKLVSGPGYKSATRNLIKKFAEQPTLNSDDLMNFTNAAREDAQESRNKVGSKGQRNYADAILSSVERVCGFTYLTASDGSDVSVETRYQLPENYTWGTSRHKEFAVMLDHAARRVSIAHSWIKKAEARRNKFEADAQKIKDIHPDVKAYLDAYCESRASLVGSLEEYLIRPRAVSGWEEVVKAWAKLEKQPGWDNKEPDQRKQARVDVARELQDQIEKFGDIQLFESLASDDATLVWHKDGKADGEPDPELLKNYVKATVANFNKQRFKVPAYRHPDAYYHPVFCDFGNSRWDVRFSVHEAHTVLAEKKAQLERLQQEMQTTRNLTKKSKLQSQIKDLEEELRWLENPRLVQMKLWTGKSIAPVILRWQSKRLVQDLALKQNASTAPEVVSVSRADRLGRAAAGLSANHIVQVKNIFDEDHWNGRLQAPREQLEELARHVEKHGWDARAIKLRRSIQWLVTFSPKLEPWGPWCEYVNTHPDFKGLKTKNPSAWPHAEENKKRSGDARLILCRLPNLRVLSVDLGHRYAAACAVWETLSKEDFIKQTEGKKIKAGGTGSDSLYCHVEHECDGKKRTIIFRRIGSDILPDGSEHPAPWARLDRQFFIKLQGEQEGAREASNEEIWQVHELEKELGVNTPLIDRLVTTGWGETDGQQARLEDLRKRGWKPKTSLGITVDESAEEHDEEEARFRRFP

SEQ ID NO: 61822 - protein, 552 aa, Unknown
  Microbial source - Accession No. Ga0272447_1003507
LGDVLTKETTRVIVPLVGFEAKLLNTKSTYVAVHAKLEFLSNEDKREVLDLMRRFSSAYRWIYNRLIEGVNPAEVKRVSGPVSRFGLNSEYNNSALQLARYKILSLNSKGANPRKIIFGTRTLFNRLCRKGSLNSRARAKRVWRERRNGNLLSLGNKRNVSGNYVLTLSLINGELWLRINMGTSENSESGKKESRYIYAKVKTSHPYLNHILEVVGKSGIASVNVYLKLIDGKVYAIFTKKIDLPEPVLTKYYGVLGVDINARPFHLALAVAEPDGNLRKYSTISLEEAIRIRERYRGESSAKVLDNFYWLVAHQVVDLAKNEGVAIAIENIFNLPKGFRGDGNKKLRRILGRFAYRSILERIVRVASREGVEVWGVNPAYTSVIGMLKYAPMYSLSKDVAAAYVIGRRALGFPEKVPKRYLQLMASPEYREAVINWFNQELRTLEEKIGGERNEYKLNRLKREKESLEKAFNHLNKFLSLEDSPEGLQRGLTYGRNPEEPKGDSLHLWKALQVGVLRPLLGQKVPRDLSVLKPLLVGGVWKGRGGTHLGPS

SEQ ID NO: 61823 - protein, 1392 aa, Unknown
  Microbial source - Accession No. Ga0272448_1000001
MAESLPATQRAYTLRLRGADPDDESWREALWRTHEAVNKGAKAFGDWLLTLRGGLSHELADEPVKAKGGRRQPSADEKRDRRIVLALSWLSVESERGAPQQFIVASGKDNDKQRQHKLVKALRDILQKRGVGKAELDEWVKACEGPLGAAIREDAVWVNRSAAFDQAVKRIGKSLSRDQVWDLLERFFGSKNAYLAPIVLKDEAEPSEKAKDLVQKAGQWLSSRFGKGKGAKFEVLSGAYQEIERWAKSARPSSPAHLMAHLARLLKAPSEDLDGVLSIISGPGYKSATRNLLKKLSGQQRVSSEDLARLAKTAADDRVKCKSKVGEKGKRPWADTILEDVQRACGFKYIPDGGPARHRQFAVMLDHAARRVSVAHTWIKRAEAKRRSFEEDARKIGQVPSQAKQWLDDFCLERSRSSGSLEGYRIRKRAADGWEHVVSRWAGADCTTVADRIAVVRELQSDPEIDKFGDIQLFEALAEDDATCVWKPEGEPDPQPLKDYVAAKDAEFKRRRFKVPAYRHPDPLLHPIFCDFGCSRWDIKFDVHEAYKRKERKSTQTQTNPHGLTMRLWDGTDVSDVRLRWRTKRLFGDLNLGGAGAGKDVSRADRLGRAAAGAQEGEAVQIAGLFEDKDWNGRLQAPRPQLDAIARRVDAHGWDKQAVRMRARLEWLLTFSARLRPRGPWTEFAKKNDLRPDPVYWPHAAENKNRQGRGRLILSRLPGLRLLSVDLGHRYAAACAVWEAVSAEAVKKACKEAGHPNVKEDDLYLHLKRKDQGKLRTTIYRRIGADRLGQPTPRKEVAHPAPWARLERQFLIKLQGEDETPRKARKDEFKAVENLERELGRERSEADKLPHRIDELMSEAVRTVRLALGRHGNRARIAHYLVATEKTMPGGVVQSLDQSGRVRQIAYALELWYELAASSKWKDDWAAELWEKQAWAKDVPLQKRDEETVTRQALKKEKKERCGKLEAAAENLLRDGARCRDLSARWAKRWGEEDKKFRERLRWLRDWILPRGKKAAKNPAIRHVGGLSLTRLATIRSLWQVQKAFFTRMTPEGRRRDEDGRPLTAGEGFGQKVLDALDRMRDQRVKQLASRIVEAALGVGKEQEKCANRDPRRPRECVFEPCHAIVIENLTNYRPEETRTRRENRQLMRWSAGKVKKYLSELCQLHGLHLREVGAEYTSRQDSRTGAPGIRCQDVPVREFMRSPFWRKQVAQAEKKLEKGEGGARERLLCELNANWKDSSEKELKEAGVIRVPLNSGEIFVSADAKSPAAKGLQADLNAAANIGLRALLDPDWPGAWWYVPCDAKTMKPSKEEASGSAAVDMEKPLVQVSEAKPGARGGRGKSEKPVVNLWRDVSARALEPGDWRRWEPYWNDVSARVVRLLRKQQGLPDFA

SEQ ID NO: 61824 - protein, 634 aa, Unknown
  Microbial source - Accession No. Ga0272448_1000002
MVSEEGIMLALKLKIIPTEKQAEILDAMFWKWASICSRMAKMKKMMSIKEIREELSRKTPSNSDIWFSKTQLWQAKDNVENHKKALKNFEKRQESVLDKLKNKVKDIKEAIDDESKRDIDPNDSSKFRIKAWIKEGNLNSSKFYTLKKWQKFLQEDEKRVKKIESTIEKLKKGNIVFSPTKISLHKDEYSINFGSSKLLLNFFYKYNKKSGINLMDQLENKFNEFQNGLKIIFSPLQPIRGSSKRSAEFLRNNIINFLMYSLYAKLFGIPRSIKALKKSNKDENKLKLEEKLKKKMSSFNETIKEFEKMIGRKLSDNESKILNDESKKFFEIIKSDNKHIPSEECLKLLKDISEEIYNSNIDFKPYKYLILIRKPLSKFKSKKLYNLKPTDYKYYLQLSYELFPKQLIATKTILGIDRGVNHLLAVSVFDPLQNRFVYNKLIENPVFKWKKRYRNLKRSIRNRERRIRALTGAHIHENQLIKKLKSMKNKINVLYHNVSKNIVDLAKKYESTIVLERLENLKQHGRSKGKRYKKLNYVLSNFDYKKIESLISYKAKKEGVPVSNINPRYTSKTCAKCLLEVNQSELKNEYNRDSKNPKIGRCNIHGQIDADLNAARVIALCYFKNLNEPGILSP

SEQ ID NO: 61825 - protein, 1437 aa, Unknown
  Microbial source - Accession No. Ga0272448_1000009
MAKQVPVRQRAYTLRLRGLDAQDQSWRDALWRTHEAVNKGAKAFGDWLLTLRGGLDHALADAKVEAGKAKPDRDPTDEERKGRRILLALSWLSVESEKGAPEKYVVPHDLDKESGMRSNWKTVDALREILKGRGLDEREIESWVQDCSASLSATIRDDAVWVNRSKAFDEAVKSIGSSLTRDEVWDMLQPFFGSREAYLAPAEPPEEESADVRQEDKAKDLVQKAGQWLSSRFGTGKGANFRRMATIYEKIANWAGKARSGMSGDKAIADLATALSEFSPASNDLQGVLGLISGPGHKSATRNLLNGFPTKTSVTQGDFQNLQDKARQDAQKCKNKTGSKGQRDYADAVLRYVESACGFTYLQNSGSARHSEFAVMLDHAARQVSSVHTWIKRAEAERRRFEEDAKRMANVPGPAKKWLDSYCRERSRRSGALDRYRIHRRAVDGWKEVVAAWSKADCKTAEDRIAAARALQDDPEIQKFGDIQLFEALADDDALCVWHKDGDSAKAADPQPLIDYVLATDAEFKKRDFKVPAYRHPDALLHPVFCDFGCSRWDIEFAVHEARRKTRRKHKPIPTDDPHALSMTLWTGSTFKSQKLRWQSKRLTHDLALGQVKQDDGAAEVVARADRLGRAAADVGASATVRIAGIFEQKDWNGRLQAPRAQLNAIAARVTRHGWDDKAKQMRDRLRWLIAFSARLQPSGPWVEYARAFPDDAPAKPFVSRKGDYAVRHQDNDARKGHAKLILSRLPGLRLLSVDLGHRYAAACAVWETLSTEQVRKACQEAGNEPPKDSDLYLHLKNGQRTVVYRRIGPDTIEAVDESTGEIKPVPHPAPWARLDRQFLIKLQGEDHEARKASPAEAEAVQELERAVGREPPDQRSLRVDDLMSKTVHTVRLALQRHGRRASIAFNLTAAKRLLPGGREEDLDEEGRVELLADRLSDWYTLFKGKGWNDEWAKEQWETHIAPLLQGAALPQISEDAEATPKARKKYRADLTEQLKPAAESLARNPSLCKKLHCLWATRWRDDDGALRKRLRWLRDWILPRGKNARRDPAIRHVGGLSLTRIATIKALYQVQKAFRTRPEPDDLRKNIPAKGDDALRDFGRSVLDVMEHMREQRVKQLASRIAEAALGVGRVKRFAGGKDPKRPREQVDRPCHAIVIENLAHYRPEETRTRRENRQLMTWSSSKVRKYLAEACQLYGLHLSEVNAGYTSRQDSRTGAPGIRCQDVPVQKFMQSPSWRREVAHAEKKHAEGKSEARERFLCDLNAKWKGREAEWEKAGTVRIPLNGGEIFVSAGPCKCCERNDRNGPAGLQADLNAAANIGLKALTDPDWPGKWWYVPCDPKTFKPVKDKVAGSAAIRLDKPLKDLPAAQGTDGARKKPSKTKAQQREIVNLWRDVSSQPISANDDWREYKPYWDHVQERVVKILRQWAGLTPNYKNQ

SEQ ID NO: 61826 - protein, 1355 aa, Unknown
  Microbial source - Accession No. Ga0272448_1000011
MSKVNNGFSSLCVWSDFTRKFSLSKTLRFELKPVGRTEDFLKQNKVFEKDKTIDDSYNQAKFYFDKLHQKFINESLSPSSDSSNLKNIDLEYFAKQFLKLKSEIQKLKSEKKQKEANNKEKEINNLRKAYYKEIKSLLDKKAEEWREVYKKRGIKFSKTDLRQRGTDLLMKSGILGILKYEFPKEKEEEFKSKDWPSLFVDDKANPGNKVYIFDSFDDFATYLIKFQETRKNLYKDDGTSTAVATRVISNFEKFLNNKKIFEDKYINHWKQIEITDEEKKIFEIDYYYSCFTQGGIDEYNKIIGQINQKTKQYRDKNKIEKSELPLFKVLDKQILGEVIKERELIAETETEEEVFINRFKEFIDQNKQRILRAQNLMNDLINEEFENEYSGIYLKNSAINTIANRWFKNTTEFLLKLPQASKSKENKESPKVKPFVSLLDIKNALDDFEKEKDSLGTIFKDKYYKTKESDEVPLNSDSQESYWKQFLKIWGYEFNQLFEDKFNEEGVKIFWGYTKDLVEQAESLNSFSRKKEEIILVKNHCDAALRIYQMMKYFALEAKKQDDIPLDYSTEFYNRFNEYYQDFKFIRYYDAIRNFVTKKPSNEDKIKLNFESGSLLTGFDKNKESEKLGIILKNKNNNKYFLGIINKKHNKIFESKNENEFIGNPAKDLYEKMELKLFPDPKKMIPKIAFADKNKKDFGWTQEIQKIKEDFENFQENKKDNKDLKFDKNKLSKLIEYYQNCLEKGNYKKEFEFELKRPEEYQSMSEFNQDIEKKNYKIKFIPVKDSYIDDKVKNGELYLFEISNKDFIWPNQKKNIHTLYFLSLFSEKNIQKPIFRLGANAEIFYRQKSEKATKEKRGEKEIIKYKRYTEDKIFLHLPIEINYGCPKDTNKNEYNKKIIEFLNKNKDEINIIGIDRGEKNLLYYTAINQKGKILDHRSLNEINGVNYLEKLIEREKERQINRQSWEPVVKIKDLKKGYLSYVVREIADLVEKYNAIIVLEDLNMRFKQVRGGIERSIYQQFEKQLIDKLGYLVFKDDRGPESPGAVLNGYQLVAPFTTFKDLGKQTGIIFYTNAEYTSKTDPITGYRRNIYISNSASQKKIKENLINKLKEICWDEKENSYFFTYNQKDFGSPISKEWTLYSKVPRVRREKNNSTGYWEYKPIDLNKEFEDLFKKCEINEKSIDIFSEIKELIKNNEGKLTQKQEFDGKNKNFYERFIYLFNLLLEIRNTISLQVKLDKRGNEIKLDEIDYGVDFFASPVKPFFTTAGVRLVGRQIEGGKIQKEKKEEFTIKNFADFERLFKGCSSDGFDSDGVGAYNIARKGIMILERIKQNPKDPDLYISKEDWDSFVLRNLS

SEQ ID NO: 61827 - protein, 1069 aa, Unknown
  Microbial source - Accession No. Ga0272448_100062
MANISLKKALQQFPQTTLSKVTNPKTGKVQTRNVLKTMQCGLAISLTPKQRKVELEELSPDKKKLLDEYIDTFENKKQLILEDFYHYYEKSIWDFLIYCSRIKDTTETTYIVIPELPEITTKIKKSDGTYLKVKAYKGISNTTGNIHKTLYWFADDIDTKDGCTKVQFQYTEQRKEYITTDNYEKYNFDPALFELQPDTQQISNRISFFYMTNAQKKDKNGIYHETPKYQEYKKKGISIKGIVDDIEIDIKEPLRTKTAAVLKAFVDKLQESIKEIESVISEKNERIALLNKEDPKNNFPEFFVTNLKEDDKKLLSELTQLQIEDRDVKKFSELYNTLAKSFNQILNNAIQTYISIKLKESKIKQSDKEQEGKRLWDTYHLNHLKGIPSFPQMKNESQGKITAEMIYHFIQEQLQQYKNFSAFDHLLLDKNDFIFTDQKRKLSEDTVEQEQEWKEQWKTIKEKENNSFILTLRKILWRKNNIPGKKLMHYAHYLVQQGKITTNSAIVKALIEYALQELLKKQEHLSCEQFSSDQKAKREFCDYARIIISFIAYQLKKEEKRKEARNLELQIDDMSGNYKGTAFDLLKKGESNILPLSGFDFDNHGTKKGACLVFRNTTDHGNIRTHWYFALNLYNKIHFEEFDQQYDHPLEYPVDQYFVLASKGNDKTVSHHIYQLSPKEFDPGSKTMLIPLLLGTRQLREYITNFEISPFKNLLYFNSAEIQRIRNHKEEQYFLNLVTTRPEVEAYELTQEKKKGLIGIDRGENTVAWAALVNTQGNPLFEGKDERNFIELAPKFGKKFREEYKEISKRQSHGSVKKLNIQGRVKKVIEGVGAKIISNALEYGLQIVLENLDRGFGRHGKNTFVGVRQFTHLQKFIESKLKQNNISFKKDSILQTVPAAYTSKMCSNCGVINSLTGKEDFIAAVIEQFKDHPQQKDPKISCNKLCINLDQEITSWDRNKKREVVENSFEKIKAIFSNTKIQKHEAYVEIILKKLLNPRKEKADLFKCNFCGHTCHADKQAALNIARFSLLPYRSESEKKKGITAISKLEEEYQQRLNDGIFQRGSLIL

SEQ ID NO: 61828 - protein, 1472 aa, Unknown
  Microbial source - Accession No. Ga0272448_1000167
MAHQAAVTQRAYTLRLRGEDPQDRSWRDALWATHEAVNKGAKAFGDWLLTLRGGLDHALADAKVEGGKGKPDRDPTDEERKGRRILLALSWLSVESEKGAPEEYLVPHDLDKQSGARSNWKTVDALREILKGRGLGESEIESWVQDCSASLTAAIRDDAVWVNRSKAFDDLCPRFRGLDRDYAAKTISFFFGNQGTYLALPNRDNDEDATTAVQSGDSSDFRERARQWVSTNFGTGTKSDNARICSALHTLATSNLMSFDGCSKADFLKHLATLLGRSEPNKEPEEVLRIAIGWTTGRPSAGLLAIKSLPDPVTANDIDTLQRKFADEKAKKEEKADLLRVPEWIRTFRETVERECGIPYVGKRDHIGEYSVMLDHAARRVSIVHSWIKRAEAERRRFDEDAKRMANVPEPAKNWLETFCLERSGASGARDQYRIRRRAVDGWEEVVAAWSKADCKTAEDRIAAARALQDDPEIQKFGDIQLFEALADDDALCVWHKDGDSAKAPDPQPLIDYVLASDAESKKGRFKVPAYRHPDALLHPVFCDFGKSRWDIKFDVHEARKSTARKKEGATQNSDPHALSMTLWTGSTFKSQKLRWQSKRLTHDLALGQGKQDHRAPEVARADRLGRAAAGVPASATVRIAGIFEQKDWNGRLQAPRARLNAIAARVARHGWDDKAKRMRARLRWLITFSARLQPSGPWVEYTATFPDDASAKPFVSRKGDYAVRHQGNDAREGHAKLVLSRLPGLRVLSVDLGHRYAAACAVWETLAKEVFEKERHDAEAKGAHVVLGPEGCKPEEAIYAHFVWPEKESNAATKKARQEGREKFHPVTVYRRIGPDELVDTSTGEVKEHPAPWARLDRQFLIKLQGEDHEARKASPAEVEAVQELERAVGREPPDQRSLRVDDLMSETVRTVRLALQRHGRRARIAFNLTASKRLLPGGREEVLTDEGRVGLLADTLADWYALFAGKGWNDEWARQQWETYVTPLLQGAALPQIPEDAEATPKARKKYRADLTENLKPAAESLAQNEPLRMKLHCLWATRWSKDDIALRKCLRWLRDWILPRGKKVKEKAGRAIRHVGGLSLTRIATIKSLYQVQKAFHMRPEPEDLRKNAPSKGDDALLDFGRSILDVMEHLREQRVKQLASRIVEAALGIGIERQVGKKTPKRPRQRLYWKDEKGNEHGDRRFAPCHAVVIENLTHYRPDETRTRRENRQLMSWSSSKVKKYLAEACQLNGLHLREVQAGYTSRQDSRTGAPGVRCQDVPVKEFMRSPFWRKQVAQAEKKQAGDKGDARERLLCDLNAEWKGKPEADWEKAGTVRVPLKGGEIFVSARPCSCCKHGKRGGAPGLQADLNAAANIGLKALTDPDWPGKWWYVPCDPTNFKPARDKVAGSAAICLDKPLKNAPAAQDTEGPRKKRDEAGARSRGVVYLWRDVSSRPISANDAWREFTPYWNDVQARVVNILQQLAKNQGVR

SEQ ID NO: 61829 - protein, 1470 aa, Unknown
  Microbial source - Accession No. Ga0272448_1002516
MVKQAAVTQRAYTLRLRGVDPQDQSWRDALWATHEAVNKGAKAFGDWLLTLRGGLDHALADAKVKGGKGKPDRDPTDEERKGRRILLALSWLSVESEKGAPEEYLVPHDLDKQSGTRSNWKTVDALREILRGRRLDESEIESWVRDCSASLSAAIRDDAVWVNRSKAFDDAVESVSSSLTRDEVWDMLERFFGSREAYLAPAKGAEDESAEVEQEDKAKDLVQKAGQWLSSRFGTGKGADFSRMATVYKEIANWAGKAQPGMTGDKAIADLAGALSEFSPTSNDLRGVLSLISGPGYKSATRNFLSQLATRTVVAESDLQSLQKSAKHDAQKCTANTGAKGQRPYSRVVLEQVESACGFTYLQDGGPARHSEFAVMLDHAARRVSLAHTWLKRAEAERRRFEEDAGRMGNVPASVKQWLDSFCADRSEASGALEPYRIRRRAVDGWKEVVAAWSKADCKTAEDRIAAARALQDDPEIQKFGDIQLFEVLADDEALCVWHKDGDSAKAPDPQPLIDYVLATDAEFKKRQFKVPAYRHPDALLHPVFCDFGNSRWDISFAVHEAGKSTVRKKKGQWQNSDPHALSMTLWTGSTVEPRRLRWQSKRLTRDLAFKEGKQNGNAPTVGRADRLGRAAAGVPEHGAVSIAGIFELEDWNGRLQAPRAQLNAIAARVARHDWDAKAKQMRDHLRWLITFSAKLQPSGPWLEYAAAFPDDAPAKPFVSRKGDYAVRHQGNDAREGHAKLILSRLPGLRVLSVDLGHRYAAACAVWETLSAKQVKAACQAAGHEPPKDSDVYLHLTKKVKKQKKGKEVEVEETTIYRRIGADTLPDGKPHPAPWARLDRQFLIKLQGEEEGAREASNQEIWAVHQMETVLGLSVPFIDRLIAAGWGCTEKQKSRLEELKKIGWTPAPKAESSGVQKENEEVDVCKPSLAVDELMSGAVRTVRLALQRHGRRARIAFNLTASKKLLSGGREEGLTDEGRVELLADTLADWYALFTGKGWTDEWARQQWETHVTPLLQGAALPKIPEDAEAAPKARKEYRADLTEHLKPVAETLAKDESLCARLHCLWATRWRENDVALRKRLRWLRDWILPRGRKAEADRAIRRVGGLSLTRIATIKSLYQVQKAFHMRPEPEDLRKNIPSKGDDALLDFGRSILDVMEHLREQRVKQLASRIAEAALGIGRMKRFAGGKDPKRPRERVDRPCHAVVIENLTHYRPDETRTRRENRQLMSWSSSKVKKYLAEACQLNGLHLREVSASYTSRQDSRTGAPGVRCQDVPVKEFMQSPFWRKQVAQAEKKQAKGKGDARERFLCDLNAKWKGRPEADWEKAGAVRVPLKGGEIFVSADEKSPAAKGLQADLNAAANIGLRALTDPDWPGKWWYVPCDPTNFKPAKDKVAGSPAICLDKPLKDTDGKAGARSREVVNLWRDVSSQPISANDDWREFTPYWNDAEARVVNILRQSAGLARDQGER

SEQ ID NO: 61830 - protein, 347 aa, Unknown
  Microbial source - Accession No. Ga0272448_1011735
METVKLCVKAVIPPRDIGLRRLMREYNVYKRVLIPRVKQTVRQVIKDKSITVYAQQKWMVDKKLNEYLKNLPFHPMPFHNQSVQLENKDGRFWIHFKTKEGETVCYLHVPAKYRDVIQKACGEDNPVLGQVELIEDRRYGWVNCHITLRLPKPEPYEPKGWIGVDVGWNKLATSIACTCNPHLKFFNPTFHGKEFKTRIIQLRHLLKQYAIKGKAWKKWNFRLQHTVKNAVGTVAKEIVSKAKRFKAGVAMENLTFKPVTKGYVVPRYKLMIAVKTLCEREGVPFKLVPAQYTSITCPKCSFKDEKNRDDEWFKCQKCGFQTDADLAGAMNIALKALTDAQMEGVMA

SEQ ID NO: 61831 - protein, 401 aa, Unknown
  Microbial source - Accession No. Ga0272448_1059621
MEEKLKLCVRAVIPPKDLGLRRLMREYSVYKKVLIPRVKQAVRQVVKDKNIAVYAQQKWMLDKKLNEYLKNLPFHPMPFHNQSVWLQNKDGRFWIHFKTKQGETVCYLHVPAKYHELIEKACGKDNPVLGQVELIEDQKYGWVNCHITLRLPKPKPYEPKGWVGVDVGWNKLATSIACTCNPHLRFFNPTFHGKEFKSQIIQLRHLLKEFQRKDKSVKKWENRLRNTIKYAVGVVAKETVSKAKKLKLGVAMEKLTFKSTTKGYLVPRYKLMVAIKTLCEREGIPFKLVPAQYTSITCPKCGFKDYRNRNGERFRCLKCGYQADADVVGAMNITQKAFDCSPDGGENDVGFTPASKADRGLPREAGHVASPQAPMNDDPYKARRKPNKIENEVRKEGLSRL

SEQ ID NO: 61832 - protein, 474 aa, Unknown
  Microbial source - Accession No. Ga0272448_1067731
MDKGEKELAEQPRHTKVLKLHILKPSGDMTWKELLELLREARYRVFRLANLAVSEAYLNFHQKRISPDFNSKRQTIGQLNRALREMLEQEGKKNNDRFSKNGALPDTVASALSRYRLHPLTSKKKWSEVLRGNISLPTFRRDMAIPVRCDKPGQKRLEKTNDGQVEVDLMICTHPYPRVVLATQDKSLGDGARTILAHLLENKDQSKNGYRQRYFEIKEDKLSHKWFLLVSYDFPASTPSLSKERIVGVDLGISCPLYVAINNGYARLGWRQFHALAARIRAIQNQTIRRRREILRGGNTIISDDRARSGHGLKRKLLPIEKLQGRIDRAYTTINHQFSSAVIKFAKDHGAGMIQIEKLDGLKEILSGTFLGERWRYSELQQFIKYKAKENGIEVKEVNPQYTSQRCSQCGYINEQFTFNYRQEQRQKLGKPVPFTCPECKYEANADYNAARNLATLDIEQLIMRQLDKQGIKN

SEQ ID NO: 61833 - protein, 401 aa, Unknown
  Microbial source - Accession No. Ga0272449_10022361
MASTVETDTIKLCVRATISPKDSGIRRLMREYTTYKKILIPRVQQAVRQVVKDRSITVYAQQKWMADKKINEYLKNLPFHPMPFHNQSVYIENKEGKFWVHFKTKVGEAVCYLHVPVKYHDLIEKACGDDYISNPVLGQVELIEDRKYGWINCHIVLRLPKPKPYEPKGWVGVDVGWNKLATSIACTNNPVKFFDPTFHGKEFKTRIIQLRRLLKEFQRKDKSVKKWEHRLQNTVKYAVGVTAKEIVAKAKKHKMGVAMESLTFRSVTKGYLVPRYKLMVAIRTLCEREGVPFKLVPAQFTSVTCPYCRHRDHENRDGERFKCLNCGYQADADLVGAMNVALTAAQMEGRLVWSLLPYLKGTAGLPAVQGDVATPLRGMSDDLYKATRKPEKIESEVSREG

SEQ ID NO: 61834 - protein, 427 aa, Unknown
  Microbial source - Accession No. Ga0272449_1004365
MRRVNVYRVIADRALLLLLRIIADRCARLWNTAQYICRQRFLAGEKVPSYARLCSLLKEHEAYRALPSDIAQEVLKMVRESWNSFFKNRKNYRAGKIPEPPGLPGYCKDRRTGHRLIRCIPIKCTRSYSIHGSEFSMTAPSDLSSDRLRMRVRGCTRWNGKPGRAELLWDAARNVWYLHQSVKVNAPTRRPRRRRWAAVDRGARIPLALAIEGVPEVLVFRARELWKDFLYWSRQIAGLQSRLRTRGMHASRELRRMYARRRERLLAAYRGLARTVVDILKRHGVTDLIVGDLTGIRENMDFGPLNELVHNFWSFAELLRILKDACERAGIRVHEKPEGGTSSHCVLCGEDAARPIRSRVLCRNGHELHADINGALNLLYREPEVRARVEGRPGWRTLRWNGHRWVPIESACRVPSPAATSRLPPGG

SEQ ID NO: 61835 - protein, 1399 aa, Unknown
  Microbial source - Accession No. Ga0272449_1006528
MSNKITNQKSIWSEFTKQYALNKTLRFELKPVGRTEDFLRQNKVFEKDKTIDDSYNQAKFYFDKLHQKFINESLSSNNARAIDLKYFAEKFLELKSEIQKLKSEKKQKEANNKEKEINNLRKAYYKEIKSLLDKKAEEWKEIYKKKEIKFSKTDLKQKGTDFLMKSGILGILKYEFPKEKEEEFKSKDWPSLFVEDKANPGNKVYIFDSFDDFTTYLLKFQETRKNLYKNDGTSTAVATRVISNFEKFLNNKKIFEDKYINYWKQVGITEEEKKIFEIDYYYSCFTQEGIDEYNKIIGQINQKTKQYRDKNKIEKSELPLFKVLDKQILGEVIKERELIAETETETEEEVFIKRFKEFIDQNKQRIPRVQNLMNDLINEKFESEYAGIYLKRSAINTIANRWFKNTTEFLLKLPQASKYKENKESPKVKSFVSLLDIKNALDEFEKERESLGAIFKDKYYKIKESDELPLDNDSQESYWKQFLKIWGYEFNQLFEDKFNEEGIKTFWGYTKDLEKEAENLNSFSRKKEEITVVKNYCDASLRIYQMMKYFALEAKKQEDIPSDFSTEFYNRFDEYYKDFEFVRYYNAIRNFVTKKPSNKDKIKINFESGELLRGWDISKIKGCLGIILIKNNEYYLGVVKKGKDKLFDYYENKNDTEKDIQRKNNLKKEIIAKPNEYYYIRVKYKQIADAGKDIYNLVLMPDGNVERFTDKEKKEKYWPEEIKRIKKEGSFKNNKRDLVKFIDYFKKCASIYWKEFNLEFKSSEEYENFKEFTDSINIQGYKISLDEENENKIKSEYIEKQVNEGNLYLFKIINKDFYKNKKQNSKKNIHTLYWEYLFSKDNLIKNEYPLIRLSGGAEIFYRKSFNIKKEPVVLKKDSIEKQVLRENKPIFHLNRYLEDKYLFHCPIKLNSLYTEVPNNEKQKRSFAAKYNKKLVEFLSKNVNEINIIGIDRGEKNLLYYTVINQQGEILDHGSLNEINGVNYLEKLIEREKERQINRQSWEPVVKIKDLKRGYLSYVVRKIADLVEKYNAIIVLEDLNMRFKQVRGGIERSIYQQFEKQLIDKLGYLVFKDDRDSDAPGGVLNGYQLVAPFTTFKDLGKQTGIIFYTNAEYTSKTDPITGYRKNIYNISNSASQKTIKENLINKLKALGWDEKEKSYFFTYNQKDFNSKDFNSPISKEWTLYSKVPRVRREKNNSTGYWEYKPIDLNKEFEDLFKKYEINEKSRDILSKIKELIKNNEEKLIQKQEFDGKNKNFYERFIYLFNLLLEARNTISLQVKLDKRGNEIKLDEIDYGVDFFASPVKPFFTTAGVRFVGKQIEGGKIQKEKKEEFAIKNFADFEKLFKGCSSDGFDSDGVGAYNIARKGIMILEKIKQNPKNPDLYILKEDWDDFAIKNALVK

SEQ ID NO: 61836 - protein, 359 aa, Unknown
  Microbial source - Accession No. Ga0272449_1019852
MKVSSQYRTVIVRLYPTEQQEKLLLKAEKEVLKFLETSRFELQKMLYHKIGEEVGISRRSLALLVQRFTGSLGEKAILPFDDNARFVNDNRIWFLEVQLFAGKGNRVRIPLAKTKVPYYSVLDELDGLPIVITRENSDWFAYVSIPVSQASNDLVVGVDFNYRKWLASPYEGKPLFFEVEDYATKIDRLQRMASRFQSRREEEKVREYHRLIRETVKLAHGNFLSRIRERFGVCTIAMEDVEKMYKMIEEIDSKTTNNWLNTKTALRQFILRAMAKGFEVVEVDPKDTSRTCHKCGNPVKIYGKHSRLVSCGFCDYRDYNRDLNAARNIARRGIELLSVMKGTCSITQILKTELHQLHQ

SEQ ID NO: 61837 - protein, 374 aa, Unknown
  Microbial source - Accession No. Ga0302046_10000852
MEVRKTYKYRLYRSKRDKHLAEQIELASEIWNHSVALSRRYYSLYRKHLGYYQLKRHLAKLKKRDKGRWYGLNSQAGQNVIERLRMSYQRFFSDPKAGRPGFKKRTKYPSFTLTQTGWKYLGGNRLRIGKHNFKFVLSRPLGGEVKTVTIKRDRCGDLWVCFSVVEDIQPSIPQTGSAVGVDFGLKEFLVESDGERVESPQHLRASLTEMARRGRDLSRKKKGSNNRRKARRRVAKLHRRIANQRRDFHFKTARTVLERHDFIAVEDLNLDGMKRLWGRKVFDLGFYQFVGILEHLAAMNGKRVVKVDRFFASSKTCHDCGWVKRDLTLADREWACEGCGSVHERDENAAKNIRDRALSHVVGDVRPAERAIAA

SEQ ID NO: 61838 - protein, 1088 aa, Unknown
  Microbial source - Accession No. Ga0302192_10026063
KVGGKGSRPYANAVLQDVEAASGITYHNACNGPSHHWQYAVILDHAARRVSMAHSWIKRAEEERSKFEIEKDKLQCVPSDARAWLDAYCARRSSESGAIDAYRIRRSAVDGWKQVVAEWAALLAKAKNAGSELPSEAESARIQAARELQDTIEKFGDIQLFEALSLPDAKCVWLTNGKPDAQPLMDYVAGTDAVSKKQRFKVPAYRHPDAFLHPVFCDFGNSRWSIDYAVHRAPEKLARAQQLLEKKKEELTRAEQALSKASDPSKRSSIEKKLKTLNVAFKQQEAEVLWLESHHAMTMGLWNGSRIEDTPLLWQSKRFGSDIGQAGAEHPLVASRADRFGRAVAMAKDNAPVVPSGLFDLADWNGRLQAPRRQLDAIAAIHDRTDLSVEEKRQLVAKRIRTIRWLVTFSAKLQSRGPFIAYAAQHGFDWRYGAHGIENKSREGLAKLVLCRLPGLRILSVDLGHRYAAACAVWETLSAAQMQNACLEAGMEAPSQRTLYLHLKHFVNGKEKKTIYRRIGAETLPDGSPHPASWARLDRQFLIKLQGEDRDARQATCDEVVAVEQLETELGYVRPIKRKGREHLVDELMSDALRTLRLGLQRHGARARIAFNLTATKRTRPGGIQELLDQESRIGLLTETLLEWNELYAGERWADELARDMWNKHIQPLLGGTILQETNNQDVTPSAAKRRMQREETREKLRPVAKQIAENDSLCRQLNVLWSTRWQIEDAAWRMRLRWMRRWLLPRGINRDPQFRKSIRDVGGLSLIRIASFKSLYQVQKAYWMRPHPDDLRRNIPERGDSSLTSFGQRVLDAMERMRENRVKQLASRIAEAALGIGDETSVNAKNGRRKRPTERSNDPRFAPCHAVVIEDLTHYRPDETQTRRENRQLMSWSSSKVKKYLGEACQLNGLYLREVPPAYTSRQDSRTGAPGLRCNDVAVPEFNSSRFWRKQVEAAEKNQKDGKKGDARERYLLSIDERIRSEANDRDVFRIPVKGGEIFVSACGQDGGSNANRKAPPGLQADLNAAANIGLRAIFDPDWEGRWWYIPCDATTICPVEKKFNGCKAVDSSKPLRIVAEKVAVSSSGID

SEQ ID NO: 61839 - protein, 1473 aa, Unknown
  Microbial source - Accession No. Ga0302246_1000265
MPQQAKPPVTQRAYTLRLRGAGPSDISWRKALWQTHEAVNKGAKAFGDWLLTLRGGLDHTLADAKVKGEKGNPDRDPTDEKRKARRILLALSWLSVESKLGAPAGFIIASGTEAAEDRNGKVVAALEEILKSRNLAENEIDEWKNDCSASLTAAIRDDAVWVNRSRAFDDAVESVGCSLTREEAWDMLERFFGSRDAYLAPAKVTEDESSEEEQEEKAKDLVQKAGQWLSSRFGTGKGADFSRMAAVYGKIAAWADNAQAGTTGNQAINKLAADLSEFTPASNDLQGVLGLISGPGYKSATRNLLNGLATKTTVTQQDFGSLRDKAADDAQKCKQNTGSKGQRPYSDAILKDVEAVCGFTYLQQDGGAARHSEFAVILDHAARRVSLAHTWIKRAEAERRRFEEDTQRLANVPGPVKAWLDSFCSERSATSGALEPYRIRRRAVDGWKEVVTAWSKSSCSTSADRIAAARALQDDPEIDKFGDIQLFEALAEDDAVCVWHKDGDAAKAPDPQSLIDYALAAEAEFKKRHFKVPAYRHPDALLHPIFCDFGKSRWDICFDVHKNVQTPFPRALCLTLWTGSGMVSVPLCWQSKRLARDLAIGSNATNAGYVEVARADRLGRAASNVTKSDEVKISGLFEQADWNGRLQAPRQQLEAIAVVRDNLSLSAQERERRMSSMKDRIRWLVTFSAKLQPQGPWCEFAKTNQLRIDPQYWPHADSNKTRKGQARLILSRLPGLRVLSVDLGHRYAAACAVWEAVNAEQVKKACQVAGHEAPKASDLYLHLKRKATKRKKGNQVVVEETTIYRRIGADTLPDGTQHPAPWARLDRQFLIKLQGEEEGVREASNEEVLKVYHLEAELGRTAPIIDRLVKAGWGQSGKQRTRLEALRELGWKPASEAVVSDGMGADEGEVRKPSLSVDELMSSAVRTMRLALKRHGDRARIAHYLITDEKTRPGGVKEKLNENGRIDLLQDALLMWHDLFSSRGWRDDVARQLWDNHVAKLSGYKAPEEIGEESSGPERKKRQKENREKLHDVAKALAQDVTLREALHDAWKKRWKDDDERWKKQLRWFKDWVLPRGKHASDPAIRKVGGLSLPRLATLTEFRRKVQVGFFTRLQPDGTRAETKEQFGQSALDALEHLREQRVKQLASRIAEAALGIGRMRRPMGGKDPKRPNGRVDEPCHAIVIEDLTHYRPEETRTRRENRQLMTWSSSKVKKYLAEACQLHGLHLREVSASYTSRQDSRTGAPGIRCQDVPVKEFMRLPFWRKQIAQTEKKQAEGKGDARERFLCYLNAKWKGKSEADWEKAGVIRVPVRGGEIFVSASRDSQGAKSLQADLNAAANIGLRALTDPDWPGKWWYVPCDPASFRPIKDKVEGSAAVKPDQALRQSAQAQSGDAAKDKKKRGNKSAGKSKEVINLWRNISSSPLECIEFGEWKEYAAYQNEVQCRVIRILEEQIKGRDKQLHEGAKEDDISF

SEQ ID NO: 61840 - protein, 1536 aa, Unknown
  Microbial source - Accession No. Ga030221_1001844
MPDQTNPPLTQRAYTLRLKGAQKDDTSWRCALWQTHEAVNKGARVFGDWLLTLRGGLDHTLADASLKSGQEKPDSTLTDEERKARRILLALSWLSVESKTGAPENFIVASGQDSEKNRADCVISALKEILESRKVDKNELDAWINDCSASLSSAIRDDAVWVNRSKAFDEAVKSIGPSLTREEVWDILGCFFGSREAYLAPGQSSDEDESSEAEQEDKAKDLVQKAGQWLSSRFGTGKGANFSHMSKVYEKISGWADSAQAEMTSKEAINDLAAALSEFAPASNDSAGVLALIKGPGYKSATRNLLSLIALQTTVTQEDLTKLKELAAKDKVECATKIGAKGHRAYSDKILEDVESACGFTYLQQSEEESARHSEFAVMLDHAARRVSLAHTWIKRAEAERKKFEKDSKKINCLPEAVRTWFDNFCIDRSELSGALEPYRIRRRAIDGWEKVVAEWSKPSCGNCADRITAARMLQDDPDIGKFGDIQLFEALAEDDALCVWHKNGNINEASDPQLLIDYAAATEADFKKRKFKVPAYRHPDALLHPVFCDFGNSRWDIDFSIKKAFNDLDKQKALLNKKEEEIIRAEQKLNIKNSKDVESQKKLQQEKEKLKKIQQKIAWLEEKNGVEMALLNNGKIGKMALRWQSKRLTRDLALDQSDNDCGVSHDVSRADRLGRAASNATGGKVNILEIFNQDYWNGRLQAPRQQLQDIAAVRDNPSLQAAERERRMSIMKDRIQWIVTFSAKLRPKGPWCEFAELNQLNIDPKYYPHAKENRGRKGMAKLILCRLPGLRILSVDLGHRYAAACAVWEAVSADDVKLSCACAGHEEPNERELYLHLKEKKSVEQKNGGKTETEQTIIYRRIASDTLPDGTPHPAPWARLERQFLIRLQGEDEIVREASNEEIFNVHRAEAELGRTVPLIDRLDKAGWGKSRKQKERLDGLRKLGWERVSDGTAQDVPDTGEDYWAKPSLSVDELMSSALRTLCIALKRHSDRARIASAMTAEYKTMPGGRKYYFTGPRELSASDDKSTIDNKHIEFIQDALVLWDGLMTSRGWRDDAAKQLWNNHIAKLSGYKAPEEISDESSKTERKNKQKENREKLRGAAAALVSDTNLREALHAAWKKIWEDDDELWKKRLRWFKDWILPRGKAAKDPAIRKVGGLSLARIATLTEFRRKVQVGFFTRLHPDGTKTEITEQFGQSALDALDRLREQRVKQLASRIAEAALGVGRVPRTKGGKTPKRPSARVDEPCHAIVIEDLSNYRPEETRTRRENRQLMSWSSSKVKKYLSEACQLYGLHLREVSAGYTSRQDSRTGAPGIRCQDVPLTEFILSPFWRKQVAQAEGKGDARDVLIRDLNHMLEDKSASDGEKPKVLRIPLKGGELFVSADKKSPASKGLQADLNAAANIGLRALTDPDWPGRWWYIPCEPGSFRPVKDRVEGSAAVDPNRALRQDAQPQGSDAAADKKKRAKKSTGKSQEKEIINLWRDISSSRPDDTAAGKWQTYDEYQNRVQYRVVDILREQANERKKRTSSRCDKP

SEQ ID NO: 61841 - protein, 1503 aa, Unknown
  Microbial source - Accession No. Ga0302253_1002416
MPQQDKPPVTQRAYTLRLRGTDPSDTSWRDVLWRTHEAVNKGAKEFGDWLLTLRGGLDHTLADTKVKGGKGKPDRDPTDEERKARRILLALSWLSVESKLGAPAGLIIASGKETTEDRNGRVVAALEEILKSRGAEDKIDEWKNDCSASLSAAIRDDAVWVNRSKAFDEAVKSVGCSLTREEVWDMLERFFGSRDAYLAPAKGSEDESSQTEQEDKAKDLVQKAGQWLSSRFGTGKGADFSRMAGVYQKIADWAGAHSPNNAGTGAIAGLASALSEFTPASNDLNGVLGLISGPGYKSATRNLLTQIDAKTTVTQADLTKLNETAAADKGKCETNTGSKGRRPYSDAILKDVESVCGLTYRVDENGNAVSVSNYSLYGDEYNWGSARHSEFAVILDHAARRVSLAHTWIKRAEAERSKFEEDAKKVDQVSKAAKDWLDKFCLERSGMSGALEPYRIRRRAVDGWKEVVAAWSKSSCSTSADRIATARALQDDPEIDKFGDIQLFEALAEDDAVCVWHKDGDAAKAPDPQPLIDYALAAEAEFKKRHFKVPAYRHPVALLHPIFCDFGKSRWDICFDVHKNVQTPFPRALCLTLWTGSEMKPVPLCWQSKRLACDLALGNNERNAGASAVTRADRLGRAASNVTKNDEVNIAGLFEQADWNGRLQAPRQQFEAIAAVRDNLSLSAKEREQRMSGMKDRIRWLVTFSARLQPQGPWCDFAETNQLRIDPQYWPHADANKTRKGQARLILSRLPGLRVLSVDLGHRYAAACAVWEALSAEKVKEACHAAGRKEPTENDLYLHLKKKVKKQKKAKAVEVEETTVYRRIGADTLLGGTQHPAPWARLDRQFLIKLQGEEEGVREASNEEVWKVYQLEAELGRTSPIIDRLVKAGWGQSNKQQTRLDALRELGWKPASGAGVSDGTDEDEAEVRKPSLSIDELMSSAVRTMRLALKRHGDRARIAFAMTAEYKPMPGDRKYYFTEAKELSANDDQATRDNKHIEFIQDALVLWHGLASSRGWRDDAAKQLWDDHVAKLSGYKAPEEIGEDASGVERKKKQKENRERLHDVAKALAEDTTLRKTLHDAWETRWEDDDEQWRKQLRWFKDWILPRGKAVDDPAIRKVGGLSLTRLATLTEFRRKVQVGFFTRLHPDGTRAETKEQFGQSALDALEHLREQRVKQLASRIAEAALGIGRMRRPMGGKDPKRPDVRIDEPCQAIVIEDLTHYRPEETRTRRENRQLMTWSSSKVKKYLAEACQLHGLHLREVSASYTSRQDSRTGTPGIRCQDVPVKEFMRSPFWRKQIAQAERKQAEGKGDSRERFLCDLNVMWKDKAVADWEKAGVARVPLKGGEIFVSADPASPAAKGLQADLNAAANIGLRALTDPDWPGKWWYVPCEPGSFSPVKDKVEGSAAVKPDQALRQPAPAQSSDAKDKKKRGKKGAGKSKEVVNLWRDISSSPLECIEFGEWKEYAAYQNEVQCRVVRVLEEEIKGRDKQPHDGAKEDDILF

SEQ ID NO: 61842 - protein, 1042 aa, Unknown
  Microbial source - Accession No. Ga0307340_100872
QQSEEESARHSEFAVMLDHAARRVSLAHTWIKRAEAERNKFEKDSKKINCLPEAVRTWFDNFCIDRSELSGALEPYRIRRRAIDGWEKVVAEWSKPSCGNCADRITAARMLQDDPDIGKFGDIQLFEALAEDDALCVWHKNGNINEASDPQLLIDYAAATEADFKKRKFKVPAYRHPDALLHPVFCDFGNSRWDIDFSIKKAFNDLDKQKALLNKKEEEIIRAKQKLNIKNSKDVESQKKLQQEKEKLKKIQQKIAWLEEKNGVEMALLNNGKIGKMALRWQSKRLTRDLALDQSDNDCGVSHDVSRADRLGRAASNATGGKVNILEIFNQDYWNGRLQAPRQQLQDIAAVRDNPSLQAAERERRMSIMKDRIQWIVTFSAKLRPKGPWCEFAELNQLNIDPKYYPHAKENRGRKGMAKLILCRLPGLRILSVDLGHRYAAACAVWEAVSADDVKLSCACAGHEEPNERELYLHLKEKKSVEQKNGGKTETEQTIIYRRIASDTLPDGTPHPAPWARLERQFLIRLQGEDEIVREASNEEIFNVHRAEAELGRTVPLIDRLDKAGWGKSRKQKERLDGLRKLGWERVSDGTAQDVPDTGEDYWAKPSLSVDELMSSALRTLCIALKRHSDRARIASAMTAEYKTMPGGRKYYFTGPRELSASDDKSTIDNKHIEFIQDALVLWHGLMTSRGWRDDVAKQLWNNHIAKLSGYKAPEEISDESSKTERKNKQKENREKLRGAAAALVSDTNLREALHAAWKKRWEEDDEMWRKRLRWFKDWILPRGKAAKDPAIRKVGGLSLARIATLTEFRRKVQVGFFTRLHPDGTKTEITEQFGQSALDALDRLREQRVKQLASRIAEAALGVGRVPRTKGGKTPKRPSARVDEPCHAIVIEDLTNYRPEETRTRRENRQLMSWSSSKVKKYLSEACQLYGLHLREVSAGYTSRQDSRTGAPGIRCQDVPLTEFILSPFWRKQVAQAEGKGDARDVLIRDLNHMLEDKSASDGEKPKVLRIPLKGGELFVSADKKSPASKGLQADLNAAAN

SEQ ID NO: 61843 - protein, 550 aa, Unknown
  Microbial source - Accession No. Ga0308310_1004946
LGDVLTKQTTRVIVPLVGFEARLLNIKSTHVAVHAKLEFLSNEDKREVLDLMRRFSSAYRWIYKRIVEGGNPAELKRAFGPMDKFGLNSRYKDSAVQLALVKLRTMESLGVNPKKVIFGSRRLFERLCRKGDLKSRAKAKRKWRERRKGVLKGLGSKADISGNVNLTPLLINGELWLRINIKTGTNPESGKKESRYVYAKVKTSHPYLSHILEVVGKRGAVPISVHLKLIDGKVYAIFTKKIDLPEPVLTKYYGVLGVDINARPLHLALAVVEPDGNLRKYTTISLEEVIRIRERYKGKSSNVLDNFYWLVAHQVVDLAKNEGVAIAIEDISNLPKGFRGDGNKKLRRILHRFAYRSILERIVRVASREGVEVWGVNPAYTSVIGMLKYAPMYSLSKDVAAAYVIGRRALGFSEKVPKRYLQLMASPEYRGSVINWFNQELSALEKRIGGERNEYKLNRLRKEKESLEKAFNWLNRFLSPGGSPEGLQRGLTYGRNPEEPKGDSLHLWKALQVGVLRPLLGQKVPRDLSVLKPLLVGGVWKCGKVEEGYT

SEQ ID NO: 61844 - protein, 552 aa, Unknown
  Microbial source - Accession No. Ga0308310_1013800
LGDVLTKETTRVIVPLVGFEAKLLNIKSTHVAVHAKLEFLSNEDKREVLDLMRRFSSAYRWIYNRLVEGGNPSEIIQVSGPVSRFGLNSYYYLSARELALYKISSLEAKGVNPRKIIFGTRTLFNRLCRKGSLKSRAEAKRVWRERRKGILLNFGNKKSVSGNYALTLSLINRELWLKINMGTSKNPKSGKKKSRYIYAKVKTSHPYLNHIMEVVGRSGIAPISVYLKLIDGKVYAIFTKKIDLPEPVLTRYYGVLGVDINARPLHLALAVVEPDGNLRKYTTISLEEVIRIRERYKEESSKVLDNFYWQVAHQVVDLAKNEGVAIAIENIFNLPKGFRGDGNKKLRRILGRFAYRSILERIVRVASREGVEVWGVNPAYTSVIGMLKYAPMHSLSKDVAAAYVIGRRALGFSEKVPKRYLQLMASPEYREAVINWFNQELRALEEKMGGERNEYKLNRLRREKESLEKAFNHLNRFLSLEGSPEGLQRGLTCGRNPEEPNKGDSLHLWKALQVGVLRPLLGQKVPRDLSVLKPLLIGGVWKGGGGLHLGPS

SEQ ID NO: 61845 - protein, 556 aa, Unknown
  Microbial source - Accession No. Ga0308411_10001123
MAFGRMAGPTIVYRYGAKKPTTNAEAMLEQLRKAHQYRNKLVELELQRRKLVEDAVKSIESEVRQMADKIEQLELDIDYVARKISSHKQKNRTRTVPTELKEQLKALKAQRRETLRQMREAKKAAYTRPETQEALSRIEGKARAEHKKARSLCGLYWGTYCHVEQIISQIRKGPPPKFRRFDGSGVLAVQLQKGEDIARLESGEDRRIRIEGYGKRRILWLRIGSDENHNPIWATIPFTYHREIPHNAKIKWVKVKAKRIACQIDWEVLFTLERSSGWKKPDLAQDGAVAIDIGWRNFDDRIRVAYWVGSDGFEGEIALPSNMVSKALEQVEHLRSLRDKNFNEIKQQLLDAIGALQIPEWLTEATKTLHQWRSQGRLASLTIRWRQQRFEGDNDIFNLLETWRVRDKHLYEWEAHLRMKAIRRRDDYFANVAADLSRRYKTAIVEDFDLRNVTQIDPTQTEQIGDGRQRYRARIAAAGNLRQMIKNRFAETQIVSAALTTQTCTECGEIMNFDAAESVFGKCPHCGHAFDQDRAAAINLMRRYEGKLVAASGEVR

SEQ ID NO: 61846 - protein, 1193 aa, Unknown
  Microbial source - Accession No. Ga0308411_10021369
DKNEVKMFNDIKARMRHHISKALTAHEGFSKLNKDDLFKKKKNANESLLENFLNQNEKVRNKLNELLRDNEGDRVDLFELLRAFENFTTYFRNFHENRQNLYSPEDKFSTIPHRLIHENLPRFCDNIKIYNQAKAAGLNMNDIEKELRLNNNSLDEIFSIKYFTKTLTQSGIDFYNYIIGGGAIQSGSQNIKGINNFINNDINQNVNNSSGRIPIMKTLYKLPLFERTSYSFRYEPIENDKDLIERIKNFYYEDLKNHRDVDDNENNQVNVISAIKSLIENIHDYREGLYVNGGITLTQISQKIFGSWHYIRDVLSEYYDKSIVPVKLDKKRTKAEEKAKEKWLKQKQFSVKIIEDALCAYKKEKETNEEIIKKITETTICDFFKLAGADDNGSNNLFERIESKLTIKNEYDESLADLLGKEFQNERNLMQDKPRTLLIKNFLDTLQGYKDDITAGLLHFIKSLLPSEEISDKNELFYSEFEKYYNILKEVTPLYNKVRNYLTQKPYSVEKVKLNFENNTLLAGWDENKEADNSCVLLRKNNNYYLGIMKKEFNNVFKKDKYLIANDNEPCYEKMIYKLLPGANKMLPKVFFADRNINEFNPSEEILRIRNTASFSKNGTPQEGFNKAQFNLEDCRKLIDFYKKCISNHCDWKNFNFQFSDTDSYQSIDEFYREVEQQGYKVNFVKIPDRYINQLVDEGQLFLFKIYNKDFSDKKKTNGKPNLHTLYWKMLFDENNLKNVRFKLNGEAEIFFRPKSINYTDEIWEKGHHYDKLKDKFNFPIISNKRYALDKFHFHVPITINFKSNNQENINEIVNNYLKNSDKYNIIGIDRGERNLLYVTVINLKGEIIEQFSLNEISTNYRDKCFSKDYHEELDKRESQRDRARKDWQTIEGIRNLKEGFLSHVIHKISQLVIKYNGVVVMEDLNFGFKRGRQKVEKQVYQNFEKMLINKLNYLVFKDKEPDEPGGVLNGYQLVNKFKTFKELGKQSGIVFYVPAAYTSSIDPLTGYVQYLFPIKHANSVEKARNFYSKFKSIYYNPEKEWFEFVFDYIDFNIRFEGKSDWKICTANTERYVWNKNLNSGRGGQEKINVTEGLKLLFREYNILYCDGKNLRELISEVRSINNENTDKKFYNRLNYLLNATLKLRHNNGKQGAEEKDYILSPVKPFFDSRSANKTLPKNADANGAYNIARKGL

SEQ ID NO: 61847 - protein, 1261 aa, Unknown
  Microbial source - Accession No. Ga0308414_1002480
MNFDEFTNLYSISKTLRFELKPVGKTLDWITKNKLVEEDEKRAEDYKTVKKIIDRYHKEFIEEAFESALNANSFQRDMKDLIESYSELYYKEDKSDKDKKELENISSQMRQEIVSCFEGNYSDEVKKKFSNLFKKELIKQDLLNFCQPSEKEVIEKFADFTTYFGGFHENRKNMYSSEEKSTAISHRIVHENLPRFLDNLKVFNSLKEEYQDFPWNQLEFNLKNIDPSLKLEDYFSKKGFILTFTQKGIDRYNLILGGKSLDSGQKVQGLNELINLYRQKKCLDRRKIPNLKELYKQILSDRVKFSFIPEKFLSDNSLLEAIRNFHEEVINAKIEIDSKQVNFLEALKNTIQGIKAHKLEKIYISNDLGLTNISNFLYGEWSKIKSALFYYYDEKIADKGKGDKQSKKYQEGREKWIKKDYYSVQKLNEAITLYSKYSEDGFEATPLEEYFSKFKTRDENRAELDILSNIEQSYSELKPLLEKEYLKNKNLKSDKYNIEKIKNYMDSIKILQNFLKPLTPKKILEEKDLGFYNEFETYVESLQSFNRLYNKVRNYLTEKEYSVEKFKLNFENSTLLNGWDENKESANLGIILRDEDKYYLGIMNKNYKKIFSNIPKLKSSEAYYEKMVYKLLPGANKMLPKVFFAKSNIGFFQPSQKILDIKNSESFKKGDNFNLKDCHELIDFYKESISKHEDWSKFNFHFSETSSYQDISEFFREVEAQGYKITFNQVSKDYIHSLVEYGKLYLFQIYSKDFSEKKKSNGKPNLHTIYFKALFDEENLKDVVVKLNGEAEVFYRKKSINYDPEIREKGHHYEELKDKFTYPIIKDKRYAEDKFHFHFPITLNFKPKERSNFNLEVRKFLKASKDVNIIGIDRGERHLLYLVMINQEGKILKQLSLNTIQNEKQAVNYKEILQKREIARNQARKSWRTVENIKELKEGYLSQVVHKISKMMVEHKAIVVLEDLNLGFKRGRQKVERQVYQKFEKMLIDKLNFLVLKDRKNNEPGGILKAYQLTDKFVSFENIGKQTGFLFYVPAWNTSKIDPKTGFVNFLHLKYENVQQAKDLIGKFDSIRYNKQKDWFEFQVTTDKFFTKENLPESRTWTICSTPTTRYYTEKTTNSSIVTNEINVNEKLKELLSEFHFEDGKELKEKILQKDTKDFFSKLIFYLRVLTSLRQNNGKIGDQEKDFILSPVADSKGNFFNSLEAKDDEPNDADANGAYHIALKGLMNLQVLKQTQEENLDKPNWKIKNTDWLHFVWNRQN

SEQ ID NO: 61848 - protein, 427 aa, Unknown
  Microbial source - Accession No. Ga0308414_1007395
MNQRILTKRETQQRHKQMICKSYELKIDKSHLSKELANHLRQLFLEAKWFTNYAIANGIFEVDYKIKTVQIKVKDTFEERQIKHLSSQMKQAIIDKLKQDVKNLSILKNNGHKVGKIKFKRFVKTIPLKQFGVTYAICDKNHVRIQGIGKKVRVRGIKQIPTGAEFSNAYLIQDHGDYYLRGITYQNPENTVPKENSKNNAVGIDFGLRNQITLSNGISIQYRIPVITKKLRRLYKKFTRTQKGSNNRLKLNFKIQKQFAKSNNIKKDIKNKIVHCIRENFSIVCFQNDDIRQWQRIWGSKILDTAIGKFKDILKKRIPISIAVDKTFPSTYLCSHCGTINEISLAEEIYKCPVCGFTMHRDLKAARDIFSEGLKQLLMEHREAALLYQGRYACGEETSTRMLEYLNSIPYIRASFLYETGSLTASA

SEQ ID NO: 61849 - protein, 1024 aa, Unknown
  Microbial source - Accession No. Ga0308414_1018540
MDKQVAATQRAYTLRLQGADPRDQSWREALWQTHEAVNKGARAFGDWLLTLRGGLDHTLADAKVKGRKGKPARDPTDEERRDRRILLALSWLSVESAPKDGDTHKPFVTATGQDSQAIREEKVLCALRGILEKRGVRGADLEGWIKDCTPSLSAAIRDDAVWVNRSEAFDKAVDSIGSSLTRDEVWDMLERFFGSRQAYLAPAEGAEDESAEAEQEDKAKDLVQKAGQWLSSRFGTGKGADFSRMAAVYEKIADWAGKARAGMTGDAAVAGLAAALSEFSPASNDLQGVLRLISGPGYKSATRNLLNKLRARPSVAQEDLENLRDSACDDAEKCKAKTGSKGQRAYADAILKEVESVCGFTYLQEGGPARHSEFAVMLDHAARRVSLAHTWIKRAEAERRRFEEDARRMDKLPARVKQWLDAFCFERSEASGAMEPYRIRRRAVDGWKELVAAWSNADCKTAEDRIAAARALQDDPEIEKFGDIQLFEALAHDEALCVWHKDGDLAKSPDPQPLIDYVLATDAEFKKRQFKVPAYRHPDALLHPVFCDFGNSRWDISFDVHEAVKTGGRNRKNMMPPQDPHALSMTLWTGSTVEPQRLRWQSKRLARDLALKGRQGSNAPEVTRADRLGRAAAGVPERATVSIAGVFEQEDWNGRLQAPRAQLDAIAARVARHGWDDKARQMRDHLRWLITFSAKLQPSGPWLDYAAAFPDDAPAKSFVSRKGGYAVRHQDNDAREGHAKLVLSRLPGLRVLSVDLGHRYAAACAVWETLSAEQLKAACRAAGQEPPKDSDLYLHLKKKVKKQKKGREVEVEETTIYRRIGADTLPDGKPHPAPWARLDRQFLIKLQGEDTEARKASPAELQAVQRVEKEVGRVPPDQRALRVDDLMSETVRTVRLALQRHGRRARIAFNLTAGTKLLPGGREEVLTAEERVRLLADTLADWYDLFTGNGWSDQWARQQWETHITPLLKGAALPQMPHDAEDIAKSLAGNESLRRQLHCLWATRWRDYDVTLQKCLRRLRDWIL

SEQ ID NO: 61850 - protein, 683 aa, Unknown
  Microbial source - Accession No. Ga0308415_1006042
MLTRARTRVKKITKTILKLELKGDPNSMKFLDNLFNEYEQLVRIADTFIYHLYPYYANINEQEKFEGLNKLIRSIERKAIIKRRKDKKRETDDDFVYQQLPYLFAWLEGKISKESRYIYSHSDLLKTLLYTFIKYAKQYYGIDVKYVLLEKQGGLADLMHSNAENAYKHRSIPNMRRRLINVIPIRVSKRPLPENRRNKDKRNDDKPYERDTAFIFENGKIMFRIGRGKHKVVFKIATRFNDDERLSMFIKAIKGNDGLTIGDPCYLVRKDTDNGYRYYIMVSISKNVDVKALYEAIKNKSKIRIVGIDSNISKYITTMFCIEVDKENKTYKLVNAKGINSKDYINAVKKYEEDKRKLQQGRMKGKKQKKKKDSRYKEKEDYTIRNRCGDSKRIDIRRQLIGYICNQILEFANENYADIIVIEDLKGLNKELKTLRIIKKELGKLYNDVNTKGNNAIDDKINESKKYKNKIRKPLLGILNKIKEYSNAKDKVKVAKYILKQRQIIERRIFLLSMMAYYQFKQELDVEALWNGKLLYIINPKYTSQQCLRCGHTNKLNRITQRQFKCIKCNFEMNADFNASANIALRFATKVLKLELNLKQVEQGESSSMMTITKTNATTPLHASINAGSKLGVVADTLSSVASILQGCDEGRSPYLGGQTDEPCSVKSIATLDEFLEKKGNGG

SEQ ID NO: 61851 - protein, 1229 aa, Unknown
  Microbial source - Accession No. Ga0308419_1006240
IRKDAVWVNRSKAFDNAVKSIPYFSREEIWDLLHRFFVSQKKYLAPLDSPTEDKPDTTKKNSSKRLIKSARNWLSNRFGTGKGADFERSAAVYEAISRWASEAKPNKTNVLIDDLAKALQKFGVKTRDIKGISNVLKKSGRKSKTRSLLLQLSAKPNIEDKDLQRLKDTAEKDSKKERSKIGVKGHRDYASEILKAVEAACGFTYLQEGDRAKHREFAVMLDHAARRVSSLHTWIKQAEAERRRFEIDTKKKDQLPASVKQWLDTYCQKRSEETGAVEPYRIRRGAIEGWKEIVEAWSKPAITTSEERIQEARRLQDNPEIDKFGDVKLFEDLAREDALPVWHANGDPDKPPDPQLLIDYVEASEAEFKKRAYKVPAYCHPDPFLHPVFCDYGCSRWNISFTIHKEKAPDDPHGLSLDVWDGRAIRSVALRWQSKRFVRDLALNPKRSSDKPKVTRADRFGRALAECPSSDEVCIRGLFEDEDWNGRLQAPRPELTALAKHVAKYGWDEKANKLRNRLNWFITFSAKLRPSGPWEEYTKYAGGKHASPNKRGTMAKLRLSRLPELRVLSVDLGHRYAAACAVWETLSKAAFEQEIRERQILRGGTGPNDLFCHTRHVTDGQAKVTIYRRIGADTLPDGTLHPAPWARLDRQFLIKLPGEEREARKASPTELAQVEKLEKGLGRKTPDNRVKRIDDLMSDTLRTVRLALQRHNRRAQIAFKLTTTKRHLPGGRVESLGEQDRVTLLCETLKMWHSLFMGDDWTDDWAKTLWDEHIVPLLPPFDNQKADDLKWLKPAAEELASNPTKTQELHILWASRWQEDEQLWKERLRWLRHWILPRGIQTSAQKASIRHVGGLSLTRLATIKTLYQVLKAYHMRPEPDNPRKNIPAEGDEALQNFGQKILDDLEHMREQRVKQLASRIVEAALGLGRMKRATNKRDPKRPRERVDQSCHAVVIEDLTHYRPEERQTRRENRQLMNWSANRVKKYLGEGCELHGLHLIKVPASYTSRQDSRTGAPGIRCQEVPLIDFLKEPFWCKKVKCAKQRLSVGKANACDRYLCQLYERWENTPVTKAQTAIRLQIPLKGGELFVSADQNSPASKGIQADLNAAANIGLRAITDPDWSGAWWYVPCEANTFKPVKNKVAGSAAIDPNVPLKKDSPNSEKPASGQKHLVQRSRASKSIINLWCDISSKSISERDQWQESVPYWEDVAVRVIKILQASLVCSTTNSQ

SEQ ID NO: 61852 - protein, 488 aa, Unknown
  Microbial source - Accession No. Ga0308419_1011938
LQKAFKNYHLLYDRLLKVIYNELSSFYSAIAYSTKNGEARCSDKKAVQYINSQYRNVLNSFVLSSGLKESLCKDLADNLISYKELLAQRPNTSYPSLQKLKERVKERTLEELYESLKACIDTETYNHLRDAIARQSKENAKLKPLSFIRCDTTHQNMTFLYSPDRKKYYALLYVLPSSKKKLVIIKEDELYDVRTGQLFSRPKGTTTGLIFPIETGQRIVERYLNEKSQPKEGKLVYDSKNNEYYLHLAFEFKPEKIPTETIIGIDRGIEAICAYSVINMNYNLLESGLYEGKTLKELLKSEEKRMAEMQRRGVNYRFKVRRNWANRIIHEATNMIADIASKYKSQVYVEDLQGITDRTKARRKSSFNKMLNRSQFQKILMTLDYKLEGKGLPRAKKVHPAYTSMTCVQCGLIKPENRPKFDENGNPIQDKFKCVGCGYEDNADKNASRAIALKGIWTYIKKEDKIRQEIESFQSFLNKKLNKKVIAL

SEQ ID NO: 61853 - protein, 1476 aa, Unknown
  Microbial source - Accession No. Ga031036_000087
MAKQVAVTQRAYTLRLRGVDTQDQSWREALWLTHEMVNKGAKVFGDWLLTLRGGLDHTLADTKGKDGKEKHGCNPTDEERKARRILLALSWLSVESRLGAPEKFIIASGQDAAEERNGKVVAALEEILNSRGVEPNEINAWKINCSASLSAAIRDDAVWVNRSKAFDDAVKSIGCPLPRDKAWDMLGRFFESEDAYLAPLEGSEDESSDTEQEDKAKDLVKKAGEWLSNRFGKGKGADFSRMADVYGKIAAWAGNAQAGTTGNNAINELATALSEFTPASNDLQGVLGLISGPGYKSKTRNLLTQLAQTPVVTQDNLKDLNKRAAADTKKCKEKIGSKGQQPYANAILKEVESVCGFTYLQNGGTARHCEFAVMLDHAARRVSLVHTWIKRAEAERRRFEKDLQMLGQVPSAVKEWLDKYCEERSNSSGALEPYRIRRRAVDGWEKVVAAWSKTGCKTPEDRITAARVLQDDPAIDKFGDIQLFEALAEDDAVCVWHKDGDPNREPDPQPLIDYVRATEANFKKQQFKVPAYRHPDAFLHPVFCDFGKSRWDIEFAIHEARKVKATKSALRRKNRQCFDSSRELFMTLWTGNEMKRVPMGWQSKRLARDLALGQNTPNDGAPEVPRADRLGRAASNVTKSNEVKIAGLFEEAEWNGRLQAPRRQLEAIARRVDKHQWDAKAKKMRDQLHWLITFSPKLRPTGPWFEYAATFPDNALAKPSVSRKGTFFVKYRDNERPRKGGLILSRLPGLRLLSVDLGHRYAAACAVWETLSKEKFEGEIKGRKVRYSDSETGGLFCHTEHGNNAVTIYRRIGADMLPDGTPHPAPWARLDRQFLIKLQGEEEETRAASNQEIWAVHQLEAELGRTSPIIDRLVKAGWGQSGQQRTRLDVLCKLGWKPISEDRVSDGTDEGEYEVRKPSLSVDELMFSAVRTMRLALKRHGDRARIAFAMTAEYKPMPGDRKYYFTEAKDLSTNDDQVAREHKQIEFIQDALVLWHGLFSSRGWQDDAARKLWDDHVAKLSGYNAPEEIREDASGVERKKKQKENREKLYSVAKALAGDATLRKALHDAWKTRWKEDDERWKRQIRWFKDWILPRGKASNDPAIRKVGGLSLTRLATLTEFRRKVQVGFFTRLHPDGTKAETKEHLGQSVLDTLEHLREQRVKQLASRIAEAALGIGSENRKKHWDGRKRARERIKDPRFIPCHAIVIENLTYYRPEETRTRRENRQLMSWSSSKVKKYLAEACQLHGLHLREVSAGYTSRQDSRTGAPGIRCQDVSIKEFMQLPFWRKEVARAEKKRAEGKGDARECFLCELNAQWKDKSKAAWGEAGIVRIPLKGGEIFVSADKNSPAAKGLQADLNAAANIGLKALADPDWPGKWWFVPCNSTTFEPLKDKVGGFAAIRLNESLKKAPASWEGEETKKKRSRDVVNLWRDVSSQPISASDDWREFTPYWNGVQTRVVNILRQSAGPIMNHGER

SEQ ID NO: 61854 - protein, 457 aa, Unknown
  Microbial source - Accession No. Ga031038_009337
MAKRKRDKNAVVKTLKLELVDVLNYEPPPKKDGEEYTEKEKKRMFRKELRNLQKRIAQTSNYIMREYFLWELKRIEASKNGIILNEKEELGTTLQNKGYRIATETLKGLNTRNISALTSWLWENWRKYKKKVFNGSMSLPSYGLKQPIHIIKENYKIMPYKNNNEYIVEITFLSPSEGRNRTLKFVTVRQDKYRQNIINKILSGEYRQGSAQLILENNPNKNLSAQKIFFHFNYEFVPQVKEELSDKILGLDLGLKNVVVMQVYDPQQGKFEDLDENECMIDGTELVIYKNKIEALRKKANKATKWKGQGNTGHGRKKRTKNALNIGHKIKNSKSTYNYKLAKYIIDFALKYQCKYIKMEKLTRHGFSDTLLQNWAFNDLQNKIKNKAKENGIEVLFVEPQYTSQQCSKCGYIDKENRETRDNFKCKKCGFEIDADINAARNIALSEKIIKEDDDDE

SEQ ID NO: 61855 - protein, 457 aa, Unknown
  Microbial source - Accession No. Ga031046_00181
MAKRKKEKRTIIKTLKLELVDVLNYQPPISTDEKEYTKKEKERMLKKELRDLQKRIAQTSNYIMREYFLWELRKNAASKNGIVLNEKEELGTTLQNKGYRIAAETLKGLNTSNISALTSWLWENWKKARKRVLNGSISLPSYGNKQPIHINGKNYKIIAYKNNNEYIIEITFLSPSEKRNRTLKFVTAKQDKYHQDIMNKILNGEYRQGSAQLILEDNPNKNLSAQKIFFHFNYEFIPKQKEEISDRILGIDLGLKNVIAMQVYDPQHQQFISLDNNECVIDGLELVIYRNKIEALRNKISKATKWKGKGNVGHGYKKRNKNVLNIRKKISNFRKTYNYKLAKYIIDFALKYQCKYIKMEKLTRHGFSDTLLQNWTFNDLQNKIKNKAKENGIEVLFVEPQYTSQQCSKCGYIDKENRETRDNFKCKKCGFEIDADINAARNIALSEKIIKEDDDDE

SEQ ID NO: 61856 - protein, 672 aa, Unknown
  Microbial source - Accession No. Ga0310828_1006812
KHGFSYYHKGINYELKGTLGGARIQFDRDHLLRRQGVKAGNVGRIFLNVTLNIEPMQPFSRSGNLQTSVGKALKVYVDGYPKVVNFKPKELTEHIKESEKNTLTLGVESLPTGLRVMSVDLGQRQAAAISIFEVVSEKPDDNKLFYPVKDTDLFAVHRTSFNIKLPGEKRTERRMLEQQKRDQAIRDLSRKLKFLKNVLNMQKLEKTDEREKRVNRWIKDREREEENPVYVQEFEMIRKVLYSPHSVWVDQLKSIHRKLEEQLGKEISKWRQSISQGRQGVYGISLRNIEDIEKTRRLLFRWSMRPDNPGEVKQLQPGERFAIDQQNHLNHLKDDRIKKLANQIVMTALGYRYDGKRKKWIAKHPACQLVLFEDLSRYAFYDERSRLENRNLMRWSRREIPKQVAQIGGLYGLLVGEVGAQYSSRFHAKSGAPGIRCRVVKEHELYITEGDQKVRNQKFLDSLVENNIIEPDDARRLEPGDLIRDQGGDKFATLDERGELVITHADINAAQNLQKRFWTRTHGLYRISCESREIKDAVVLVPSDKDQKEKMENLFGIGYLQPFKQENDVYKWVKGEKIKGKKTSSQSDDKELVSEILQEASVMADELKGNRKTLFRDPSGYVFPKDRWYTGGRYFGTLEHLLKRKLAERRLSDGGSFKRGLSNGTDSDSNVE

SEQ ID NO: 61857 - protein, 1215 aa, Unknown
  Microbial source - Accession No. Ga0311022_13670299
VLLVYTGGQGLPLHAGNRKLCFEKFHNQEIASLAAMSFKGAVLHVSSENRKEMDMTQQNRPSVTQRAYTLRLYGANSEDASWRKALWLTHEAVNNGAKTFGDWLLTLRGGLDHTLADAKVKGAKGKPDRDPSIEERKKRRILLALSWLSVESKRGAPAAYIIATGREITENRNSKVVAAFEEILKSRGLTDTEIAEWRSDCTASLSATIRDDAVWVNRSKAFDDAAKSVGRSLTREQLWDMLDPFFGSRDAYLAPTKSSEDDSLEEEQGEKAKDLVQKAGKWLSSRFGTGEGADFSRIADVYEKITAWADAFQVGKTTTGDEAIKNLAAALSEFKPVSNDLTGVLRLISGPGYKSATRNHLNSLFGKKRINQEDIQILKTKAANDAQQCRQNTGSKGYRPYANAILKDVEDACGFTYRTDKDNKDVSVSDYSKFEDGYRWGPARHSEFAVMLDHAARRVSLAHTWIKRAEVERRRFEDDALKREQVPENVKKWLDDFCWKRSEASGALESYRIRRRAVDGWKNIVGAWSKAECRTMEDRITAARALQDDPDIEKFGDIQLFEALAEDDAVCVWYKDGDPAKEPEPQNLIDYALAAEADYKKRQFKVPAYRHPDALLHPVFCDFGESRWDISFSVHQQERNKSKLNNKKMITQGSPLRGLSLTLLTNIGIKPVLLCWQSKRLARDLALVSNADKGHVVNVSRADRLGRAASAVTENDTVAIESIFEEKKWNGRLQAPRRQLEAIAAVQNNSRFSAEERARRIQRMRERIRWVVTFSARLQPQGPWCEYAEKHRFKPDPRYWPHAEINKNRKGYARLILSRLPGLRVLSVDLGHRYAAACVVWEAVDAAHIKEACRAAGRESPNESDLYLHLKTKGQDGKERITIYRRIGADALPGNTPHPASWARLDRQFLIKLQGEEEGAREASNEEIWAVHRLESGLGRVAPLIDKLIAAGWGGTDKQKARLEALKQLGWSDRTAAASAGAGAEADEESGGIVPSLAVDELMSSAVRTMRLGLKRHGDRARIAFYLVTEEKTMPGGVKNKLDEQGKIDLITDALILWHDLFSSRGWCDDAAKKLWDDYIAKLSVYRALEEGDKDDSGSERRKQKDENRRKLYNVAEALLQDTDLQQRLHNAWKKRWEEDDEWWKRQLRWFRDWLLPRGKHTRAPGIRKAGGLSLIRIATLTEFRRKVQVGFFTRLRPDGTREEIKEQFGQSTLD

SEQ ID NO: 61858 - protein, 347 aa, Unknown
  Microbial source - Accession No. Ga0315269_0011078
METIKICVRGVISPRDMGLRKLMREYDVYKKVLIPRVKQTVRGIIKDKSLAVYSQQKWMIDKKLNEYLKNLSFHPMPFHNQSVYIESKDGKFWIHFRTKQGNVVCHLQVPMKYKSLIEKACGEDFADNPILGQVELIDDKKYGWINCHITLRLPKPEPYEPKGWIGVDIGWNKLATSILATKNPHLCFSSPIFHGKEFKTRIIQLRRLIKEYSRKGKSWKKWNFRLKNTIKYAVGVVAKEIVFKAKKFNAGISMEKLTFKSTTKGYLVPRYKLMIAIKTLSEREGVPFKLVSPQYTSITCPKCNYKDEKNRDKQWFKCQKCGYQTDADLVGAMNIALRALTASQMEG

SEQ ID NO: 61859 - protein, 371 aa, Unknown
  Microbial source - Accession No. Ga0315269_0014929
VARVETAYRTVILRLYPTPKQARMLKRAEAEVFKFLEVSRYQLMKLIYHKAGEAGVGVGRYSLSLLAQRFTGSLGNKAIIPLNTAYNARFIRENGVWFLEAQLLKGRGNRVKIPVAKTENKYYAAIGELGDLPLYVTREDDKWFAYVSIPVNAENNGRVIGVDFNLRKWVAAPAEGGPVLFFDASWYCREIDRLQRMRARLQSKGDLEGVQAACKGMVDAVTLAHGNFLARIQEKFGVCVIGMESVETLYKLTEKDNTMINNWLYSKTALRQFALRAMGKGFEVVEVDPRYTTRTCHRCGAPVKINGRRGRSITCPSCGLTNYHRDLNAARNIAKKAAEEWSKRVESRRRMEKLQPIAVAANGGGEEAAEK

SEQ ID NO: 61860 - protein, 439 aa, Unknown
  Microbial source - Accession No. Ga0315269_0030078
MENTIKMCVKAVIPPRDAGLRKLMHEYSVYKRILIPKVQRAVRQVVKDKSIAVYAQQKWMMDKKVNEYLKNLPFHPMPFHNQSFYIEDKDGKFWIHFKTKQGEAVCYLRVPARDHDLIEEACGNDYASNPILGQAELIEDRRFGWVKCHITLRLPKPEPYTPKGWVGVDIGWNKLATSILATTNPHIRFIKPAVHGKDFKTRIIQLKHLLKQYARRGNAWKKWDYRLKDSIKYAVGVVAKEIVAKAKKHKAGVAMEKLTFKSTTKGYLVPRYKLMMAVKTLCERSGVPFKLVSPKNTSLLCPKCENKQSRSWAEENGKDEKEQRKLFQTRIRKNREKARFRCIDCGYQADADIVGAMNIAQKALDSFPYEGENDVGFTPTSKADRGLPRKAGHVASPQAPMTDDPYKARRKPNKIENEVRNRLKWALNGHRTDLTQRLQ

SEQ ID NO: 61861 - protein, 796 aa, Unknown
  Microbial source - Accession No. Ga0315277_10001015
MATKSFEARVLCRDDPPDKKGEKYSAEQKKQFLWYTHQVFNESIRKVLPYVFKMKRGELGDEFQAIYYAISSSQDAVGKLEAITSLDWSSKKIGKSEPEKWKEILRYRELEKEFRQKLKDEEKNTKKFRKELQKKKKALANEIGQKDIWADAASIIQQKNNLLFDREKILPNLPSEFRRKIFEMCIQLIHGHQELVANWQDEHAEWLQEKDKFEEEHPDYMKVRPILEEFEKEAGKVKGSRIRWLKYLDYMSSHPELAGWRGGEAKVEPLTSAERAKFRKPREHFEAFFKKNPELSALDSIHKQYQEKFARTQTKRTPNPDGFKHRPTFTLPSANLHPAWYSFKGATDPTKGATYKLNFREDRRVDSFMNLKVLTDMEGEGRNPKGMITYDFEPDDRIRDFRYIGTTEKGKKAKGFVYYDKILEKERPAKIQGIKLVFRPPRSDGVPYLIFSCSIEDEKSKIKIWQDKESEEGPDEARKGKKAKKIYPPELVTLAIDFGQRHLGAITICKNNNGKPEQIKFIPAYPKRKQGKQTKPVSAWLAKVPGLTFNAIGMHEKEIRAGMHQRFQDPKSIRQAGEKEGRASKPRHIPETETSFAHLRDHIAGMKEDHYKKAANLIIKTALQNGAQVILLEDLKKYRPMLEKESRENRRRMQWAVRQTAEFLKKTAKPLGLLIYDRINPAYTSSMCSVCGNPGARISLPSKRNWEKYYAEYYGKERRMIAVVGGQFFCCPVCKKIINADINASQNMHKVFYNTFNWPPKMEKKEKKIFWESVREQAQNILDQKAEPKREEDISY

SEQ ID NO: 61862 - protein, 478 aa, Unknown
  Microbial source - Accession No. Ga0315280_10009663
MEDLRMAKKTENRHIKVLKLRILKPAGEMTWADLGEILREARYRVFRLANLGVSEAYLNYHLWRSKRASDFKIRTMGELNRELRETLRNEGKNEDQLNRFSKTGALPATVTDALSQYKLRAVTKKSKWKEVINGKSSLPTFRLDMAIPVRCDKKDQRRLEKTASNEVELDLMISARPYPRVVLATQEGSLGEGARAILEKLLENENQSKAGYCQRCFEIKQDTLSRKWFLFITYDFPATEVLSSKDRIVGVDLGVSCPVYVAINNGYARLGRRQFNPLMARLRALQNQTIRRRREIQRGGNEIISEERARSGHGRKRKLMPIEKLQGRIDRAYTTLNHQMSAAVIKFAKNNGSGVIQMENLDGLKEELTGTYLGERWRYAELQHFIGYKAKEAGIEVRKIDPKYTSRRCSECGYIYIEFNRAFRNTEHEKGKAAKFRCPVCNYEADADYNAARNIATLDIENIIKLQLEKQRVNPGDH

SEQ ID NO: 61863 - protein, 383 aa, Unknown
  Microbial source - Accession No. Ga0315280_10032046
MENTLKLCVKAVISPRDMGLRTLQKEYANYKKVLIPKVQKAVRQVAKDRSIKVYAQQKWMLDRKITEYVKNLPFHPMTFHNQSVWLERMEKGHFRIHFKTKQEEKEAVCYLQVPSKYRDQIEKTCGKDNPVLGQVELIEDRKYGWINVHITLRLPKPESYEPKGWVGVDVGWNKLATSILTTVNPHLHFANPTVHGKDFKTRIIQLKYLLKQYARKGRSWKKWDFRLKQSVKYAVGTVAKEIVGKAEKHKAGISMENLTFQSQTKRWLIPRYKLMIAIKTLCERKGIPFKLVPPRNTSITCPKCGFADSGNRNGERFNCRKCGYKADADISAAMNIAAIAIGFMPLAKEVRLHAKTSGDVATPLSTDEPMTSIKAGANPTESK

SEQ ID NO: 61864 - protein, 446 aa, Unknown
  Microbial source - Accession No. Ga031528_10053614
METIKFCVKGIISPKDKALQILQKELKNYKNALIPKIQNAVRKVVKDRVFQVYAQQKWMLDKKITGYIKNLPFHPMTFHNQSVRLEKTEEGQFYIHFKTRQEEKEAVCHLQIPMKYRSQVEKACGEDNPVLGQVELIEDNKYGWINVHITLRLPKPEPYEPKGWIGVDVGFCKLATSILAVPYVEARSIGHISSPLKGVTESPSSEALSSIAFNQQHKADGNTPNQGYKNRLNTIIIKFSNPTIHGKDYKTRIIQLKYLLKDYARKGKGWKKWNFRLKQTVKYAVGTVAKEIIAKAEKHKAGVAMENLTFQSQTKRWLIPRYKLMVAIKTYCERKGIPFKTVPPRNTSITCPKCRYVDAENRDGERFTCRRCGYQADADISAAMNIAHLAIYEEVEHLNSRKSAIAIGFTPMVKEARLHAETSGDVATPLSTNEPMTFIRTGANPV

SEQ ID NO: 61865 - protein, 389 aa, Unknown
  Microbial source - Accession No. Ga0315282_10053614
VETIKFCVKAVISPKDKALQILQKELKNYKKMLIPKVQKAVRKVAKDRSINVYAQQKWMLDKKLTEYLKNLPFHPMTFHNQSVWLERTEKGYFLIHFKTKQEEKEAVCHLQVPSKYHSQIEKACGKDNPILGQVELIEDNKYGWINVHITLRLPKPEPYTPKGWVGVDVGWNKLAASILVTANPHLHFSNPTVHGKDFKTRIIQLKYLLKQYARKGRSWKKWDFRLKQTVKYAVGTVAKEITVKAEKHKAGVALENLTFQSQTKRWLIPRYKLMVAVKTLCERKGIPFKLVPPRNTSITCPKCGYIDAKNRNGERFNCKKCGYQADADITAAENIAAIAIGFMPVVKEVRLHAEASGDVATPLNTDETDDLIKGRCKPSKIENEVTVKG

SEQ ID NO: 61866 - protein, 488 aa, Unknown
  Microbial source - Accession No. Ga0315285_10079970
VSVLLTAKLKVHNPSARKRQILDRALEEYTRAYAELLQWAKDNLSTIEEKGRYNGRFTETAIRSVFPNPSAFNHYYLHSSARDALWVDVAGTLCSYFRLREQNPSTAFPSCRDPSPETYPNALDDFAAVLDDEQQEKDCRARLLKVARGSVMPMYFSRPDAVPRNRNFSLLHDPQRQRYYALLYLEPGANNSDGCLRGKGNLVRVGWPQGKNAGDPRPAFRARAPCAVLLPLALGDWHVETFLNTSLRGDANVRSAFLSRRERGGREPEYYVHITFEFSPERVQTETALGVDRGLANLIALTVTDEAGKILHQELHPGRDLIDYQKYVYTVYRSRQKRGRSVAGQAMVARVNEEVCHRLANVIVETAVEHKSQVVMEDLKWFKERRRDFGQLKRAPLQRIQQILEYKLPMRGLPRPWYVGSAYTSRECPLCGYGFQVKGRGINRPSQDRFKCERCGYQTHADLNGSHNVARRWLQRKAERARPSTLTA

SEQ ID NO: 61867 - protein, 473 aa, Unknown
  Microbial source - Accession No. Ga0315288_10142264
MTEKEIAKRHVKVLKLHILKPADGMTWPELGKILKEARYRVFRLANLAVSEYYLGFHLWRAKKTEQFSTRTIGELNRELREMLKEGKSAEELDLFSKTGALPDYVAGALSQYKLRAVTSKSKWKEVINGKAALPTFRLDMSIPVRCDKPNQRRLERAANDDVQVALMVCSKPYPKVVIATGEPSLGGGPREVLKRLLENKSQSKDGYCQRCFEIKQDRLSGKWFLFVTYDFPVTQIAVSKERVVGVDLGVSCPIYVAINNGHARLGYKQFSSLMARLRALQIQTITRRREIQRGGKTIVSDDRARSGHGRRRKLLPIEKLEGRIDRAYTTINHQLSAAVIKFAKNNGSGVIQIEDLKGLGQELSGTYLGERWRYAELERFIEYKAKEAGVEVRRVQPQYTSRRCSECGNINMEFTYEFRKAEKEKGNRLKFKCPKCNYEADPDYNAARNIATIDIESIIRLQLDKQDHQDVDL

SEQ ID NO: 61868 - protein, 636 aa, Unknown
  Microbial Source - Accession No. Ga0315298_1000517
MDGLRGQRTRLRVGSWRRSWDLRDVPDERKRTVHRTAHRLTIRAETAIRDDHACTKASYLRPTMGMKRREGESMFGNPSEPSCVYRYGAYAPTTNIEIVHEQMRIGSRYRNKLCEIELARRAERDAFLQEASGEVNAAEKALADICAEIDKIKTEIAEYRKRARKRKLPPELSARRKELFAARKAARQRRNAAKKAAYKSSEFKEGLHKIDVAAIEKIKQARAESGLYWGTYSHVEQSMKGTQKGPPPKFKSYRNGEGTIAVQVQHGLTVREAESCKDTRIRIEGTGRKRILHIRVGSNGRKPIWATVPFVYHRPLPEDALIKWVRVTSRRVACHFHWYVLFTVSRPSGWKKADLAPDGVVAMDIGWRLFRDRFRVAYWVGSDGQEGEICLPLEYLDRRDKKNDLRKIRDEKFNAIRDKLADWIEAKTDALPQWLKEDTTSLRQWKSQARLAGLVLRWSRQRFTGDEEIFPELEDWRSDDRHLYEWEVNQERKAIAWRNEQYRIIAAELSRRYRKAVIEDINLHELSDSEKATDSANNATRDGKVGDGKQAWRRMVASVGRLKQFIKERFDSTVEVKCEWTTQDCAYCGERMNVDAAHNVVIKCPSCGVEIDQDRNAALNLLKRAGVPLESILVCS

SEQ ID NO: 61869 - protein, 583 aa, Unknown
  Microbial source - Accession No. Ga0315298_1001941
MQEQIKTFFCEKCNKEKKIPRNLLGKADAVEKARERHYHKEHTLILGIKFKIYPEKKDLEKINEYFDEYAKAVNFAARLIDKLKGQFLFMGKRNKEDEERKYIFPIARCDFCGEEKEISYQNKRGKKICFSCYQNEFGENGIRKKLYATKGRKVNASYNIKNATNKLCATHYNYVIRDAFQLLDALKKQREKRISRLIRDKGKLKKFEEMLEQEDKRYELPKKERQREPRFIHISLKDRAQEFEGRGYTIKRIKEKIKVLRRNIEREEKSLNKKTPIEFSGKRITLSSSLKFNIEKSLVRIPLTKELTKDYKFGGMNVANEHGRKFFEEKLKLIKENKPKYSYLIRKQINKDPDKPFYDYYLQYTVEFLPEVKQNYKRVIGIDRGIDHLACLVLLENGKEKPSFVKFFSGKDILKLRNQRRKQLSFLIGVHNKKRKQKKIRPIEPKIHQILHTISKQIVMLSKQKEAAISLEQLEKPKKGKYKQSKSTKYKLGQFVFKALSDYIEYKAKKEGIRVIYVPPEMTSQICSHCAIKGKVHVDTKRPYKNSYKLFKCNKDGCGVELNADYNAAFNIAQKGLKILNSK

SEQ ID NO: 61870 - protein, 1470 aa, Unknown
  Microbial source - Accession No. Ga0315298_1005332
MPKQNKPPVTQRAYTLRLRGTDLNDQSWRDALWKTHEAINKGAKAFGDRLLTLRGGLDHSLVDTKVKGGKGNPDRDPTDEERKTRRILLALSWLSVESKLGAPENFIVASGEESAQDRNNKVIAALEEILKSRGVAENEIDQWKKDCSASLSAAIREDAVWVNRSKAFDCICGNEDKKKAREDAQTLLWFLLTDDYLAIPKKPVKASETTVLDDKKEETGDDSSGELIVKSGKGAGKRTRHPFSHIFGRETTKGFGNPLRTFNLRNFWRQYLKPKIEAAGIPLSDPNAKAKKKDPPSPTELHREMFSQAAARLAQIWTKQKQQELERVQRAAADDELKKLENDPAYNTVLKRLEMFCRERGQATGSLEEYRINPRAIEGWDRVVTAWENISETDNDRATEKRIEKAKDLKKDNPDKKFGDINLFIHLAEPEYEPVWRHNGQADPSILKTYVKGWKARTDAIRLKVAAFRHPDPYFHPVFCHFGVSRPPIKHNRLNKRSVDDTRIVQMLLWTECKAEYVQLLAISKRFDAEIGSAAESSRDASANVPEVARRSRLGVAAITKQGGGDTFCVANVFDQQEVRPRKGEDKDGTQEEGCNNESQDRKKKEPTWNGTLQADRLKLEAIGRLQSSEPQKALLAKQHLRWWLIVSLELQPTGPWYDYITVLSDKSPFLRTARKDEDKGEKRKQGAKYISWSGWPHDEVNKPLRKNKNGTGLEADPTSHRQSMAALILSRLPGLRVLSVDLGHRYAAACAVWEALSAEAFKKDIDGKKILRGGTDEKDLYCHTEHEADGKKHVTIYRRIGADKLPDGTPHPAPWARLDRQFLIKLQGEEEGVRQASNEEIWQVHQLEAALGRSKPLINRLISSGWGITKNQQSRIEALKKLGWCPPEQPESGDVSDADEEEIAYKPPLSVDELMSSAVRTMRLALKRHGDRARIAHYLITDEKTKPGGVKEKLDANGRTEMLQDALVLWHDLFSSRSWRDDAAKQLWDEHIIKLTGDKLPEEIGEDASESERGKKKKENREKLHDAAKALAQDESLRKTLHDLWKTRWEEDDRQWKKHLRWFSDWVLPRGKAAEDPAIRKVGGLSLTRLATLTEFRRKVQVGFFTRLHPDGTRAETKEQFGQSTLDALERMREQRVKQLASRIAEAALGIGSQDKRHWEGGNRPRRRINDPRFAPCHAVVIEDLTHYRPEETRTRRENRQLMTWSSSKVKKYLAEACQLYGLHFREIFAGYTSVQDSRTGAPGIRCQDVPVKEFMRSPFWRKQVKQAETKLLENKGDARERFLCSLNAMWKDKAVTDWERAGVVRLPLKGGEVFVSADPLSPAARGLQADLNAAANIGLRALTDSDWPGKWWYVPCESSSLRPVKEKVEGSAAVNPTQALPQSAQKQNDGAGAKKKRKGSGTGKPKEVVNLWRDVSSSPLDDPNAGEWKEYTAYQNEVQWRVVRILEEELKGRFQRLYEGAKEDGIPF

SEQ ID NO: 61871 - protein, 1362 aa, Unknown
  Microbial source - Accession No. Ga0315298_1007399
MTNNIKNQKSIWSEFIKQYALNKTLRFELKPVGRTEDFLKQNKVFEKDKTIDDSYNQAKFYFDKLHQKFINEALFSESVKSINLKDFAEKFLGLKSEIQKLKSEKKQEEANKKEKEVNDIRNDYYKKIKSLLDKKAEEWKKKYKDGGLKFRKTDLKQKGTDFLMKSGILGILKYEFPKEKEEEFKNKDWPSLFVEDKANPGNKVYIFDSFNATYLLKFQETRKNLYKDDGTSTAVATRVISNFEKFLNNRKIFEDKYINHWKEVGITEEEKKIFEIDYYYNCFIQEGINKYNDLIGQINQKTKQYRDKNKIEKSELPLFKVLDKQLLGEVIKERELITKTENETEEDVFVKRFKEFVDRNKQIIPRAENLMNDLINEKFESDYYGIYLKRAAINTIANRWFKNTTEFLLKLPQASKSKENKESPKVKPFISLLDIKNALDDFEKEKESLGTIFKDKYYKTKESDEAPLNNDSQESYWKQFLKIWNYEFNQLFEDKFKEKGIKVFLGYTEALKKQVENLKSFSRKKEEIVLVKNYCDAALRIYQMMKYFALEAKKQDDIPLDYATEFYNRFDEYYKDFKFIRYYDAIRNFVTKKPSNEDKIKLNFESGSLLTGFDKNKESEKLGVILRNRNSDKYFLGIINKEHNKIFDSKNESKFIGDDNKDLYEKMELKLFPDPKRMIPKIAFADKNKKDFGWTQEIQKIKKDFENFQKNKKDNKDLKFDKNKLSKLIEYYQNCLEKGNYKKEFDFEWKKPEEYQSMSEFNQDIEKKNYKIKFIPVKDSYIEEKVANGELYLFAISNKDFIWPDQKKNIHTLYFFNLFSDKNIQKPIFRLGANAEVFYRPASVKKELDKGRSKEGKEIIKYKRYTEDKIFLHLPIEINYGCPKVPNEEARKKAFAAKYNNKLIEFLSKNINKINIIGIDRGEKNLLYYTVINQKGEILAHKSLNEINGVNYLEKLIEREKKRQIDRQSWEPVVKIKDLKKGYLSYVVRKIADLVEKYNAIIVLEDLNFGFKQKRTKIERTIYQQFEKQLIDKLGYLVFKDDRGSESPGGVLSGYQLVAPFTNFKDLGKQTGIIFYTNAEYTSKTDPITGYRKNIYISNSASQKTIKENLINKLKSLGWDEKEKSYFFTYNQKDFGSPISKEWTLYSKVPRVRREKNNSNGYWDYQPIDLNEKFEDLFEKYGINKKSSDILSEIKELIKNNEEKLIQKQEFDGKSKKFYERFIYLFNLLLEARNTMSLKVKLDKRGNEIKLDEIDYGVDFFASPVKPFFTTAGIRFIGKQNEDKKIEKQIKEKFAEENFADFKGLFKDCSSDGFDSDGVGAYNIARKGIMILERVKQNPQKPDLYISKEDWDDFALKNAIIK

SEQ ID NO: 61872 - protein, 767 aa, Unknown
  Microbial source - Accession No. Ga0315298_1007594
MARTRYREERTLVRRLCRLPREEEERSEFNHKVLKLREQFKKFNLDASETCQWLMGIRPDGKRANERTKLFWDFFLEPEKFLKEEDKDKSDRCRRVVFDFVAGFEKDTALSEFSFSKELMDSIQAIKSMPRIPCAEKLFQRLVQLNPAHRQVLLKASSEWIFAHYQKAKDNWEFQHKHWEEEKKGWENRYPDLTDEIRKEFTEIFKQMDIREKRPRICPWERLKESKDNCLYAGEKIGKKNHAQLCKKYKDFLDDCKRNNVKKFFAENAEKYLSLKRNQPYLPKEIIIKEFLNKNPKAKWFTDAWDKYLKAMGITEQTILSRGSLPHCVEFGDDKECQFNQHTEKCRQYKALLDAKPELQALEGLYRKWREKYLSGPSKPSFKYPSAKKLSMPKIFGAGFFEVDFNKSILKLRLDDMPEGKFLEFGFIPWPKDYKPQPNETEITSCQVNFIGTRPRVGFRFKTPHKKSRFTISQDEIDELRSRKYPRQEQDQKFLDEARKRLLESFPQDPKKELKILAVDLGEKTGGAVLFKGTDFQKYFPLKVVKMKKLLEIRPEDEKDKNDKISKEEKKELRKKGLGKWHIALHLEARREQAKAIAEKRQKEKEKAELRNFDLRKLTLHTRWMIRDWVRLNASQIIQLAEQNQVDLIVFESMRGFSVPGREEIGKEDKKLAFLAAGQIRRKVAEKAVERGMRIITVPYLESSKHCSICKKLQKDEKIWRKNKLDEHKFRCEKCKAEMNSEENAARVLARVFWGEITLPGQLPDHT

SEQ ID NO: 61873 - protein, 1380 aa, Unknown
  Microbial source - Accession No. Ga0315298_1015991
MPETPAYTTRAYTLRLAGATPEDHAWRGRLWQTHEAVNKGARVFGEWLLTMRGGLDHTLADQQDPQQRRDHRVALALSWLSVESPAEAVASDLIVSRGKDPHEDRSQALEIALREILQQRGLSDADIDSWLVDCRATLGARIRDDAVWVNRSKAFDAITEQPRRPQARVDCQVLLWHLFTHDYLTLPRASLRRRQEQQAQREGADQDPDEGQGEDKRSAVVRSGRGAGTRTRHLFSHIFGGSPTFGKDKHKEKEKERVLALRGHWLAYLQPLVEGAGIPLRDPSQPRRANDGAVPTELHREMLSKAAARLAQIHTKQKQQEIEREQRERADEALRRLEDDPAYKEALALLEAYCDDRRAEWGDYTIRPRALEGWRDVVAAWALCGSEEERVDEVKRLQDEDPDRKFGDPNLFCELAQEKYVPVWRHCGKEDPDLLTRFVKGNAARADAKRLRVAAYRHPDPCFNPVFCQFGISRPAIKFARLGQLRKSKEPGSERSTAVSLLLWDGKAARTTILQALGARLDREIGTVDQQQPLDRDPTLVTRRTRQGFAVAAQESASGEGSRVIGVFDEQDIEKRRPEHDQAAAGKVARKAPEWNGTLQADRRALAAIGRAADAREAARAREQLQWWLTVSIELRPQGPWPTYADKHGIELDRGREGIVTLPTKKADEWRGLAYPCWVDDNKGRHGRDRLVLARLPGLRVLSVDLGHRAAASCAIWETLTRPQVEEICRACGHDAPGEGDIYLHLKRKVLKQDKGGSAREAEATTIYRRLAADTLPDGSPHPAPWARLDRWFTIRLQGEEAQARFATRAEQAAVRDFEKWLGWQAGNRRRSQRIDELVAHAVDLARRGLRRHADHARIAWGLAAPKKQLPGGRRPDGEMSREERVAHLQGVLLRWHDIAFSTQWKDDWAQELWNATLPDYQKPEPIAENASAKEKKAARERNLETLRPAATALAEDSARRLALHEAWKSRWAQDDGAPAQVDRQASGCKQSQGTGWHAHLRWLHDWLLPRGNKSRKRTLRQVGGLSLMRLGTIRDFHRKVQKAFFTRLRPDGTKAEAPESFGQRTLDDLAAMRENRIKQLASRIVEAALGVGSENPLHREGRRRPRQRIADPRFAPCHAVVIEYLANYRPHQSRMRRENRQLMDWSTGRFKQYLAEACALNGLHLREVSAAYTSQQDSRTGAPGIRCEQVVLREFLQSPFWRKKVSSAAKRAGNPFTQLWRDLVNRARKSSPADAATTVLYLPREGGRLFVSASPCLCCQPSSQGLAPINADLNAAANVGLRALSDPDWPGTWWYSPYNLTQSQPCLDKAKGSAAISAGSPPAAPAQATTQEKVINLWRDVSAKPITPENGQPYSRYWNGVQERVVARLRPALGLHHEP

SEQ ID NO: 61874 - protein, 847 aa, Unknown
  Microbial source - Accession No. Ga0315903_10087816
EVRKKYTPTCLADYFHTHFKAQKKTDSEKDYTLTANVEAKHSAIKGILNIPYPNDKKLYQQQKDIDNIKLFLDSVMELLHFVKPLSLNKDSALEKDNSFYGQFEVLFEQLDMLTPLYNKVRNYATQKAYSTEKIKLNFDNSTLLKGWDINKETDNTSVILRKDDQYYIAIMPQDYKKAFQSIPKAIDGESTFEKMDYKQIALPMGVGAFVRKCYGTAMQYGWVCPDDCKNEEGKIIIRQDEIKGNLAALIDCYKDFFDKYEKEGFQYKEYNFKFKDSAAYENLNQFFLEVEQQGYKISFREVAETYINQLVEEGKLYLFKIHSKDFSAHSKGKPNLHTLYWKALFEPENIKDVVYKLLGQAELFYRKASITSDKIIVHRAHEAIDNKNPEKKKATSTFAYDLVKDRRYTVDKFQFHVPITLNFKATGNNYINQDVLTYLQRNPEVNIIGLDRGERHLIYLTLINQRGEILKQLSLNDIINTYKDAAGNTVDVKTPYHTLLDTREKQRAEARENWGAIETIKELKEGYISQVVHIIAKMMVEHNAIVVMEDLNFGFKRGRFKVEKQVYQKLEKMLIEKLNYLVFKDKAPSETGGLYHALQLANKFTSFKEMGKQSGFLFYVPAWNTSKIDPTTGFVNLFDTRYESIEKTKSFFDKFKSICFNPIKNYFEFAFDYTDFTTKADDTKTNWTVCTHGDRIRTYRNPDKVNQWDNKPIQLTQEFEDLLGKYNITYGAGACLKAQIAEQKDKEFFASLLHLFKLTLQMRNSITNSEVDYLISPVANERTGLFYDSRKKNEKLPKDADANGAYHIAKKGLWWLEQIHELEGQEWKKLDLDKSNKGWLAYVQQSK

SEQ ID NO: 61875 - protein, 1000 aa, Unknown
  Microbial source - Accession No. Ga0334883_1024988
AAIRDDAVWVDRSKAFDEAAKSIGCSLTREEVWDMLKGFFGSHEAYLNPAKGSDEESSDTGQEEKAKDLVQKAGQWLSSRFGTGKGADFSRMVGVYQKVADWAGACPGNNAGTDAIANLAAALSEFTPISNDLQGVLGLISGPGYKSATRNLLTQIDAKTTVTQADLTKLKDTAATDKEKCEPKIGSKGQRPYSNAILKDVESVCGFTYRVDKDGQPVSVAHYSKYDDDCSWGSARHSEFAVILDHAARRVSLAHTWIKRAEAERRKFEEDAQKVDQVPKAAKDWLDQFCLERSGMSGALEPYRIRRRAVGGWKEVVAAWSKNSCTSYDDRIGVARALQHDPEIDKFGDIQLLEALAENDAVCVWHKDGDAAKAPDPQPLIDYALAAEAEFKKRHFKVPAYRHPDALLHPIFCDFGNSRWDIRFEIHENVQTSSPHALLLTLWTGSGMNSVQLCWRSKRLAHDLALGQNAQNAGVSEVARADRLGRAASNATKSDKVKIAGLFEQETWNGRLQAPRQQLEAIAKRVEKHGWDENAKKMRDRLQWLVTFSARLQPQGPWCEFAKTNQLRIDPQYWPHADANKTRKGQARIILSRLSGLRVLSVDLGHRYAAACAVWEAVNAEQVEKACQVVGHEAPKASDLYLHLKSKAMKRKKGNQVEVEETIVYRRIGADILPDGMPHPAPWARLDRQFLIKLQGEEEGVREASNKEIWAVHQMEADLGRPVSLIDHLVASGWGGSDKQRARLEGLKQLGWNPAEKFESGGESDLGEASDAYRPSLSVDELMSSAVRTMRLALKRHGDRARIAFAMTAACKPMPGDRKYYFTEAKELSMNDDQVTRSNKHVEFIQDALVLWHGLTSSRGWRDDAAKQLWNDHITRLSGYKAPEEIGEDTSAAERKKKQKENREKLHDVAKVLAEDATLRKVLHDAWKKRWKEDDERWKKELRWFKDWILPRGKAVDDPAIRKVGGLSLLRLATLTEFRRKVQVGFFTRLQPDGIRAETK

SEQ ID NO: 61876 - protein, 1490 aa, Unknown
  Microbial source - Accession No. Ga0334884_1015165
MPQQNKPPVTQRAYTLRLRGAAPNGQSWRDALWQTHEAVNKGAKAFGDWLLTLRGGLDHTLADTKVKGGKGKPDRDPTDEERKARRILLALSWLSVESRLGAPESLIIASGKEPTKDRNDKVVAALEKILKARRVEQNEINAWKNDCLASLSAAIRDDAVWVDRSKAFDEAAKSIGCSLTREEVWDMLKGFFGSHEAYLNPAKGSDEESSDTGQEEKAKDLVQKAGQWLSSRFGTGKGADFSRMVGVYQKVADWAGACPGNNAGTDAIANLAAALSEFTPISNDLQGVLGLISGPGYKSATRNLLTQIDAKTTVTQADLTKLKDTAATDKEKCEPKIGSKGQRPYSNAILKDVESVCGFTYRVDKDGQPVSVAHYSKYDDDCSWGSARHSEFAVILDHAARRVSLAHTWIKRAEAERRKFEEDAQKVDQVPKAAKDWLDQFCLERSGMSGALEPYRIRRRAVGGWKEVVAAWSKNSCTSYDDRIGVARALQHDPEIDKFGDIQLLEALAENDAVCVWHKDGDAAKAPDPQPLIDYALAAEAEFKKRHFKVPAYRHPDALLHPIFCDFGNSRWDIRFEIHENVQTSSPHALLLTLWTGSGMNSVQLCWRSKRLAHDLALGQNAQNAGVSEVARADRLGRAASNATKSDKVKIAGLFEQETWNGRLQAPRQQLEAIAKRVEKHGWDENAKKMRDRLQWLVTFSARLQPQGPWCEFAKTNQLRIDPQYWPHADANKTRKGQARIILSRLSGLRVLSVDLGHRYAAACAVWEAVNAEQVEKACQVVGHEAPKASDLYLHLKSKAMKRKKGNQVEVEETIVYRRIGADILPDGMPHPAPWARLDRQFLIKLQGEEEGVREASNKEIWAVHQMEADLGRPVSLIDHLVASGWGGSDKQRARLEGLKQLGWNPAEKFESGGESDLGEASDAYRPSLSVDELMSSAVRTMRLALKRHGDRARIAFAMTAACKPMPGDRKYYFTEAKELSMNDDQVTRSNKHVEFIQDALVLWHGLTSSRGWRDDAAKQLWNDHITRLSGYKAPEEIGEDTSAAERKKKQKENREKLHDVAKVLAEDATLRKVLHDAWKKRWKEDDERWKKELRWFKDWILPRGKAVDDPAIRKVGGLSLLRLATLTEFRRKVQVGFFTRLQPDGIRAETKEQFGQSALDALEHLREQRVKQLASRIAEAALGIGRMRRPMGGKDPKRPNGRVDEPCHAIVIEDLSHYRPKETRTRRENRQLMTWSSSKVKKYLAEACQLYGLHLREVSAGYTSRQDSRTGAPGIRCQDVPIKEFMRSAFWRKQVAWAEKKRAEGKGDSRERFLCNLNAIWKDKTMADWEQAGVVRVPLSGGEIFVSADPVSPVVKGLQADLNAAANIGLRALTDPDWPGKWWYVPCEPGSFKPVKDKVDGSAAVKPEQALRQSAGVRSGGAGKSKEVINLWRDISSSPLECIECGEWKEYTAYQNEVQCQVIRVLGEQIKGHHKQSYGRVKEDGILFR

SEQ ID NO: 61877 - protein, 664 aa, Unknown
  Microbial source - Accession No. Ga0370516_000963
MLARTRVKKITKTMLKLELKGDPKSLEFLDNLFNEYERLVRIADSFVYYLYPYYANITEQEKLERLKELVQSLDEKAIRKNKRRKREPQEIEEQTITETETKHKYTHSNLLKTLLHRFIKYTKQYYGIDAKYAWLEKQGGLADIMHSNAESAYKHRSIPNMRRRLTNVMPITMSKSPLDENRKDKKNNGRYYKKDAEFIFGNGKIMFRIGRGKHKVTFKIATRFNDAERLGMLIHAIQGDNGFTIGDPCYLVRKETYNGYRYYIMVSISKNVDVKALYEASKNKSKIRIVGVDSNISKYIATMFCIEVDKENKEFKLINAKGINSKDYINAVKKYEEERRKLQQGRMKGKISKKKCSRYKEKEDYTIRNRCGDSKRIDIRRQLIGYICNQILEFTDENNADIIVIEDLKGLNKELKHLRIIKKELGKLYNDVNDKGNNAIDDKINEINKKYKNKIRRPLLEILNKIKEYSNAKDKVKVAKYILKQRQIIEKRIFLLSIMAYYQFKQELEVEALWNGKLLYTINPKYTSQQCLRCGHTNKLNRITQRQFKCIKCKFEMNADFNASANIALMFATKILKLNLKQEEQGESSSMMTVTSATTPLHASINAGSKLGVVADTLSSVASILQGCYEERSPCLGGQTEQPCSARRSIATLDEFLEKRGNGG

SEQ ID NO: 61878 - protein, 687 aa, Unknown
  Microbial source - Accession No. Ga0370516_004838
MLTITKARTRVKKITKTMLKLELKGDPNSLEFLDNLFNEYERLVRIADSFVYYLYPYYANITEQEKLERLKELVKSLDEKAIRKNKRRKREPQEIEEQTITETETKHKYTHSNLLKTLLHRFIKYTKQYYGIDAKYAWLEKQGGLADLMHSNAESAYKHRSIPNMRRRLTNVIPIRVSKIPLAENRRNKDKCNDDKPYERDTAFIFENGKIMFRIGRGKHKVTFKIATRFNDAERLGMLIHAIQGDNGFTIGDPCYLVRKETYNGYRYYIMVSISKNVDVKALYESIKNKSKIRIVGVDSNISKYTATMFCIEVDKENKEYKLINAKGIKSKDYINAVNKYEEERKKLQQGRMKGKKQKKKGSKYKEKEDYTIRNRCGDSKRIDLRRQLIGYICNQILKFADENKADIIVIEDLKGLNKELKHLRIIKKELGKLYNDVNSKGNNAIDDKINEINKKYKNKIRRPLLELLNKIKEYSKNKDRIKVAKYILKQRQIIERRISLLSMMAYYQFKQELEVEALWNGKLLYTINPKYTSQQCLRCNHTNKLNRITQRQFKCIKCKFEMNADFNASANIALRFASEILKLELELKQGESSSMMTATNATTPLHASMNAGSKVSEQGHNDDLVRNGSVASTMSSVASILQDCYERRSPCLGGQTKQSCSVRSIATLDEFLEQKGNVFAMKGNGG

SEQ ID NO: 61879 - protein, 686 aa, Unknown
  Microbial source - Accession No. Ga0370516_008232
MLTITRARTKKITKTMLKLELKGEPNSNSLKFLDNLFNEYKQLVRIADTFIYHLYPYYANITEREKLEGLNKLIRSMERKAIINRRKEKEKKKETDDDFAYQRLPYLFAWLEGKISKESRYTYSHSYLLKTLLHRFIKYAKQYYGIDVKYANLEKQSGLVDIMHNNAENAYKHRTIPNMRRRLINVMPIRVSKRPLPENRRNKDKCNDDKPYERDTAFIFENGKIMFRIGRGKHKVVFKIATRFNDIERLGMLIHAIQGDSIFTIGDPCYLVRKETDNRYRYYIMVSISKNVDVKALYESIKNKSKNKIRIIGIDSNISKYIATMFCIEVDKENKTYKLINAKGIDSKAYINAVNKYEEERRKLQQGRMKGKKQKKKGSRYKEEEDYTIRNRCGDSKRIDLRRQLIGYICNQILEFANENDADIIVIEDLKGLNKELKTLRIIKKELGKLYKDVNSKGNNAIDDKINEINKSKKYKTRRPLLEILNKIKEYSNTKDKVKVAKYIIKQRQIIEKRMSLLSMMAYYQFKQELEVEALWNGKLLYTINPKYTSQQCLRCNHTNKLNRITQRQFKCIKCNFGMNADFNASANIALMFATKILKLKLELNPKQGKDSSTVTSTAIPLHASINAGSKLGVVADTLSSVASTALQGEGEGRLPCLRGQTDKPCSAKRSIATLDEFLEKKGNGG

SEQ ID NO: 61880 - protein, 672 aa, Unknown
  Microbial source - Accession No. Ga0370516_009639
MLTDTRTKVKKITKTMLKLELKGDPKNLKFLDNLFNEYGQLVRIADSFVYYLYPYYANINEQEKLERLKELVQSLDEKAIRKNKRRKREPQEIEEQTITETETKHKYTHSNLLKTLLHRFIKYTKQYYGIDAKYAWLEKQGGLADLMHSNSESAYKHRSIPNLRGLSNVMPIRVSKRPLLENRKSKDNDEYYKRTAEFIFNNGKIMFRIGSKHKGLTFKIAERFNDTERLVILIDAIQGKNDLTIGDPCYLVRKETDNRYRYYIMVSISKNVDVKALYESIKNKSKIRIVGIDSNISKYIATMFCIEVDKENKEFKLINAKGIKSKNYINAVKKYEEERRKLQQGRMKGKKQKKKGSRYKEKEDYTIKNRCGDSKRIDLRRQLIGYICNQILEFADENNADIIVIEDLKGLNKELKHLRIIKKELGKLYNDVNSKGNNAIDDKINEINKKYKNKIRRPLLELLNKIKEYSNAKDKVKVAKYIIKQRQIIEKRMSLLSMMAYYQFKQELEVEALWNGKLLYTINPKYTSQQCLRCGHINKLNRITQRQFKCIRCNFEMNADFNASANIALRFATKILKLNLKQEQGESSSMMTATNATTPLHASINAGSKLGVVIANNNTDGSVASTMSSVASNLQGCDEGRSPCSRGQTKQSCSAKRLVTLGEFIEKKGNGG

SEQ ID NO: 61881 - protein, 405 aa, Unknown
  Microbial source - Accession No. Ga0370516_018229
VGLKPKLLNPRTTFVAVHARLVFTSPEDERAVLDLMRRFSAAYRWIYKRLLEGHDPNELKREGGPMERRFGLNVKYNEGARDLALWKIAVMKELGRPPEKVVFGGRGLFRRLGRKGDLKARLEAKRLWRERRNGLLYCPGDRSQYSGNRNLQLFTRDGALWLRIVLDTTPLTPEERAQSRLFPGESGRTKGHYVDALVQTRSQNLPAILEVVGQKGVAPIGVNLRLHDGRVYATFSRQLPLPVPVYTRQHGVLGVDVNARPFHLALAVVGPDGNLRRYTTIPLEEADRIRERKQGETSRNALENFYWHVAHQVVRLAKEEGVAIAVEDIRRLPKGRRGEGNKRFRRKLHRFAYRAILERIVRVASREGVEVWGVNPAYTSVIGALKYAPMRGLTKDVAAAWVIAR

SEQ ID NO: 61882 - protein, 348 aa, Unknown
  Microbial source - Accession No. Ga0370516_020865
MRVNTKYRTVIIRLYPTPKQEVLLKKAEEEVLKFLHLSRLELQKMLYHKMKEMGIELSMYTVSLLTQRFTGSLGEKAIIPFDTDYNAKFVNDDGIWFVEVQLFKGKGNRIRIPIAKTELPYYEAIDEIQGLPFVITRENNDWFAYVSVPVKAEPSDLVVGVDFNLRMWVASPYEGRPVFFDVREYDQKIDRLQRLRTRYQKRGEEENVNECLRKMKEIVKLAHGNFLARIMERYGVCNLAIEDIEVIYKLTEKDSRMINNWLYSKTALRQFALRAMAKGFNVIEVDPKDTSRLCHKCGNPVRIYGKHERLIACETCGYRDYNRDLNAARNIAKRGSESRNIICPHPSG

SEQ ID NO: 61883 - protein, 422 aa, Unknown
  Microbial source - Accession No. Ga0373397_000168
MKHTKVMRYQIIKPINDTWETLGHVLREIQRETRAALNKTIQLAWEWQGFRAEYKQRYEEYPKTKDHLGYSALHGYAYNRLKDEFYRMNTANLSQTVKRAADKWKSDLKDVMRGDKSIASFKKDCPIDIVSQALRIRKDGSDYILTLSLVSIKYRKELERKQSSFDVLISANDKTQRDILDRLIAGEYKLGASQLLYHKKKWFVNVNYQFEKEETAFDQDNIMGVDLGIVYPVYMAFNNSLHRYKIEGGEIERFRAQVERRKKQLLQQAKYCGEGRRGHGTKTRIQPIEVVSDKVANFRDTVNHRYSRYVVDMAIKHRCGTIQMEDLTGIATDNTFLKSWPYYDLQQKIEYKAHEAGIQVVYIKPDYTSQRCSKCGHIERDNRTEQATFECKSCGFKTNADFNAARNIATKDIEKIIAETLK

SEQ ID NO: 61884 - protein, 426 aa, Unknown
  Microbial source - Accession No. Ga0373621_000479
MGANKEMETIKVTVKATISLKDKGIRKLMREYDAYKKVLISRVKQAVRPIIKDKSIRVYAQQKWMVDKKLNEYLKNLSFHPMPFHRQSVWIEYRKGFLIHFKTAEGEAVCHLHVPEKYYDMILEACGEDNPILGQVELIEDPKYEWINCHIVLRYPKPEPYEPKGWLGVDTGWNKLATSIACEINPHIRFYNPTFHGKDFKTRIIQLRHLLKEYQRKGKKIKMWKNRLKNTIEYAKGMVAKEIVSKAKKHKLGVAMESLTFKAVSKGYLVPRYKLMIAVKTLCEREGVPFKLVPASYTSQTCPKCGYVDEKNRDGERFKCLKCGYQADADIVGAMNISQKAFDSSSDEEENGVGFKPTSKADRGLPREAGRVASPQASMRDDPIERDATQGVARVACKEHCNFAPEESASQIWENCRSRQRTLQLY

SEQ ID NO: 61885 - protein, 378 aa, Unknown
  Microbial source - Accession No. Ga0373621_007959
VNKNNTDLIKVTATCGIDPRDKGIKILMKEYVIFKKNFITKVKGAIRPIVKDRNVRVYSSQKFLLEKKLHEFVKNLPYHPMPTGNQAYWLEKSYYETKNGKKYPCINLHIKTKDGEAVSKLIVPKKYEEYLLKATKKSCPYLHDEKCEFEYCPFETPKMCKKINPHRGELELIEDLKSGYIRAHITLRFPKSKPYEPTGWLGVDTGWNKLAVSIVAKNNPHLRFYAPSIHGKDFKTRIIQLRHKLKELQRNGKVSEVWENRLQNMIKYATGKTAKEIVSKAKKYRVGVAMEDLNFQAVTKGFIVPRYKLMIAIKTHCEREAVPFVLVPAKNTSITCPKCGFVDEKNRNGERFKCLKCGYEADADIVGAMNISKAGVKI

SEQ ID NO: 61886 - protein, 336 aa, Unknown
  Microbial source - Accession No. Ga0373621_010685
MRVNSQYRTVTVRLLPLPEQEILLRKAEMEVIKFLSLSRYELQSMLYHKMKDYGVEISMRSLNLLVQRFTGSLGEKTIIPFDDNAKFVNDNGLWFVEVQLFKERGNRIRIPIAKSEVPYYEAIGELEGLPLLITRENEDWFAYVSIPVKADPNGLIVGVDFNLRKWVASPYIGTPIFFDVREYNEKIDRLQRLSSRYQSREEEEKVKECFRKMQEIVKLAHGNFLSKIMDKYGICNLAVEEVETIYKLVRKENKMINNWLYSKTALRQFILRAMAKGFNVIEVDPKDTTKLCHKCGNPVKIYGKHERLIACEKCGYRDYNRDLNSARNIAKKGKFK

SEQ ID NO: 61887 - protein, 334 aa, Unknown
  Microbial source - Accession No. Ga0373621_017562
MRVSTQYRTVILQAYPDPKQERVLKRCEQSVLKFLEVGRLQLQKMLYHKLKDLDIGRYSLSLLAQRFTGSMGEKALLPFHTDYNARFVEDGGLWFIDAQLLKGRGERVRIPIAKTEVPYYESIQELVGLPFFLARENDKWFAYVSVPVKADPNGTAVGIDFNLRLWVASPYEDSPLFFDARPYSREVDRLQKLIARAQKNEEDVEEHYQSLRGLIKQAHGNFLSAISEKWGICTLVLEDIETMYGMRGLKSKLTNNWLYKKTALRQFALRAMAKGFDVVEVPPRGTSKECHRCGSQLKIYGRHERLVECDKCGLRDYNRDLNAARNIAKGAVDA

SEQ ID NO: 61888 - protein, 347 aa, Unknown
  Microbial source - Accession No. Ga0373621_020135
MKVNSQYRTVIIRLYPLPEQEILLRKAEMEVIKFLNLSRYELQNMLYHKMKECGVELSMYTLSLLVQRFTGSLGEKALIPFDTDYNAKFVNDNGLWFVEVQLFKGKGNRIRIPIAKTELPYYEAIGELDGLPLVIARENEDWFAYVSIPVKADPNNLIVGIDFNLRKWVASPYEGAPVFFDVREYNEKIDRLQRLRSRYQKRGEEEEVKECFRKMQEIVKLAHGNFLSKIMGKYGICNLAVEEVETIYKLVKKENKMINNWLYSKTALRQFILRAMAKGFNVIEVEPKDTTKLCHKCGSPVKIYGKHERLIACEKCGYKDYNRDLNSARNIAKKGSEVSITNSCMVR

SEQ ID NO: 61889 - protein, 356 aa, Unknown
  Microbial source - Accession No. Ga0373621_023545
MPKVFKVAPTVEGNTLKRCVRGAISPRDIGLRKLMREYAIYKHVLIPRVKQAVRQIVKDKTISVYAQQKWMVDKKLNEYLKNLPFHPMPFHNQSVFIENKSGRFWIHFKTKQGEAVCYLYVPAKYHSLIEKACGEDFTRNPVLGQVELIEDKHYGWVNCHITLRLPKPEPYEPKGWIGVDVGWNKLATSILATVNPHLTFSHPTIHGKNFKTQIIQLRYLLKDYARKGKAWKKWDYRLKNTIKYATGVVAKEIVLKAKRHKAGVVMEKLAFKSVTKGYIIPRYKLMVAVKTLCEWEGVPFKLIPAKYTSITCPKCGYKDEKNRLSERFTCLKCGYQADADIVGAMNIAKTASQMEG

SEQ ID NO: 61890 - protein, 405 aa, Unknown
  Microbial source - Accession No. Ga0373621_050562
LDSETARLCVKAVISPYDLGLDKLLHEYKLYKKMLIPKVQQAVKQIVKDKSIPVYSDQKWLVVKKISEYLRELPLHPMLFGNKSYWIEKRGGEFWIHMKTKDGEAICLLNVPEKYRDVVEKACGETCPYMRNSKCEFTKCPFNTPKMCNRINPHRGEMRLAQDARYGWINCHITLRLPKPEPYEPKGWLGVDVGWNKLATSILATVNPHVRFSNPTFHGKEFKTRIIQLRHLLKEAQRRGRVVKTWRNRLKNTTDYAVKVVAKEVASKAKKFKAGVAMEKLTFKPISKGYLIPRYRLMIAVKTLCEREGVPFKLVPARYTSITCPKCGYRDEKNRNDEWFKCLKCGYQTDADLAGAMNIALRALDGTADGAVNDVRHASRLKPRRLYASKAGCVAQPKAAMRDVS

SEQ ID NO: 61891 - protein, 1477 aa, Unknown
  Microbial source - Accession No. Ga0373637_0010996
MSPNATPPVTQRAYTLRLRRAPGRCPKCQNDTCDCWRDALWATHEAVNRGAKVFGDWLLTLRGGLHHTLADMEVPAKGKGSSRAPTQEERRHRRVLLALSWLSVEDEGGAPNGDGLRVTTGRYSDNDRREAVEAALREILEKRGVQPSEIEEWVRDCGPSLAARIRKDAVWVNRSALFDAVCGGQNVRQAREDARTLLWYLLTDHYLALPKTDKKQSEGSDEDQEDGEEKEPTVDAAAEAVAKSAKGAGQRTRHLFSHIFGRKSTQGFGKPRRKLDLREHWRGYLKPRIETAGIPLSDPDVKAKKKAALSPTEVHREMFSKAASRLAQTWTRQKQQEVARQLGAAADEELNKLEGDKAYCKALELLDAYCRERGQASGSLEEYRINPRAAEGWERVVVAWERINEADRAKATEKRIDEVKRLQSENFDKKFGDINLFVDLAEPEYEPVWQHNGQATPSILKTYVKGWKARTDAARLKVAAFRHPDPYFHPVFCQFGVSRPPIQYGRLGTNWDGDTRTVRMRVWNGSRAVDLPLLAVSKRFDAEIGSASESMEKAEPEVTRRSRLAIAAVPNGRIQGNRFRVASVFDQQDVRSRQKADNGTQEDTDDEDSRNGKDKEKKKEPTWNGTLQADRWALKSIGRLPCSDLQKKQQAKRRLQWRLTVALELQPIGPWYDYVRNAADPFPFQRTIRKNDKGIKRQKEKKYLSINGWPFEEINKPLRDGGAKLVVDKQSVRGRDANVILSRLPGLRILSVDLGHRFAAACAVWEALPKDKFEKEIANLEALAGGSGKDDLYLHVAKPGDDGKTRTVVYRRIGPDDLPDGKAHPAPWARLDRQFLIKLQGEDEEAREASNEEIWAVHQLEAELGRAVPLIDRMVRGGFGQKVEQKWRLEALRGLGWRPAATNVPPGAADEEEGEARKISRSVDELMSAAVRAMRRSLKRHGDRARIAFAMTADYKPMPGDRKYYFNEARDASRGDDAASRRGKRVEFLQDALSLWHDLFSSRGWKDDAAKVLWDEHIATLLGYQTPEETAENLTNVERKKKRKEYRDKLRAAAEALAVDDRRRAELHEAWKKRWESDDAQWNKRLRWFKDWILPRGKAKKDPGIRHVGGISLVRLATLTEFRRKVQVGFFTRLRTDGTRAEIEESFGRSALDALDRLREQRVKQLASRIVEAALGLGRVKTPKKGNTPKRPREAVDASCHAVVIESLTHYRPDDLRPRGENRQLMTWSSSKVKKYLAEACQLNGLHLREVPAGYTSRQDSRTGAPGIRCQDVPVKEFMQSLFWRKQVAQAEKKVTDGKGDACERFLVDLNAKWKDQTEAAWKSAGSVRIPLKGGELFVSADPGSPAAKGIQADLNAAANIGLRALLDPDWPGRWWYVPCKPGTSEPALDRIKGSAAFEGVQVLPADGAAPAGSEAGKRQPKKSKSKAPKKIEYLWRDPSGGVLAAGRWKQTQAYWNDVQYRAVQLLRKRAGLDSYG

SEQ ID NO: 61892 - protein, 1352 aa, Unknown
  Microbial source - Accession No. Ga0373637_0021496
MSNKTTNQKSIWSEFTKQYALNKTLRFELKPVGRTEDFLKQNKVFEKDKTIDDSYNQAKFYFDKLHQKFINESLSLNNAKAIDLKYFAEQFLKLKSQIQKLKSENKKEEVNKKEKEINNLRNDYYKKIKSLLDKKAKEWKEIYKKKEIKFSKSDLEQKGTDFLMKSGILGILKYEFPKEKEEEFKSKDYPSLFVADKANPGNKVYIFDSFDDFATYLIKFQETRKNLYKDDGTSTAVATRVISNFEKFFNNKKIFEDKYINYWKQVGITEEEKKIFEIDYYYSCFTQEGIDEYNKIIGQINQKSKQYRDKNKVEKSELPLFKVLDKQILGEVIKERELIVKTETETEEEVFIKRFKEFIDQNKQRIPKAQNLMNDLINEKFENEYSGIYLKNSAINTIANRWFKNAIEFLRKLPQASKSKENKESPKVKPFVSLLDIKDALDEFEKERESLGSIFKDKYYKTKESDEVPLNNDRESYWKQFLKILGYEFNQLFEDKFNEEGIKTFWGYTKDLEKEAENLNSFSRKKEEITVIKNYCDASLRIYQMMKYFTLEAKKQDDIPLDYSTEFYNRFNEYYQDFKFVHYYDAIRNFVTKKPSNEDKTKLNFESGSLLTGFDKNKESEKLGIILKNKNNNKYFLGIINKKHNKIFELKNENEFIGNPAKDLYEKMELKLFPDPKKMIPKIAFADKNKKYFGWIQEIQNIKKDFENFQKNKKGNQDLKFDKNKLSKLIEYYQNCLEKGNYKKEFDFEWKKPEEYQSMSEFNQDIEKKNYKIKFIPVKDSYIDDKVKNGELYLFEISNKDFIWLNQKKNIHTLYFLSLFSEKNIQKPIFRLGANAEIFYRQKSEKATKEKRGGKEIIKYKRYTEDKIFLHLPIEINYGCPKAPNKNQYNKKVIEFLNKNKDEINIIGIDRGEKNLLYYTVINQKGEILDHGSLNEINGVNYLEKLIEREKERQINRQSWEPVVKIKDLKRGYLSYVVRKIADLVEKYNGIIVLEDLNMRFKQVRGGIERSIYQQFEKQLIDKLGYLVFKDYRDSDAPGGVLNGYQLVAPFTTFKDLGKQTGIIFYTNAEYTSKTDPITGYKRNIYISNSTSQKKIKENLINKFRAIGWDEKEKSYFFTYNQKDFNSPISKEWTLYSKVPRVRREKNNSTGYWEYKPIDLNKEFEDLFKKYEINEKSKDILSEIKELIKNNENKLTQKQEFDKKNKNFYERFIYLFNLLLEARNTISLQIKLDKRGNEIKLDEIDYGVDFFASPVKPFFTTAGVRFVGKQIEGGKIQKEKKEKFAIKNFADFERLFKGCSSDGFDSDGIGAYNIARKGIIILERINQNPKNPDLYISKEDWNDFAIKNALVK

SEQ ID NO: 61893 - protein, 1485 aa, Unknown
  Microbial source - Accession No. Ga0373637_0024972
MSQNPAPPVTQRAYTLRLRRGPGKCPACQKDACDCWRDALWATHEAVNRGAKAFGDWLLTLRGGLCHTLADIDVPAKGKKPARNPTKQEQRDRRVLLALSWLSVEDERGAPNGDGLRIATGKEPADKRGEAVKAALRNILGNRGVNASEADSWVKDCEASLAASIRDDAVWVNRSAAFDAACNGQNLRQAREDARTLLWYLLTDDYLVLPKANKKESEDTGEDQEEGQDEESAVDEAAEAVAKSAKGAGQRTRHLFSHIFGRQSTQGFGKPPCQLDLRDYWQGHLKPLIEAAGIPLSDPNVTAKKGAAPSPTELHREMFSKAASRLAQIWTKQKQQEVARQLRAAADDELKELESDQTYSKALDLLEAYCRERGQITGSLEEYRINPRAVEGWERVVAAWEGIKSSDPTEAQQRRIDEVKRLQDESDDKKFGDNNLFVSLAEPEYEPVWQHKGQATPSVLKTFVKGWKARSDAARLKVAAFRHPDPYSHPVFCQFGVSRPWIKHGRLDPKGNAGTVQMLLWTGSKADKVQISAVSKRFDAEIGSASESTVIAARQVARRHRLAVAAVSTSGAGVNTIRVAHVFDQQEVRSRERAVEHGIEDENGDDESQNARKKGPIWNGTLQADRQALKAIGKLASSQKAPQAYRCLQWRLTVALELQSSGPWYDYVRNATDQSPFQRTVRKDEDKGKKRKKGTKYLFLDGWPFEEVNNPLKVNRVDTLLLADKRSARGREAKIVLSRLPGLRVLSVDLGHRYAAACAVWEALPNAAFKGEVAGLKVRAGGPGEDDLYLHVEKPGDDGKTKTVIYRRIGPDSLPDGQFHPAPWARLDRQFLIRLQGEDEEAREASNEEIWKVHQLEAELGRTVPLIDRMEKGTFGQTEKQKQRLEALRGLGWTPATTNVPPGAAGEEEGETRIVSRSVDELMFAAVRTMRLALRRHGDRARIAFAMTGDHKPLPGGRKYYFDEAKGASASDDEATRRSKRIEFLQDALALWHDLFSSRGWKDDAAKKLWEQSVATLSGCQTPEEIAEDLTAIKRKKKREENRDRLRAAAEARAAAEALAAAEALAADDRRRKELHDAWTKRWELDDAQWKRRLRWFKDWVLPRGKAGNDPGIRHVGGLSLTRLATLTEFRRKVQVGYFTRLHPDGMKRETRESFGQATLDALDRLRDQRVKQLASRIVEAALGIGRIKTPKGGKMPKRPGKAVDDPCHAVVIESLTHYRPDDLRTRRENRQLMTWSSSKVKKYLAEACQLNGLHLREVPAGYTSRQDSRTGAPGIRCQDVRVKEFMQSPFWRKQVAQAEKKRADGKGDARERFLFDLNTKWKSQTEAAWESAGSVRIPLKGGGLFVSTDPRSPAANGIQADLNAAANIGLRALLDPDWPGRWWYVPCKAGTSEPASERIKGSAAFKNVRGLPADGADRAGSEASTGQPRKNKGGASREIENLWRDPSSEGLAAGHWKQTQAYWNDVQYRAVQLLRKRARLDSDG

SEQ ID NO: 61894 - protein, 1289 aa, Unknown
  Microbial source - Accession No. Ga0373637_0031827
VWDILEPFFGTRAAYFAGLEDGEEEDEATHEEEEAKDLVQKAGQWLSARFGTGTGADFDAMAGAYKRIARWAVRASSDYPGKETIHRLATCLKLSGSCDLNGVLRVISGPGYKSATRNHLKTMYGKSKVAREDLDRLKELAEQDAAKCKGNVGRKGQRAWADLVLKDVEKACGFTYLQNDGPARHREFSVMLDHAARRVSIAHSWIKLAEQRRRQFESDAKKLNELRKRAANAVVWLDQFCADRSTATGADTEGGYRIRKRAVEGWTHVLKTWARPSCNTGEERIAAAREVQADPEIEKFGDIQLFEALATDEAVCVWRDQAGKPDASILIDYVVGTTAEHNQKRFKVPAYRHPDALRHPVFCDFGNSRWAIRFAIHDAVGARSKGKRAKTDTNWLQNRHGLRIGLWSGNSVGDVDLQWSSKRLTKDLALDDNPAATATSVTRADRLGRAASGAFGPAAIKNVFEEKDWNGRLQAPRAQLDRIAELEDRGHHAQAEGLRQRLRWLVSFSPRLRPSGPFIEYAASQGIEPNRKGEYYPNAPANKGREGLAKLILSRLPGLRVLSVDLGHRFAASCAVWEAVPNAAFKEEIAGLKVLAGGPGKDDLYLHVAQPGNDSKTRTVIYRRIGADNLPDGKAHPAPWARLDRQFLIKLQGEDEEAREASNQEIWAVHKLEAELGRAVPLIDRMVRGGFGETDNQKRRLEALRGLGWRPAATNVPPGMSDEEEGEARTISRSVDELMFSAVRAMRLALKRHGDRARVAFAMMAEFKPMPGDRKYYFNEARDASAGDDEQSRREKRVEFLQDALSLWHDLFSSRGWKDDAAKVLWDKRIATLPGYQTPEEIAEDLTGAERKKKRKENRDKLRAAAEALAADDQRREELHEDWKKRWESDDEQWNNQLRWFKDWVLPRGKAGDDPGIRHVGGLSLARLATLTEFRRKVQVGFFTRLHPDGTKPEIKESFGQATLDALDRLREQRVKQLASRIVEAALGIGRIKIQKEGKSPKRPRMAVDTPCHAVVIESLTHYRPDDLRTRRENRQLMTWSSSKVKKYLAEACQLNGLHLREVPAGYTSRQDSRTGAPGIRCQDVPVKEFMQSPFWRKQVAQAEKKGADDKGDARERFLVDLNAKWKGQTEAAWKSTGSVRVPLKGGELFVSADPRSPAAKGIQADLNAAANIGLRALLDPDWPGRWWYVPCKAGSSEPSPDRIKGSEAFQGVQSLPADGAAPAGSKAGIGHSKKNKGKTPKEIENLWHDPSSEGLAARHWKQTQAYWNDVQYRAVRLLRKRAGLDSDG

SEQ ID NO: 61895 - protein, 553 aa, Unknown
  Microbial source - Accession No. Ga0373637_0034837
MPFGRTAGPTIVYKYGAKKPTTNAEAILEQLRKAHQYRNKLVEIELQRRKLVEEAVKNIESDVRHLANKLEQLELDIDYTVRKINNHKQKNHTRTTPAELKEHLKSLKTQYREALRQMKEAKKAAYARPETQEALNRIAGKVRAEHKKARNLCGLYWGTYCHVEQITTHIRKGPPPKFRRFAGSGVLAVQLQKGEDIARLESGEDRRIRIEGCGKRRILWLRIGSDENRYPIWATIPFTYHREIPSDAKIKWVKIKAQRIACQTEWEVLFTLERSSGWKKPDLAQDGVVAIDIGWRNFDDRIRVAYWIGSDGCEGEVALPHNMVGKALEQVEHLRSLRDKNFNEIKQQLLDAIGVLQIPEWLKEATKTLHQWRSQGRLAALAIRWRQQRFDGDNDIFALLETWRVRDKHLYEWEAHLRVKAIRRRNDYFANVVANLSRRYKTAIVEDFDLRSVTQVDPTQTEQVGDGRQLYRAHIAAAGGLRQMIKNRFAETQIVSSVLTTQTCTECCEVMNFAAAESVFGKCPHCGHTFDQDRAAAINLMRRYEERLVAANS

SEQ ID NO: 61896 - protein, 1209 aa, Unknown
  Microbial source - Accession No. Ga0373637_0065620
MKHNSTFENFTGKYSLSKTLRFELVPQGKTKETFSKWIKELENQTADEKKNLLHQDIMRAQKYEKVKKILDEYHKDFIEQALSALGKAKLQGLDEYKRLYDIKKKEKKEAEEFENIKTSLRKQISKALKAHSGFTMLNKDDLFKGKKNSDDGRLLQKFLNDNHKVKQDLEATLRENENDHINLFDLLKSFESFTTYFKNFHENRKNLYSDEDKFSTIAHRLVHENLPKFIDNIRIYEKAKTAGLNVDAIQEQLQQERLLDDIFSIEYFNETLTQQGIDDYNYILGGRAVDPGKPNIRGVNSFINNDINQKAENNKDRIPVMKPLYKLPLFERTSSSFRFDPIENDADLIQRIKSFYYHELLQYREETESEAEPLNILARLKELLKSITDFRDGLYVNGGLTLTQISAKIFGNWNYIGNALSDYYDKHVDPPKPDKKGNPKPVTKKQEEAKRKWLKQKQFPVSLIEKALSEYRKKETNEEVKSKITDTTLCDFFKKCGANEDGKNDLFARVEFKLTDKNEKGETLEELLNTDFASDKKLMQDKPKTLLIKNFLDALQGNFDDISAGLLHFIKVLKPREEVSDKNETFYSEFEKYYKALSEVTPLYNKARNYLTQRPYSVEKVKLNFENSTLLDGWDENKEADNSCVLFRKDGFYYLGIMDKNHRNIFKEYPKANHGESSYEKMIYKLLPGANKMLPKVFFADSNLQHFNPPEDILRIRNTASHSKNGNPQEGFVKAPFSQADCHKYIDFCKASIAKHWDWNSFGFVFSPTNQYADSSDFYKEIERQGYKITFAHVPESYINQLVDDGKLFLFKIWNKDFSLNKKVQNRNSKPNLHTLYWRLLFDNRNLSDITLKLNGEAEIFFRKKSIPEDKLTVHEKGKPIENKNPFNKKKESVFDYDIIKDKRFTVDTFHFHVPMTLNFGADGSDNINSEINAFLQNNHDINIIGIDRGERHLLYYSLINQKGEILKQHTLNLLGNQNYRDLLDKREGDRDEARKTWNLIENIRNLKEGYLSHVVHEIAKLMIEYNAIIVMEDLNFGFKRGRQKVEKQVYQNFEKMLINKLNYLVFKDRQPDKPGGVLRAYQLANKFESFKKLGKQSGVVFYVPAAYTSAIDPITGFVNFLQPLKADSIEKSKKFYGKFKSIRFNPEKQWFEFDFDYTDFIDKAVGKTNWVACTTNTERYAWNKSLNNGKGDQELVRVTQELEVLFGD

SEQ ID NO: 61897 - protein, 605 aa, Unknown
  Microbial source - Accession No. Ga0374803_055
MRYRNSRDVVGKVKSVTVSKHAGKWFVSIQTEREVDRPIPQGGAVGMDMGIARLATLSDGTFYAPLNSFKRHEARLRKAQQALSRKVQFSNNWKKAKARLQRIHSQMANARRDFLHKVSTAICKSHAMVCIEDLQVRNMSKLAAGTADAPGKNVRAKSALNKAILDQGWYEFRCMLEYKLAWKGGRLIVVPPQNPSRTCPCCGHVSSDNRQTQAWFECVACGYENNADRGSGPEAFRGSGPEAFRGSGPEAFRGSGPEAFLVGAINILACGIQLLRDEGQDTTDAAVGMRVGEPPVSARMACGSNRTGGRKQEPAETTAQGAIHAQRGRNLQPSGRGGCQHSLPSGSAQVRIKKQRSHPQAHFCLPVNPVRTLSATKAAFFSAYPRPINAVYRRVVEELLVELHLTTVNSTFVYDPFFALGLVTLYDGLMEAYHPPEQREAIFNALCKALHLKPEVLRKNARDLLELMGSGDPRQRLDLLCLKPEAEDVGGLKAILERMTQPPYAYSRVLAVGLYTAYEVVAKSLYEEPEERTRRFLENVVSKLPFSTERVRKDLELYRSSLDRMKQARAVVEEMVKAARRQQERRQSAASLPETSLGDPSKPGS

SEQ ID NO: 61898 - protein, 676 aa, Meiothermus silvanus
LRSGCISSRPQRRWFAWLWPGRWTRRVPSPLPWRQAPRNEPWSKLRGWKEIATTRQPWPTWWPGWPTRATPKPDGTWPRAFWPGFLGTGFARTEGKPPLQRAGEQGAPIELAFQSPTGLLALPDPSIPQRTFGSSKEGGEMPFGKKARHVKAYQFGADAPQEGMEAVLEQHRLRTDYYNALVEMELRQREERTALLANLAAESGLESPNQVYERLKAAGEKGIRKHPEYVAARERQKALYGHPRLLELQSRQREERNALRRSFGAKGLYSSNYLDVERAFDKARQSPELRFRRYSPHEGRLAVLYTEGLPMREIGSDTRVQLPLPDPIIYRDRATRRKHQRVLMKFRVRSVERQPLWITVPVYLHRELPDGVCREVSLHWHRVADRLRWTVSVVVEVEGPPVASPTGRGAVAVDLGWRRVEGGLRAGFWVGEDGAGGEIALSEGDLKQFSKVEDLRSIRDQHLNALKEALAAWLEAPPAPLPDWLAEETKTLPQWRSPARFAALFRRWQSERVHADEAAYGLLEGWHKRDRHLWQYEANLREQMILRRREQYRVLAATLARQYDALIVEDFNLRAAAELDQGGSDLPDAARRYRTIASPSTLRDALVNAFAQRGKPVRKLNPAHTTTDCHACGGALVGDPAKELRLYCPTCERFYDQDENAARNLLRRAQEVQAQV

SEQ ID NO: 61899 - protein, 447 aa, Alicyclobacillus acidoterrestris
MIVKTMPYEIIKPLSCDWAVFGEMLRRLRDESFRIKNSAIQYFYEDDIKRREFKKNNGRFPKKGEFYGSSVSVYNYVRPDVKYSAMGNVTLINQLVKSVWIKYKDDVVKRNMSIPSYRPNNPIEINVQSFNSFDFGQACVNLLSRKGVEELKKKLSEVKKKKNKTGGDDNLKFTQEQLNGISTSVTFAFNPGKNNAKQVLNRIISGEYKLSSSKIIYNERKNKWMLAVAYKFEPKTIELDKNRVLGIDMGVVYPAYMAVNYDKYWRDSIDGGQIEQYRKTVEARRRRLQRQAAVCGNGRIGHGRKKRMQPLEKISDKVANFRNTVNHTYAKKIVQNAVKLGCGTIQMEELSGINEKETFLKRWTYFDLQKKIEYRAKEYGIDVIKINPKYTSQRCSECGYIDERNRPKVPDQSKFKCLSCGYETNADFNAARNIATPYIDKIISLNS

SEQ ID NO: 61900 - protein, 1129 aa, Alicyclobacillus acidoterrestris
MAVKSIKVKLRLDDMPEIRAGLWKLHKEVNAGVRYYTEWLSLLRQENLYRRSPNGDGEQECDKTAEECKAELLERLRARQVENGHRGPAGSDDELLQLARQLYELLVPQAIGAKGDAQQIARKFLSPLADKDAVGGLGIAKAGNKPRWVRMREAGEPGWEEEKEKAETRKSADRTADVLRALADFGLKPLMRVYTDSEMSSVEWKPLRKGQAVRTWDRDMFQQAIERMMSWESWNQRVGQEYAKLVEQKNRFEQKNFVGQEHLVHLVNQLQQDMKEASPGLESKEQTAHYVTGRALRGSDKVFEKWGKLAPDAPFDLYDAEIKNVQRRNTRRFGSHDLFAKLAEPEYQALWREDASFLTRYAVYNSILRKLNHAKMFATFTLPDATAHPIWTRFDKLGGNLHQYTFLFNEFGERRHAIRFHKLLKVENGVAREVDDVTVPISMSEQLDNLLPRDPNEPIALYFRDYGAEQHFTGEFGGAKIQCRRDQLAHMHRRRGARDVYLNVSVRVQSQSEARGERRPPYAAVFRLVGDNHRAFVHFDKLSDYLAEHPDDGKLGSEGLLSGLRVMSVDLGLRTSASISVFRVARKDELKPNSKGRVPFFFPIKGNDNLVAVHERSQLLKLPGETESKDLRAIREERQRTLRQLRTQLAYLRLLVRCGSEDVGRRERSWAKLIEQPVDAANHMTPDWREAFENELQKLKSLHGICSDKEWMDAVYESVRRVWRHMGKQVRDWRKDVRSGERPKIRGYAKDVVGGNSIEQIEYLERQYKFLKSWSFFGKVSGQVIRAEKGSRFAITLREHIDHAKEDRLKKLADRIIMEALGYVYALDERGKGKWVAKYPPCQLILLEELSEYQFNNDRPPSENNQLMQWSHRGVFQELINQAQVHDLLVGTMYAAFSSRFDARTGAPGIRCRRVPARCTQEHNPEPFPWWLNKFVVEHTLDACPLRADDLIPTGEGEIFVSPFSAEEGDFHQIHADLNAAQNLQQRLWSDFDISQIRLRCDWGEVDGELVLIPRLTGKRTADSYSNKVFYTNTGVTYYERERGKKRRKVFAQEKLSEEEAELLVEADEAREKSVVLMRDPSGIINRGNWTRQKEFWSMVNQRIEGYLVKQIRSRVPLQDSACENTGDI

SEQ ID NO: 61901 - protein, 1108 aa, Bacillus thermoamylovorans
MATRSFILKIEPNEEVKKGLWKTHEVLNHGIAYYMNILKLIRQEAIYEHHEQDPKNPKKVSKAEIQAELWDFVLKMQKCNSFTHEVDKDVVFNILRELYEELVPSSVEKKGEANQLSNKFLYPLVDPNSQSGKGTASSGRKPRWYNLKIAGDPSWEEEKKKWEEDKKKDPLAKILGKLAEYGLIPLFIPFTDSNEPIVKEIKWMEKSRNQSVRRLDKDMFIQALERFLSWESWNLKVKEEYEKVEKEHKTLEERIKEDIQAFKSLEQYEKERQEQLLRDTLNTNEYRLSKRGLRGWREIIQKWLKMDENEPSEKYLEVFKDYQRKHPREAGDYSVYEFLSKKENHFIWRNHPEYPYLYATFCEIDKKKKDAKQQATFTLADPINHPLWVRFEERSGSNLNKYRILTEQLHTEKLKKKLTVQLDRLIYPTESGGWEEKGKVDIVLLPSRQFYNQIFLDIEEKGKHAFTYKDESIKFPLKGTLGGARVQFDRDHLRRYPHKVESGNVGRIYFNMTVNIEPTESPVSKSLKIHRDDFPKFVNFKPKELTEWIKDSKGKKLKSGIESLEIGLRVMSIDLGQRQAAAASIFEVVDQKPDIEGKLFFPIKGTELYAVHRASFNIKLPGETLVKSREVLRKAREDNLKLMNQKLNFLRNVLHFQQFEDITEREKRVTKWISRQENSDVPLVYQDELIQIRELMYKPYKDWVAFLKQLHKRLEVEIGKEVKHWRKSLSDGRKGLYGISLKNIDEIDRTRKFLLRWSLRPTEPGEVRRLEPGQRFAIDQLNHLNALKEDRLKKMANTIIMHALGYCYDVRKKKWQAKNPACQIILFEDLSNYNPYEERSRFENSKLMKWSRREIPRQVALQGEIYGLQVGEVGAQFSSRFHAKTGSPGIRCSVVTKEKLQDNRFFKNLQREGRLTLDKIAVLKEGDLYPDKGGEKFISLSKDRKLVTTHADINAAQNLQKRFWTRTHGFYKVYCKAYQVDGQTVYIPESKDQKQKIIEEFGEGYFILKDGVYEWGNAGKLKIKKGSSKQSSSELVDSDILKDSFDLASELKGEKLMLYRDPSGNVFPSDKWMAAGVFFGKLERILISKLTNQYSISTIEDDSSKQSM

SEQ ID NO: 61902 - protein, 1076 aa, Sulfobacillus thermotolerans
MSARNIKVKIDTKGNPELRLGLWKTHQVTNEGVKYYTEWLIKLRQQDIYRQSREDASPRVIISASDLKADLLCHARQLQKERLPRITGSDAEILGTLRQVYELIVPSSVGKSGDSKTLARKFLSPLTDPGSAGGRDQSASGRKPTWMKMKSEGNPRWEETFRKWKDRKDNDPTPLVLNQIADYGLLPLIPLFTDVGENIFDPKSKSQFVRTWDRSMFQQAIERLMSWESWNQRVRREWEALNQKHSAFYREQFTADPDAALYRVAQSLEEEMRKEHQGFASDAPEAFRIRRVALKGFDRLLERWQKTLGKNGQSATLLDDIRRVQSDLGDKFGSAPLYQKLLDERWQRLWAVDPTFLQRYAAFNDLTQRLQRAKRVANLTLPDAVAHPIWSRYEGANASSGNRYHIHLPTKGQPGSVTFDRILWPDGNGGWYERKRVTVFLRPSHQVDRIHEAPTDSVVDNFPLVVEDQSARTILRASWGGAKLEYDRNRLPRQLKKGVPDSIYLSLTLNLDTNKPSGLFHTQQNGRVWIRKDVLMQYYNETPGDNVQFKPLYVMSVDLGIRSAAAVSIFSVQLKAGIEEHRLTYPVADCPGLVAVHERSVLLTMPGERREQWDRRYEQQRQGLRELRTDMRGMNDLLRGAYMDGDRREEFLARLSKLEETSPELWGPVYRSLNDSKVASATEWERLVVYCHRQVEQSLSSRIQNLRSGRSAYRMSGGLSLDHVQDLERIRGIIASWTNHPRIPGSVVRWQQGRSHTVALGRHILELKRDRVKKVANYLIMTTLGYAYDSKRARGEKWVRRYPACHLMVFEDLTRYRFRTDRPRSENRQLMRWTHQELIAVTGIQAEPHGISVGTMYAGFSSRFDAVTKAPGVRGATVRQILRTRGMVRLKEIAADVGIDINTLRPHDVLPTGDGEYLLSVVRHGESYRLKQVHADINAAHNLQRRLWTQDEVFRVSCRLALNSGRVVAMPPPSYNKRYGKGFFEKGDNGVYIWKTGGKIKISDTLEEDMDIPEDTAELLRGNSVTLFRDPSGTIAGGNWLEAKEFWGRVNSLVNKGVRDKILGGIPVDNSSAHAE

SEQ ID NO: 61903 - protein, 1090 aa, Laceyella sacchari
MSIRSFKLKLKTKSGVNAEQLRRGLWRTHQLINDGIAYYMNWLVLLRQEDLFIRNKETNEIEKRSKEEIQAVLLERVHKQQQRNQWSGEVDEQTLLQALRQLYEEIVPSVIGKSGNASLKARFFLGPLVDPNNKTTKDVSKSGPTPKWKKMKDAGDPNWVQEYEKYMAERQTLVRLEEMGLIPLFPMYTDEVGDIHWLPQASGYTRTWDRDMFQQAIERLLSWESWNRRVRERRAQFEKKTHDFASRFSESDVQWMNKLREYEAQQEKSLEENAFAPNEPYALTKKALRGWERVYHSWMRLDSAASEEAYWQEVATCQTAMRGEFGDPAIYQFLAQKENHDIWRGYPERVIDFAELNHLQRELRRAKEDATFTLPDSVDHPLWVRYEAPGGTNIHGYDLVQDTKRNLTLILDKFILPDENGSWHEVKKVPFSLAKSKQFHRQVWLQEEQKQKKREVVFYDYSTNLPHLGTLAGAKLQWDRNFLNKRTQQQIEETGEIGKVFFNISVDVRPAVEVKNGRLQNGLGKALTVLTHPDGTKIVTGWKAEQLEKWVGESGRVSSLGLDSLSEGLRVMSIDLGQRTSATVSVFEITKEAPDNPYKFFYQLEGTEMFAVHQRSFLLALPGENPPQKIKQMREIRWKERNRIKQQVDQLSAILRLHKKVNEDERIQAIDKLLQKVASWQLNEEIATAWNQALSQLYSKAKENDLQWNQAIKNAHHQLEPVVGKQISLWRKDLSTGRQGIAGLSLWSIEELEATKKLLTRWSKRSREPGVVKRIERFETFAKQIQHHINQVKENRLKQLANLIVMTALGYKYDQEQKKWIEVYPACQVVLFENLRSYRFSFERSRRENKKLMEWSHRSIPKLVQMQGELFGLQVADVYAAYSSRYHGRTGAPGIRCHALTEADLRNETNIIHELIEAGFIKEEHRPYLQQGDLVPWSGGELFATLQKPYDNPRILTLHADINAAQNIQKRFWHPSMWFRVNCESVMEGEIVTYVPKNKTVHKKQGKTFRFVKVEGSDVYEWAKWSKNRNKNTFSSITERKPPSSMILFRDPSGTFFKEQEWVEQKTFWGKVQSMIQAYMKKTIVQRMEE

SEQ ID NO: 61904 - protein, 351 aa, Tepidiphilus succinatimandens
MTNIAQRLLVGNGRQHLVRRRLRRRDAAGGKHILDGRDDLFEKPRPAEYVAAAQAHLPLGVRLRRGGHFESDRHDGIEFEKVRDIVDEGQRLAGVDETDRRCIACGKHRRFGDAVERCGGSRQAAIGSVGGLPGFGIVVTMHPAHFVAFGQPLVHFAHARPLDAAKLLDGASLRRLLTEANGEHAAHDFEAQLIVQGELCLIQQPVGTGTARLPGRIEANAGLTHPNEQGTHPRRERAGGMRDARAGLQHQAGHAAHGDMGAHPVDIHDDESAVEYANPAYTSQTCSCCGELGKRSKHRFECPHCGLRAHSDLNASRNLARIGSGAPLSRAVVNTPDVGSVDMGNHVCASQ

SEQ ID NO: 61905 - protein, 352 aa, Tepidiphilus succinatimandens
MTNIAQRLLVGNGRQHLVRRRLRRRDAAGGKHILDGRDDLFEKPRPAEYVAAAQAHLPLGVRLRRGGHFESDRHDGIEFEKVRDIVDEGQRLAGVDETDRRCIACGKHRRFGDAVERCGGSRQAAIGSVGGLPGFGIVVTMHPAHFVAFGQPLVHFAHARPLDAAKLLDGASLRRLLTEANGEHAAHDFEAQLIVQGELCLIQQPVGTGTARLPGRIEANAGLTHPNEQGTHPRRERAGGMRDARAGLQHQAGHAAHGDMGAHPVDIHDDESAVEYANPAYTSQTCSCCGELGKRSKHRFECPHCGLRAHSDLNASRNLARIGSGAPLSRAVVNTPDVGSVDMGNHVCASQY

SEQ ID NO: 61906 - protein, 1144 aa, Alicyclobacillus macrosporangiidus
VAVKSIKVKLMLGHLPEIREGLWHLHEAVNLGVRYYTEWLALLRQGNLYRRGKDGAQECYMTAEQCRQELLVRLRDRQKRNGHTGDPGTDEELLGVARRLYELLVPQSVGKKGQAQMLASGFLSPLADPKSEGGKGTSKSGRKPAWMGMKEAGDSRWVEAKARYEANKAKDPTKQVIASLEMYGLRPLFDVFTETYKTIRWMPLGKHQGVRAWDRDMFQQSLERLMSWESWNERVGAEFARLVDRRDRFREKHFTGQEHLVALAQRLEQEMKEASPGFESKSSQAHRITKRALRGADGIIDDWLKLSEGEPVDRFDEILRKRQAQNPRRFGSHDLFLKLAEPVFQPLWREDPSFLSRWASYNEVLNKLEDAKQFATFTLPSPCSNPVWARFENAEGTNIFKYDFLFDHFGKGRHGVRFQRMIVMRDGVPTEVEGIVVPIAPSRQLDALAPNDAASPIDVFVGDPAAPGAFRGQFGGAKIQYRRSALVRKGRREEKAYLCGFRLPSQRRTGTPADDAGEVFLNLSLRVESQSEQAGRRNPPYAAVFHISDQTRRVIVRYGEIERYLAEHPDTGIPGSRGLTSGLRVMSVDLGLRTSAAISVFRVAHRDELTPDAHGRQPFFFPIHGMDHLVALHERSHLIRLPGETESKKVRSIREQRLDRLNRLRSQMASLRLLVRTGVLDEQKRDRNWERLQSSMERGGERMPSDWWDLFQAQVRYLAQHRDASGEAWGRMVQAAVRTLWRQLAKQVRDWRKEVRRNADKVKIRGIARDVPGGHSLAQLDYLERQYRFLRSWSAFSVQAGQVVRAERDSRFAVALREHIDNGKKDRLKKLADRILMEALGYVYVTDGRRAGQWQAVYPPCQLVLLEELSEYRFSNDRPPSENSQLMVWSHRGVLEELIHQAQVHDVLVGTIPAAFSSRFDARTGAPGIRCRRVPSIPLKDAPSIPIWLSHYLKQTERDAAALRPGELIPTGDGEFLVTPAGRGASGVRVVHADINAAHNLQRRLWENFDLSDIRVRCDRREGKDGTVVLIPRLTNQRVKERYSGVIFTSEDGVSFTVGDAKTRRRSSASQGEGDDLSDEEQELLAEADDARERSVVLFRDPSGFVNGGRWTAQRAFWGMVHNRIETLLAERFSVSGAAEKVRG

SEQ ID NO: 61907 - protein, 601 aa, Tepidibacter thalassicus
MIRTIQVKLHNLSNYKQNLLDNLFQNYTKAYYEMLNYAKENLDVIEKDYKLKNGSYKGETIAKFFKGTEIHKKYNLEPLGDSLKKDVGCSIASYLELKQANADVSFPETNKDRINVLYEKINELLNEISFNTSLSKEQCHNLEQEIKNLYRKINNINKYRPISFARYDFNRDACLLYNPKKNSYYAKLYVFNKITSKEHVKLYKQKSIKHKDDIKLYYLPTLEIYKENRSIAYIIVPLAFGKWHERFLKQARKRKMKFCAMKLIKRGEDFYLDIPLNEDIETRAEKKKRYEEQNKNGEVLRKIKKKKKEFKNKLGIDLGITNIATIAVLDKDNNLLFSKQFNGNEYKEKFEIFVKKLAIMQMHGSSKYPRDKKYISGILHRVANEIIDLSKKYEAQIYLEDLNIDKSHERIKSTKKFENLPNKLVKRVVKNINRWAYGQMYRILVEKCEREGLPKLIRLNPRYTSENCSRCGHNEKVVSKGERVNRESQERFVCKNCGLQINADVNAAINIATKYSKVVSFKSKEVNGYKVINHELFDFKGIGKDNIEALNDFINKLREYKKEYDKIPFEIRKSDKKLRGQYKILKDVDREDYENYYNVED

SEQ ID NO: 61908 - protein, 660 aa, Unknown
  Microbial source - Accession No. JGII2383J13903_1002647
PKATSERTYRKINYKLLPGASKMLPKVFFSDKNTSYFSPDEEIQRIRNHGTHTKNGDPQEGYEKLDFNLNDCHKMIDFFKSSIQKHKDWKNFGFRFSPTYTYDSIDAFYREVEAQGYNITFTEIDESIIDRFVEEGKLYLFRIHNKDFSPFSKGRPNLHTLYWKAIFSPENLKNVIYKLNGQAEVFYRRKSIQPEQMVIHKSGEAIDNKNPLTGKKQSTFHYDLIKDKRYTVDKFQFHVPITLNFKASESNIINYEVLQYLRTQPDVHIIGLDRGERNLIYLSLINQKGELLYQEPLNALKSDKFNVVTNYQELLARREKERDMARKSWGTIENIKELKEGYLSGVVNKIATLMVKHNAILVMEDLNTGFKRGRFKIERQVYQKLEKMLIDKLNYLVFKDKSEDEPGGLFKALQLTNKFKSFKEIGKQNGFIFYVPAWNTSKIDPTTGFVNLFYIHYENMEKARAFFGKFQSISYNHDKGYFEFAFDYNDFTTKAEGCRTNWTVCTHGDRIRAFRNPEKNHQWDYKTIHITEEFMALFRKYGIEFSGNKDLREIITGQKDAAFYKSLLDLFRLTLQMRNTNQDWDYLISPVLNENGEFYDSRKADNHLPQDADANGAFHIAKKGLMWLKQIQQFEGDNWKKLDLDKTNKGWLRFAQGYQF

SEQ ID NO: 61909 - protein, 1151 aa, Unknown
  Microbial source - Accession No. JGI24108J20142_1001595
MPQQDKPPVTRRAYTLRLRGTDPSNTSWRKALWQTHEGVNKGAKKFGDWLLTLRGGLDHTLADAKVKVGKGKPDRDRTDEERKARRILLALSWLSVESKIGAPVGHIIASGEEVAEDRNSKVVAALEEILKSRGLANSEIKEWKNDCSASLSAAIRDDAVWVNRSKAFDDAVKSTVGSSLTREEAWDMLERFFGSRDAYLAPVKISEDESSEVEQEEKAKDLVQKAGQWLSSRFGTGKGADFSHMAKVYERIAAWTDNAQVGTTGNEAINNLAVALSEFIPASEDLKGVLGLISGPGYKSATRNLLKGLDTKTAVTQQDLESLKDKATTDSLKCEQNTGSKGQRPYSDAILNGVEAACGFTYLQDGGSARHSEFAVMLDHAARRVSLAHTWVKRAEAERRRFEEDAKKIAKVPTPARNWLDSFCLERSLASGALEPYRIRRRALGGWKEVVAAWAKSSCSSCEDRISEARKLQDDPEIDKFGDIQLFEALAEDDALCVWHKDGYPAKATDPQPLIDYVLATEAEFKKRDFKVPSYRHPDALLHPVFCDFGNSRWDICFEIHKNRQSPNPNALSVTLWTGSEIKPVSLRWQSKRLARDLALDQEAQGNGASEVTRADRLGRAASNVTKNDEVNIAGLFEQKDWNGRLQAPRQQLEAIAAVRDNLSLSAEERNRRMSGMMDHIRWLVTFSAKLQPKGPWLDYATTNDLKLDQKNGEIVATPSNSKNEWRGLAYPFWHSDNQEGRKGLAKHCLSRLPGIRVLSVDLGHRHAAACAVWEAVSAEQVKKACQIAGHEAPKASNLYLHLKRKATKQKKDNQVVIEETTVYRRIGADTLPDGTQHPAPWARLDRQFLIKLQGEEEGVRKASDEEVREVYQLEAEVGRTAPMDADDGEVRKPSLPVDELMSSAGRTMRLALKRHGDRARIAHYLITNEKIKPGGIKEKLDEEGRVDLLLDTLVMWHNLFSFHGWQDDEARQLWDNHVAKLSGYKAPERIGEECSGKSRKNKQQENREKLRDAAKALAKDITLRKALHEAWKKRWEDDDERWKKQLRWFKDWILPRGKHASDPTIRKVGGLSLTRLATLTEFRRKVQVGFFTRLQPDGTKAEIKERFGQSALDALEHLREQRVKQLASRITEAALGIGRMRRPAGGKDPK

SEQ ID NO: 61910 - protein, 625 aa, Unknown
  Microbial source - Accession No. JGI24721J44947_10029740
MLALKLKIMPTEKQAEILDAMFWKWASICSRIAKMKKKVSVKENKKELSKKIPSNSDIWFSKTQLCQAEVDVGDHKKALKNFEKRQESLLDELKYKVKAINEVINDESKREIDPNNPSKFRIKDSTKKGNLNSPKFFTLKKWQKILQENEKRIKKKESTIEKLKRGNIFFNPTKISLHEEEYSINFGSSKLLLNCFYKYNKKSGINSDQLENKFNEFQNGLNIICSPLQPIRGSSKRSFEFIRNSIINFLMYSLYAKLFGIPRSVKALMKSNKDENKLKLEEKLKKKKSSFNKTVKEFEKMIGRKLSDNESKILNDESKKFFEIIKSNNKYIPSEEYLKLLKDISEEIYNSNIDFKPYKYSILIRKPLSKFKSKKLYNLKPTDYKYYLQLSYEPFSKQLIATKTILGIDRGLKHLLAVSVFDPSQNKFVYNKLIKNPVFKWKKRYHDLKRSIRNRERRIRALTGVHIHENQLIKKLKSMKNKINVLYHNVSKNIVDLAKKYESTIVLERLENLKQHGRSKGKRYKKLNYVLSNFDYKKIESLISYKAKKEGVPVSNINPKYTSKTCAKCLLEVNQLSELKNEYNRDSKNSKIGICNIHGQIDADLNAARVIALCYSKNLNEPHFK

SEQ ID NO: 61911 - protein, 1317 aa, Unknown
  Microbial source - Accession No. JGI24721J44947_10039167
  misc_feature (1191)..(1191): Xaa can be any naturally occurring amino acid
  misc_feature (1193)..(1193): Xaa can be any naturally occurring amino acid
MPQQPTTQRAYTLRLRGADPNETSWREALWQTHEAVNKGAKVFGDWLLTLRGGLDHALADTKVKGKKGKPDRDPSAEERKARRILLALSWLSVESKLGAPADFIIASGEETAEARNAKVIAALEEILRSRDVAEEAIGDVTKKPEDQPGTWIGDCAPSLTAAIREDAVWVNRSKAFDEAVKSIGSSLTREEAWDMLERFFGSRDAYLAPAKGSEDESSETEQEDKTKDLVQKAGQWLSSRFGTGKGADFCRMADVYKKIAEWADNAQADTTGNDAINNLAAFLSEFNPASNDLKGVLGLISGPGYKSATRNLLTQIAAKATVTQQDLARLKDTATEDARKCYQNTGSKGQRRYADSILKDVESVCGFTYLQEGGPARHSEFAVILDHAARRVSLAHTWIKRAEAERRKFEEDAKKIGQVPKAAKDWLDQFCLERSGVSGAQEPYRIRRRAVDGWKEVVTAWSKADCKTAEDRIAAARALQDDPEIDKFGDIQLFEALAEDDAVCVWHKDGDAAKTPDPQPLIDYALAAEAEFKKRHFKVPAYRHPDALLHPIFCDFGKSRWDICFDVHKNTKTPFPRTLCLTLWTGSEMVSVPLCWQSKRLARDLALDHGRQDLGSPKVTRADRLGRAASNVTENDEVKIAGLFEQADWNGRLQAPRQQLEAIARYVAKNGWDEKAKKMRDAIQWLVTFSAKLQPNGPWCAYAEEHNLNKDPQYWPHADTNKDRKSHARLILSRLPGLRVLSVDLGHRYAAACAVWEALSDKAFKEDLEGKKIIRGGTSDNSLYCHTEHEVNGKKHITIYRRIGADTLPDGTPHPAPWARLDRQFLIKLQGEEEGVREASNEEIWQVHQMECTLGRKTPLIDRLVAAGWGSTEKQKARLDALKNLGWKPVEKAETSEDADTEEEELSFRPSLSVDELMSSAVRTMRLGLKRHGDRARVAYYLITDEKTKPGGIKEKLDENGRIDLLQDALVIWHDLFSSRGWRDDAAKRLWDENIARLCGYKAPEEIGENASGVERKTKQKENREKLHGVAKALAQDVTLRKALHDAWKKRWEEDDGRWKKQLRWFKDWVLPRGKHASDPTIRKVGGLSLTRLATLTEFRRKVQVGFFTRLHPDGTRAETGEKFGQSALDALEHLREQRVKQLASRIVEAALGIGRMKRPAKGKDPKRPEVRVDEPCHAIVIEDLTHYRPXEXRTRRENRQLMDWASSKVKKYLSEACQLHGLHLREVSAAYTSRQDSRTGAPGIRCEDVPVKDFLNLPFWKKEVKSAESKDDAQSKYFIALCEKASVMTEEEKKKTSFRIPRRGGEIFVSADETSP

SEQ ID NO: 61912 - protein, 430 aa, Unknown
  Microbial source - Accession No. JGI26463J51803_1000081
MGRVNRYRVLREAQGFRALRILADRVSRLWNAAQFLSRQRYLAGEPVPSYAELCATFQAHESYKALPSDVAQETLKKVRESWKAYFEALRAYREGRVHNPPGLPGYWKDRKTGHRLVRCIPIKHPRSYRVADGILEIPLPPDLRGPEGTRLRLRIRGAKRWHGKEGRLELVWDSARRAWYASQSVEVQCTAHTERPRKFAAVDRGARVPVALAVEGSQEAWVFRSRELWKDYRNLAGRIYRLQALLATRGQHTSRKLRRLFGRRRERVLAAYRALARTVVRILQKTKVTDLLVGDLTGIREDMDFGKLNELVHNFWSFRELASALLDACERAGIRVHLVPEQGTSSHCAVCGQNVVRPLRSRVRCPAGHEIHADVNGALNLLYREPEVRARAEGRPRWCTYRWNGHRWVPTESARRSAQDPGSLQAAPAA

SEQ ID NO: 61913 - protein, 1489 aa, Desulfatirhabdium butyrativorans
MPLSNNPPVTQRAYTLRLRGADPSDLSWREALWHTHEAVNKGAKVFGDWLLTLRGGLDHTLADTKVKGGKGKPDRDPTPEERKARRILLALSWLSVESKLGAPSSYIVASGDEPAKDRNDNVVSALEEILQSRKVAKSEIDDWKRDCSASLSAAIRDDAVWVNRSKVFDEAVKSVGSSLTREEAWDMLERFFGSRDAYLTPMKDPEDKSSETEQEDKAKDLVQKAGQWLSSRYGTSEGADFCRMSDIYGKIAAWADNASQGGSSTVDDLVSELRQHFDTKESKATNGLDWIIGLSSYTGHTPNPVHELLRQNTSLNKSHLDDLKKKANTRAESCKSKIGSKGQRPYSDAILNDVESVCGFTYRVDKDGQPVSVADYSKYDVDYKWGTARHYIFAVMLDHAARRISLAHKWIKRAEAERHKFEEDAKRIANVPARAREWLDSFCKERSVTSGAVEPYRIRRRAVDGWKEVVAAWSKSDCKSTEDRIAAARALQDDSEIDKFGDIQLFEALAEDDALCVWHKDGEATNEPDFQPLIDYSLAIEAEFKKRQFKVPAYRHPDELLHPVFCDFGKSRWKINYDVHKNVQAPFYRGLCLTLWTGSEIKPVPLCWQSKRLTRDLALGNNHRNDAASAVTRADRLGRAASNVTKSDMVNITGLFEQADWNGRLQAPRQQLEAIAVVRDNPRLSEQERNLRMCGMIEHIRWLVTFSVKLQPQGPWCAYAEQHGLNTNPQYWPHADTNRDRKVHARLILPRLPGLRVLSVDLGHRYAAACAVWEAVNTETVKEACQNVGRDMPKEHDLYLHIKVKKQGIGKQTEVDKTTIYRRIGADTLPDGRPHPAPWARLDRQFLIKLQGEEKDAREASNEEIWALHQMECKLDRTKPLIDRLIASGWGLLKRQMARLDALKELGWIPAPDSSENLSREDGEAKDYRESLAVDDLMFSAVRTLRLALQRHGNRARIAYYLISEVKIRPGGIQEKLDENGRIDLLQDALALWHELFSSPGWRDEAAKQLWDSRIATLAGYKAPEENGDNVSDVAYRKKQQVYREQLRNVAKTLSGDVITCKELSDAWKERWEDEDQRWKKLLRWFKDWVLPSGTQANNATIRNVGGLSLSRLATITEFRRKVQVGFFTRLRPDGTRHEIGEQFGQKTLDALELLREQRVKQLASRIAEAALGIGSEGGKGWDGGKRPRQRINDSRFAPCHAVVIENLANYRPDETRTRLENRRLMTWSASKVHKYLSEACQLNGLYLCTVSAWYTSRQDSRTGAPGIRCQDVSVREFMQSPFWRKQVKQAEAKHDENKGDARERFLCELNKTWKAKTPAEWKKAGFVRIPLRGGEIFVSADSKSPSAKGIHADLNAAANIGLRALTDPDWPGKWWYVPCDPVSFESKMDYVKGCAAVKVGQPLRQPAQTNADGAASKIRKGKKNRTAGTSKEKVYLWRDISAFPLESNEIGEWKETSAYQNDVQYRVIRMLKEHIKSLDNRTGDNVEG

SEQ ID NO: 61914 - protein, 1142 aa, Tuberibacillus calidus
MNIHLKELIRMATKSFILKMKTKNNPQLRLSLWKTHELFNFGVAYYMDLLSLFRQKDLYMHNDEDPDHPVVLKKEEIQERLWMKVRETQQKNGFHGEVSKDEVLETLRALYEELVPSAVGKSGEANQISNKYLYPLTDPASQSGKGTANSGRKPRWKKLKEAGDPSWKDAYEKWEKERQEDPKLKILAALQSFGLIPLFRPFTENDHKAVISVKWMPKSKNQSVRKFDKDMFNQAIERFLSWESWNEKVAEDYEKTVSIYESLQKELKGISTKAFEIMERVEKAYEAHLREITFSNSTYRIGNRAIRGWTEIVKKWMKLDPSAPQGNYLDVVKDYQRRHPRESGDFKLFELLSRPENQAAWREYPEFLPLYVKYRHAEQRMKTAKKQATFTLCDPIRHPLWVRYEERSGTNLNKYRLIMNEKEKVVQFDRLICLNADGHYEEQEDVTVPLAPSQQFDDQIKFSSEDTGKGKHNFSYYHKGINYELKGTLGGARIQFDREHLLRRQGVKAGNVGRIFLNVTLNIEPMQPFSRSGNLQTSVGKALKVYVDGYPKVVNFKPKELTEHIKESEKNTLTLGVESLPTGLRVMSVDLGQRQAAAISIFEVVSEKPDDNKLFYPVKDTDLFAVHRTSFNIKLPGEKRTERRMLEQQKRDQAIRDLSRKLKFLKNVLNMQKLEKTDEREKRVNRWIKDREREEENPVYVQEFEMISKVLYSPHSVWVDQLKSIHRKLEEQLGKEISKWRQSISQGRQGVYGISLKNIEDIEKTRRLLFRWSMRPENPGEVKQLQPGERFAIDQQNHLNHLKDDRIKKLANQIVMTALGYRYDGKRKKWIAKHPACQLVLFEDLSRYAFYDERSRLENRNLMRWSRREIPKQVAQIGGLYGLLVGEVGAQYSSRFHAKSGAPGIRCRVVKEHELYITEGGQKVRNQKFLDSLVENNIIEPDDARRLEPGDLIRDQGGDKFATLDERGELVITHADINAAQNLQKRFWTRTHGLYRIRCESREIKDAVVLVPSDKDQKEKMENLFGIGYLQPFKQENDVYKWVKGEKIKGKKTSSQSDDKELVSEILQEASVMADELKGNRKTLFRDPSGYVFPKDRWYTGGRYFGTLEHLLKRKLAERRLFDGGSSRRGLFNGTDSNTNVE

SEQ ID NO: 61915 - protein, 454 aa, Azospirillum sp.
MAEASPNRTVMRTFKFRLYPTAEQDARMRSWCGAVRAVYNAALQQRQWYGRPAGTDWHRRDCRFNANRQSLDLKHARAEFDCLADCPADILMAGLRDLDKAFQNFFAGRARYPSPRRKHQNESFQFRVFQHRKSETHPFYMLVVFGRDSVKLPKIGRIEWVKHAHIRGEAKTATVVREGDRWFICVAAEIVLTPRPAPGGAVGIDVGVAVPLMTSEGEALAVDRTPPHLEKRRRRLQRELSRCRRGSRRRAKRREKLAVIARRISARRKAQLHQVTTDLASRYGLVAIEDLRVRNMTASAAGTVEQPGCNVKAKAGLNRSLLDVSPGQFRLLLTYKVTARGGMVVAVDPRDTSRTCPACGHVDAENRRSQAEFRCVRCGHEDNADANAARNILRRALATLSSATVSGRRKAPSEPRRRSATPKPSVSPSRAGQPSESQVQPKGMIVPDQLLVPG

SEQ ID NO: 61916 - protein, 1501 aa, Oscillatoriales cyanobacterium
MPQQAKPPVTQRAYTLRLRGADSNDPSWRDALWQTHEAVNRGAQAFGDWLLTLRGGLDHTLADTPVKGGKGKPDPDPTDEERKARRILLALSWLSVESKLGAPAGLIIAFGTEAAEERNRKVVAALEEILKSRGVDQNEINAWKKDCSASLSAAIRDDAVWVNRSKAFDEAVESIGSSGSSGSSLTREEPWDMLERFFGSRDAYLAPAKGSEDESSEAKQEDQAKDLVQKAGQWLSSRFGTGKGADFRRMATVYEAIAKWDGKASLEMAGDKAIADLATALSEFNPASNDLQGVLGLISGPGYKSATRNFLNQLAAQTTVTQQDFVSLKDKANNDAQECKQNTGSKGQRPYSNSILEKVESVCGFTYLQDGGPARHSEFAVILDHAARRVSLAHTWIKLAEAERRKFEEDAKKIDQVPEAAKDWLDRFCLERSGVSGALEPYRIRRRAVDGWKEVVAEWSKSDCKTVEDRIAAARALQDDPEIDKFGDIQLFEALAEDDAVCVWHKDGDAAKAPDPQPLIDYALAAEAEFKKRHFKVPAYRHPDALLHPIFCDFGKSRWDICFDVHKNMQTPFPRALCLTLWTGSEMKRIPLCWQSKRLARDLALGNNTGDAGASEVTRADRLGRAASRAASNVTKSDVVNIAGLFEQADWNGRLQAPRQQLEAIARYVEKHDWDQKAEKMRNAIQWLVTFSARLQPQGPWCAYAKIHGLKEDPQYWPHADTNKNRKGHARLILSRLPGLRVLAVDLGHRYAAACAVWEALSTEAFQREIKGRTILRGRTDGNALYCHTRHKANGKERVTIYRRIGADTLPDGKPHPAPWARLDRQFLIKLQGEEEGVREASNEEIWAVHQLEAALGRPVSLIDRLVASGWGGSDKQKARLEGLKQLGWDPADKPSLSVDELMSSAVRTMRLALKRHGDRARIAHYLITDEKTTPGGIKETLDEKGRIDLLQDALVLWHDLFSSRGWRDDTAKQLWNAHVAKLHGYKAPEEPGEDSSGAERKKKQRENREKLYDVAKALAQDVTLREALHDAWKKRWENDDERWKKQLRWFKDWVFPRGNHASDPTIRKRQLINPSGGNGRRGNHASDPTIRKRQLINPSGGNGRRGNHASDPTIRKVGGLSLPRLATLTEFRRKVQVGFFTRLKPDGTRAETKEQFGQSALDALEHLREQRVKQLASRIAEAALGVGRVRRPVEGKDPKRPDVRVDEPCHAIVIEDLTHYRPEETRTRRENRQLMTWSSSKVKKYLAEACQLHGLHLREVSASYTSRQDSRTGAPGVRCQDVPVKEFMRSPFWRKQVKQAEAKQAANKGDARERLLCDLNARWKDRTAADWEKAGAVRIPLQGGEIFVSADANSPAAKGIQADLNAAANIGLRALTDPDWAGKWWYVPCDPASFRPVRDKVDGSAVVNPDQPLRQSAQAQSGDAAKDKNGNKGAGKSKEVVNLWRDISSSPLECIEFGEWKEYAAYQNEVQCRVIRILKEQIKGRDKQPHEGSKEDDIPL

SEQ ID NO: 61917 - protein, 1188 aa, Unknown
  Microbial source - Accession No. 49155357
MPQQDKPPVTRRAYTLRLRGTDPSNTSWRKALWQTHEGVNKGAKKFGDWLLTLRGGLDHTLADAKVKVGKGKPDRDRTDEERKARRILLALSWLSVESKIGAPVGHIIASGEEVAEDRNSKVVAALEEILKSRDLANNEIEEWKNDCSASLSAAIRDDAVWVNRSKAFDDAVKSTVGCSLTREEAWDMLERFFGSRDAYLAPVKISEDESSEAEQEDKAKDLVQKAGQWLSSRFGTGKGADFSHMAKVYERIAAWTDNAQVGTTGNEAINNLAVALSEFIPASEDLEGVLGLISGPGYKSATRNLLKGLDTKAAVTQQDLENLKDKATTDSQKCEQNTGSKGQRPYSDAILNGVEAACGFTYLQDGGSARHSEFAVMLDHAARRVSLAHTWVKRAEAERRRFEEDAKKIAKVSTPAKNWLKSLEVERSLTSGALEPYRIRRRALGGWKEVVAAWAKSSCTSYEDRISEARKLQDDPEIDKFGDIQLFEALAEDDALCVWHKDGDPAKATDPQPLIDYVLATEAEFKKRNFKVPSYRHPDALLHPVFCDFGNSRWDICFEIHKNRQSLNPNALSVTLWTGSEIKPVSLRWQSKRLARDLALDQEAQGNGASEVTRADRLGRAASNVTKNDEVNIAGLFEQKDWNGRLQAPRQQLEAIAAVRDNLSLPSEERDRRMSGMMDRIRWLVTFSAKLQPKGPWCEFAEKLHLKIDPQYWPHADINKNRKGLARLMLSRLPGLRVLSVDLGHRHAAACAVWEAVSAEQVEKACRIAGHESPKASDLYLHLKRKATKQKKGNQVVVEETTVYRRIGADTLPDGTQHPAPWARLDRQFLIKLQGEEEGVRKASNEEIWKVYQLEAEVGRTAPIIDRLFKAGWGRSGQQRVRLEALRELGWRPASEAEISDDMDAEEGEVRKPSLSVGELMSSFVHTMRLALKRHGDRARIAHYLITDEKIKPGGIKEKLDTEGRVDLLLDALVMWHNLFSFHGWRDDEARQLWDKHVAKLSGYKAPERISEECSGKSRKNKQRENREKLRDAAKALAKDITLRKALHEAWKKRWEDDDERWKKQLRWFKDWILPRGKHANDPTIRKVGGLSLTRLATLTEFRRKIQIGFFTRLKPDGTRAEIKERFGQSTLDALEHLREQRVKQLASRITEAALGIGRMRRPAGGKDPKRPGVSVDEPCHACCRNLL

SEQ ID NO: 61918 - protein, 449 aa, Candidatus Staskawiczbacteria
MAKGEKNNDVLYRAVKFEIRPTLNQETILQRISSNLRLIWNEAWKERQDRYEIFFKPIYERIYNAKKKALEKGFTDLWEKEVAKFSQQVLVKRGFPLQLVLEQKSLFAELKKAFEEHGITLYDQINALTAKRSLNTEFGLIPRNWQEETLDALDGSFKSFFALRKRGDKDAKPPSERTNEDSFYKIPGRSGFKVTDDGKVIVSFGKLSETLVGRIPEYQQEKLSHAKNLKKFEIVRDERDMAKSGCFWISIAYEIPKPPELPFNPSKAVFLAIGASWIGIISPRGEFCWRMPRPDFHWKPKINAVDERLKRVSKGSIKWKRLIFARSKMFAIMARQQKQHGQYEVIKRLLELGVCFVVTDLKVRSKEGSLADSSKAERGGSPFGANWSAQNTGNIANLVAKLTDHVSALGGMVIKRKSPELLVEEKRLPQEKRKILLAQKLKDEFLSLN

SEQ ID NO: 61919 - protein, 352 aa, Candidatus Staskawiczbacteria bacterium
MQLVSEKESLLQELSIAFQEHGVTLYDQINGLTARRIIGEFALIPRNWQEETLDSLDGSFKSFLALRKNGDPDAKPPRQRVSENSFYKIPGRSGFKVSNGQIYLSFGKIGQTLTSVIPEFQLKRLETAIKLKKFELCRDERDMAKPGRFWISVAYEIPKPEKVPVVSKQITYLAIGASRLGVVSPKGEFCLNLPRSDYHWKPQINALQERLEGVVKGSRKWKKRMAACTRMFAKLGHQQKQHGQYEVVKKLLRHGVHFVVTELKVRSKPGALADASKSDRKGSPTGPNWSAQNTGNIARLIQKLTDKASEHGGTVIKRNPPLLSLEERQLPDAQRKIFIAKKLREEFLADQK

SEQ ID NO: 61920 - protein, 1152 aa, Unknown
  MTKY01071110.1_o | Anaerobic digester metagenome soeholt_digester_71110
LALSWLSVESKLGAPAGFIIASGTEAAEDRNGKVVAALEEILKSRNLAENEIDEWKNDCSASLTAAIRDDAVWVNRSRAFDDAVESVGCSLTREEAWDMLERFFGSRDAYLAPAKVTEDESSEEEQEEKAKDLVQKAGQWLSSRFGTGKGADFSRMAAVYGKIAAWADNAQAGTTGNQAINKLAADLSEFTPASNDLQGVLGLISGPGYKSATRNLLNGLATKTTVTQQDFGSLRDKAADDAQKCKQNTGSKGQRPYSDAILKDVEAVCGFTYLQQDGGAARHSEFAVILDHAARRVSLAHTWIKRAEAERRRFEEDTQRLANVPGPVKAWLDSFCSERSATSGALEPYRIRRRAVDGWKEVVTAWSKSSCSTSADRIAAARALQDDPEIDKFGDIQLFEALAEDDAVCVWHKDGDAAKAPDPQSLIDYALAAEAEFKKRHFKVPAYRHPDALLHPIFCDFGKSRWDICFDVHKNVQTPFPRALCLTLWTGSGMVSVPLCWQSKRLARDLAIGSNATNAGYVEVARADRLGRAASNVTKSDEVKISGLFEQADWNGRLQAPRQQLEAIAVVRDNLSLSAQERERRMSSMKDRIRWLVTFSAKLQPQGPWCEFAKTNQLRIDPQYWPHADSNKTRKGQARLILSRLPGLRVLSVDLGHRYAAACAVWEAVNAEQVKKACQVAGHEAPKASDLYLHLKRKATKRKKGNQVVVEETTIYRRIGADTLPDGTQHPAPWARLDRQFLIKLQGEEEGVREASNEEVLKVYHLEAELGRTAPIIDRLVKAGWGQSGKQRTRLEALRELGWKPASEAVVSDGMGADEGEVRKPSLSVDELMSSAVRTMRLALKRHGDRARIAHYLITDEKTRPGGVKEKLNENGRIDLLQDALLMWHDLFSSRGWRDDVARQLWDNHVAKLSGYKAPEEIGEESSGPERKKRQKENREKLHDVAKALAQDVTLREALHDAWKKRWKDDDERWKKQLRWFKDWVLPRGKHASDPAIRKVGGLSLPRLATLTEFRRKVQVGFFTRLQPDGTRAETKEQFGQSALDALEHLREQRVKQLASRIAEAALGIGRMRRPMGGKDPKRPNGRVDEPCHAIVIEDLTHYRPEETRTRRENRQLMTWSSSKVKKYLAEACQLHGLHLREVSASYTSRQD

SEQ ID NO: 61921 - protein, 412 aa, Microcystis aeruginosa
MKLVQRHLIKFNKKNYLAFDKLAFLSKNLYNCAVYLNRQAFFSHQPFLTMTELHHALKTSADYQALPAKVSQLVLKQVEKTFKSYQKAEEQFKKSPNKFTGEPKLPRYKDKKKGRNVLTYNYQAISKKALKQGLIKLSGTNLEFKTNLKEVLEVRIIPKSGAYYLEIVYEQPSPPSQEGERYAFVDLGLNNLAAVTSNIPEFQPTLLCGKALKSCNQKYNKTLAKLKSELPSLQKTSKRIQGLTLKRNCQVDYYLHTASRYIIDKLLAHQINLLVIGQNQGWKQNLNIGDRNNQSFVNIPHSRFIEQLTYKAILVGIKVITTNESYTSKCSFLDLEPIGKQEKYLGKRVKRGLFRSSSGYLYGADINGSLNIGRKVVGEVAFSKNPIERLVVSPVRVKAYKADSKCDVCVQN

SEQ ID NO: 61922 - protein, 421 aa, Unknown
  NICF_comb_assmDRAFT_10010420 | GENOME_ACCESSION
MFTKVMRYQIVKPIDVDWDIFGHILRELQHETRIALNKTIQLAWEYHGFSSEYKEKFGKSPNNREVLGYTYLHGYAYDRIKSECWKLSTSNLTQTVKRAADKWRADLPEIIRGEKSIPSFRRDVPIDIVSQSLDISKEEDDYFLDISLISTQYRKQLGRKTGKFRVLIHTGEKSKRAILDRLIDGTYKLGVSQILYHKKKWFINITYQFEGKSLPLDPDTIMGVDLGVTNAVYMAFNNSLHRYKIVGGEIEQFRKQIERRRRELLIQSKYAGEGRSGHGTKTKIAPIEVLEKKAANFKSTVNHKYARYIVNMALKHRCGTIQLEDLSGIREENTFLANWPYHDLQQKIEYKAKEVGIRVVKINPEFTSQRCSRCGHISKENRPDQATFECTKCGLKTNADFNAAKNIATRGIEDLIRQAKS

SEQ ID NO: 61923 - protein, 480 aa, Archaeoglobales archaeon
LQPDKLEREQAIKITVKGVISPRDEGIRTLLQEYKVYKKVLISRISESIKTVIKDKNIRVYSLQKYLLQKKIIEYLKNLPYHPMPYGNQSYWIEERDGKFLIHIKTKNGESVCYLQVPNKYRTLMKKASGKVCPHMNEGKCEFTICPFKTSKMCNKINPYRGEMKLIEDKKYGWINCHITLRLPKPEPYEPKGWIGVDVGWNYLAVSAYVSNEGKISHVTFHGKEWKTRIIQLKYLLKMFQRTGKSTKVWRHRLRNVTNYTVGVIAKEIVRKAKKLKAGVAVEKLTFQAHTKRWLIPRYKLRCAIKNLCERKGIPFVEVSAKNTSIKCNKCGYIDEKNRNGKIFKCLKCKYTCNADFNAAVNIAKKAIEKYKKEKLKAAGKTAIPASYTDAGKDPHAKMTHPQKDVDGVAGRGMLRAPKAPMTNDQPIDDPYKREGNPSIIEDHTQRKAIKTTKQQKLTKYLHLQKQQKITKNRSRKTIE

SEQ ID NO: 61924 - protein, 505 aa, Unknown
  Microbial Source - OGCG01005283.1_o | hot springs metagenome genome assembly
MNTDSKRVLIVRLNPTRDEQIYLISLIKAYTSIAKKLHTDAYAKFKELTANGVIENIKQLKDVKKKFYSWYNEYFKTQRKWITDALGSNVTDQLFQFLRGQYENFFANYENFFKHKIEGRPSFPNLPELFQIRDRGVAIDFDRKILTIKLKGKRLSLRFQADRLLYRGEPGSVTIKQQDGRFYAYIPFDFTPKFEEGKKGAIDIGLVNFFATVTEDGDVILVKAKEYAYVYKKYKEKIKELDRLIGKIKKHILRMYFTPPKSFRRYPFLGFTNNRQVSKIITSLYTSWYDVGRAKKKRLRREDMTSIVKKIRKVDYRLRITKLNFVKSDGSVKLFPKKSPFVRDVYKDLPILHKLEYEKKKLFEKRDRTLTHIRRTAINALLRILRERGVTHVVVGHPYNINKNRNELTVNLFQYRKTINDLKIIGERYGIKVDEIVEYNTSIRCSICGEVHKNGRIERGLYRCEKTGKVINADVNSALNIFYKAFSKMPKQLKKIETIKLHFFT

SEQ ID NO: 61925 - protein, 537 aa, Unknown
  Microbial Source OGCG01007631.1_o | hot springs metagenome genome assembly
VPAKTPSDKNNGKQSRKKENDNKRALTVKLNPTRDDQIYLTSLIKTYTAIANKLNKDAFAKFKELTSNGEIRNIADLKDIKKEFNWWFNEYYKTQRRWITDNLGSNIADQLFKFLTAQYSNFFANYENFFKHKMEGRPSFPSLPELFQIRDRGVEVDFDKKILIIKLKGKQLRLKFQSDRLLYQGDPGSVTIKKVDGKFYAYIPFDFNPKIEEGKKAAIDIGLVNFLATVTEDGDVILVKAKQYTYTYSKYKDRIKELDRMIGNIRKHTLKMYVYPPKSFTYYHFLGFTNDRRIRKIIISLYTSRYDDKRGKKKKLTREDMTNIVKEIHKVNYRLRVRRLNFMKTIGHIKLFPKKSRYMNDVFQDLPILHKLEYERRKLYEKRDRTLRHIRRTAINALLRILKQRGVTHIVVGYPRYINKNRNELTVNLFQYRKTINDLKIIGQRYGMKVEELEEYGTSITCSICGQEHKSGRIERGLYKCEKTGKTINADVNGALNIFYKAFSKMPKQLKKTETIKLTFTPLQRNVTLSPLYYRKL

SEQ ID NO: 61926 - protein, 413 aa, Unknown
  Microbial source - OKRQ01000045.1_o | freshwater metagenome genome assembly
MMKLVQKHLIKFNHKNYSVIDKLGFLSKNLYNCAVYLNRQVFFSHQPFLTMTELHHALKMSPDYQALPAKVSQLVLKQVEKTFKSYQKAKEQYKKSPDKFTGEPKLPRYKDKEKGRNVLTYNYQAISQKALKQGLIKLSGTNLEFKTNLKEVLEVRIIPKLGAYCLEIVYEQPSSSSQEGERYAFIDLGLNNLAAVTSNIPEFQPTLVCGKALKSCNQKYNKTLAKLKSELPSLQKTSKRIQGLTLKRNCQVDYYLHTASKYIIDKLLAHQINLLVIGHNQGWKQNINIGDRNNQSFVNIPHSRFIEQLTYKANLVGIEVKTTNESYTSKCSFLDLESIQKQKSYLGKRIKRGLFRSSSGYFYGADINGSLNIGRKVVGEAAFSGNPIERFVVNPVRVKAYKANSRCNICVQN

SEQ ID NO: 61927 - protein, 1592 aa, Unknown
  Microbial Source - OQOO01000421.1_o | human oral metagenome genome assembly
RSTLFPYTTLFRSGRREVRRRLNERSRALTSRILNALRRVHQRPKHRAGLPRAAKRRQLRDDRHDRERNRQRAARGGRRNSRRNPAEASSGRRREHVEEQLPHGMRDVDTTKGQERVGMFDRRIGRRLTMPKQDKPSVTQRAYTLRLRGADPSDTSWRDALWRTHEAVNKSAKAFGDWLLTLRGGLDHTLADARVKGGKGKPDRDPADAERKARRILLALSWLSVESKLGAPEGYIVASGEEAPENRNGKVVAALEEILKNRNLADNEIGEWKKDCSSSLSAAIRGDAVWVNRSKAFDEAVKSIGCSLTRDEVWDMLERFFGSRDAYLAPAKGSEDESSETEQGNKAKDLVQKAGQWLSSRFGTGKGADFCRMADVYGKIAAWAGANKSNGSATVDDLAKELQKELQIEESKATDGLDWIIKLSSYPGHSPNPVHELLRQNPKLARSNLDDLEKTANTRAESCRSKIGSKGQRPYSDAVLKDVEAVCEFTYLQKDGPARHSEFTVILDHAARRVSLAHTWIKRAEKERSKFEEDAKKIGQVPKAAKDWLHKFCTERSQASGALEPYRIRRRAVDGWKEVVAAWSERSCNTSADRIAAARALQDDPEIDKFGDIQLFEALAEDDAACVWHKDGDAAKAPDPQPLIDYALAAEAEFRKRHFKVPAYRHPDALLHPVFTDFGESRWKICFDVHENLETASPHALSLKLWTGSEVVPVPLRWQSKRLARDLALGQDAQKDGALEVARADRLGRAASNVTKSDEVKISGLFEQADWNGRLQAPRRQLEAIAVVRDNLSLSDQERERRMSGMMDRIRWLVTFSAKLQPQGPWYEFAKTNQLRIDLQDWPHADSNKTRKGHARLILSRLPGLRVLSVDLGHRYAAACAVWEAVNAEQVEEACKDAGHEAPNANDLYLHLKRKATKKQKKDKKIEVEKTTIYRRIGADTLPNGTPHPAPWARLDRQFLIKLQGEKEGVREASNEEVWKVHQLETELGRTTPLIDRLVASRWGGSDKQIARLEELKKLGWNSAEKSDPNGESDEGESRRPSLSVDELMSSAVRTMRLALKRHGDRARIAHYLITDEKTKPGGTKEKLDESGRVDLLQDALVMWHDLFSSHGWEDKAAGQLWGEHVAKLSEYKAPEEIDEGSSVIERKKKQKENREKLYDVAEALAQDETLRKALHDAWKKRWEEDDEQWKKRLRWFKDWILPRGKAANDPAIRKVGGLSLPRLATLTEFRRKVQVGFFTRLHPDGTRAEAKEQFGQKTLDALEHLREQRVKQLASRITEAALGIGSEGGKGWDGGKRPRQRIDDPRFAPCHAIVIEDLTRYRPEETRTRRENRQLMSWSSSKVKKYLAEACQLHGLHLREVSASYTSRQDSRTGAPGIRCQDVPVDEFMRSPFWRHQIAQAEKKQSGGKGDARERFLCDLNARWKDKSEADWKKAGAVRVPLKGGEIFVSADPASLAAKGLQADLNAAANIGLRALIDPDWPGKWWYVPCDPVSFRPIKDKVAGSAAVKLDQALRQPAQAQSGDAKAKKKREKKDAGKPQEVVNLWRDISSSPLGESGEWKEYAAYRNQVQVRVVDILRRAVCSKNNREKQ

SEQ ID NO: 61928 - protein, 521 aa, Unknown
  Microbial Source - OQUW01.1 | hot springs metagenome genome assembly
MKTFKVKLYPTESQSRRMEQWLITLQRHYNRVLAITLWTQRRYNLPVSKSICGGLKTPKKDGDKRPYIYGIYVAAKRRNQFLNDIPADTVNQTIQSRIEAAFDKWAAACKGKKGEDFFKGQPKFANRDRFTSFQFRTRPPRPLFTYDHKGRRYLNIPNAQGADKIGPILCSLSPDTPSDFTKSFCAIQREPDGWYACIVINLENQVRWDKAPHGVVGIDVNIGSIDLSDGTRIPMPFFADRYRDEVLRLTQKLARTRRENKDWRSSKRYADAKKRKAVLEARITRERKAWHANVVAWLVSRYDRIYVENLEPKNMVKNKHLAKAISSQAWGHFFEMLEMKCAEHGRIFGRVPPSYTSKTCSSCGWVNKAKPGEKGYMGLHVRQWVCPECQTHHNRDVNAAKNICAKGEEAFATGNYEKQELGKRKAKSNSKVLLTERTEAKAGTIIIPCPTLDLPTPPNLPAHKRRSKAEWSAKQRAERARRRNKNAKKEKLTSVDLNGQKKNFNGRKEKLANSTQLSLFC

SEQ ID NO: 61929 - protein, 1434 aa, Unknown
  Microbial Source - OQUW01000094.1_o | hot springs metagenome genome assembly
MDKQVAVTQRAYTLRLQGADPQDQSWREALWQTHEAVNKGARAFGDWLLTLRGGLDHTLADAKVKGGKGKPDRDPTNEERRDRRILLALSWLSVESAPKDGDTRKPFVTATGQDSQAIREEKVLCALRGILEKRGVRGADLEGWIKDCTPSLSAAIRDDAVWVNRSEAFDKAVDSIGSSLTRDEVWDMLERFFGSRQAYLAPAEGAEDESAEAEQEDKAKDLVQKAGQWLSSRFGTGKGADFSRMAAVYEKIADWAGKARAGMTGDAAVAGLAAALSEFSPASNDLQGVLRLISGPGYKSATRNLLNQFAARPSVAQEDLENLRDSACDDAEKCKANTGSKGQRAYADAILKDVESVCGFTYLQDGGPARHSEFAVMLDHAARRVSLAHTWIKRAEAERRRFEEDARRMDKVPASVKAWLDGFCLERSEASGALEPYRIRRRAVDGWKELVAAWSNADCRTAEDRIAAARALQDDPEIEKFGDIQLFEALADDEALRVWHKDGDSAKAPDPQLLIDYVLATDAEFKKRQFKVPAYRHPDALLHPVFCDFGNSRWDISFDVHEAVKTGGRNRKNMMVPQDPHALSMTLWTGSTVEPQRLRWQSKRLARDLALKGRQGSNAPEVTRADRLGRAAADVPARATVRIAGVFEQEDWNGRLQAPRAQLDAIAARVARHGWDDKARQMRDHLRWLITFSAKLQPSGPWLDYAAAFPDDAPAKPFVSRKGGYAVRHQDNDAREGHAKLSLSRLPGLRVLCVDLGHRYAAACAVWETLSATQVGDACRAAGREPPRDSDLYLHLKKKVKKQKKGTEVEVEETTIYRRIGADILPDGKPHPAPWARLDRQFLIKLQGEDREARKAGPAELEAVQRVEKEVGREPPDQRALRVDELMSETVRTVRLALQRHGRRARIAFNLTAHKKLLPGGREEVLTAEERVGLLADTLADWYALFTGKGWNDHWARQQWEAHITPLLQGAALPQMPHDAEDMPKARREYEADLMKRLSPVAKSLAGNESLRRQLHCLWATRWRDDDVTLQKCLRRLRDWILPRGRKAKADGAIRHVGGLSLTRIATIKSLYQVQKAFYMRPQPQDLRKNIPSKGDDALVGFGRRILDAMEHMREQRVKQLASRIAEAALGIGRVKRLAGGKDPKRPRQRVDRPCHAVVIENLTHYRPEETRTRRENRQLMSWSSSKVRKYLAEACQLHGLHLREVQAGYTSRQDSRTGAPGVRCQDVPVKQFMQSPFWRKQVAQAEKKRAEGKGDARERFLCDLNAKWNDKLEADWEKAGAVRIPLKGGEIFVSADRDSPAAKGLQADLNAAANIGLKALLDPDWPGRWWYVPCDPATFKPAEDKVAGSAAICLDKPLKNASVAQSTDRRVKKGGKTEARSREVVNLWRDVSSQPISADDNWREFAPYWNDVQARVVRILRQSAGLATDQEER

SEQ ID NO: 61930 - protein, 1256 aa, Unknown
  Microbial Source - OQUW01000235.1_o | hot springs metagenome genome assembly
MTKRKSSLAGYRLHRERILFSGGQVIRTIKFPLTPLNPSKETALFLKDFEKAIIADDLKIRGDLNINDYFVYTAKWKPPYTLFDFWVDSLRAGVIWMPKVTKLIDFLTSQYNITSPFDMVWEKASHRIAVIFQKDKFKDIFLSAPIRNTSTRNSFYERILKSLKDDLVRKNDIISTDAKKEVDLIVNSFFNDDGKLILKGKDQLDFWKREYNLDRSTIESLKPKGAYTDITFVNIPELMHNLDAKQSFEELINKREIWISDKKLLSSILGLSDNFNGFSNYLGVVLKGLQKKDGDIEALYEAQKTIFPRLGNYEDEILNALDFLSQKAKLLGETSLPLVNGWHDYRSVFGGKLQSWFTNSQNRKKELNGQISQFREGLSQVKNYLQKGNFGEEADKEKKDILSFLSLLENFFTDEQKSIKVEVNYQLFESLLALIRRRLNFFYQKYIQKEGNETKVNKYKEFEGLYKTIYKPVAFYGYTAKRANEKFVNKTIPILEDGVENTIKLISYLRDSFSVQKTFESVKQEKEKVDDLYRKFLQFFWNKYVDASINSRLFLEKYEKIIKENIEDSKWKEISDKNRKGRYVFYKSPYAKGSLEKIQIKTNDYLQQLQASVLELAEFILSFKKDTLLSDAILLLDWIELSKNTISLLIRFNTKETYKLDGLLLDIFSQAKRYKELFRRENYPRNEFSFIIQSLILSEIRGAATLYSKKEYIASYSVQVIGADDRYKLYYIPKKEISINADTIKSKPSSIERKQLMKSHNFAIALDKVYEKNKNKTFNAILLSKSGITAVYLPSESLQKLFRLSSSPYQLQFLDKYIYLPDGWENIDISLSEWSFIVEKRYKIDWDLQTKKPTLLPITGSEQAKKNKIYLAIPFNLIPNKQAVQSAPLKVIAKGKETIEKDFSRLNFPILGIDVGEYGIAYCLVRFIFDKNTYKITGVELGSYKEEILGFIEDKNIGNIKDKFAEIQQKARQGAFDEEDNVVARIRENAIGHLRNKIHVIVTQEKSSSVYEDSITNFETGSGRTTKIYNSVKRADTESNTEADKQIHNHVWGEKTKWIGRNIGAYASSYTCLSCLKSLYQIKKEDLAKMIINQKEGRVVTISSRHGNIKGYVSKEEKYDMGYQFKGTDEDLKKIRKIVQDFARPPVTNHSEVLEKYAKKILETGRIEEWRKSRGNSSIFVCPFCQYVADADKQAAFMMAVRGYLRFSGIVPSQSSKKKQGQEEEKTTGESFLEQTQKQLKDIDRSGIKNAFSVRI

SEQ ID NO: 61931 - protein, 1518 aa, Unknown
  Microbial Source - OQUW01001775.1_o | hot springs metagenome genome assembly
MTELQTQRAYTLRLKGIDEKDQSWRDALWKTHEAVNKGAKVFGDWLLTLRGGLDHTLADAEIPGEKGKPDRAPTQEERKHRRILLALSWLSVESERGAPEEFIVATGKEPAATRNDKVIAALKDILRGRNLTEEKISEWTEVCTPSLSAAIREDAVWVNRSRAFDEAVKRIGSSLTREEVWDMLECFFGSRNAYLAPVKISEDESSDGEQEEKAKDLVQKAGQWLSSRFGTGEGADFAKMAAVYAKIAAWAGNAQAGTTGNEVINNLATALREFTPKSNDLKGVLDLISGPGYKSATRNLLKQIANTKTVTREDISKLQETAGEDSEECATKTGSKGKRAYADAILKDVESVCGFTYRIDKDGQPVSVADYSKYDEDYKWGSSRHKEFAVMLDHAARRVSLAHTWIKRAEAERRKFEEDSKKIMQVPQAAKDWLDAYCAQRSEASGALEPYRIRKRAIQGWKEIIASWNKPDCKTAEDRIAAARQLQDDPEIEKFGDIQLFEALAEDDAQCVWKKEDGTLDPEILINYTLASEAMFKKQHFKVPSYRHPDAFLYPVFCDFGNSRWELDFSIREAATKLKEIEAKIEKQRQEVHKVQQALEKCENDEKRPKMEERLKEAQKKLQESQNYGEYLHSNNKITMVLFDGTFVKKHIFAWQSKRLTKDLALYQEPSADPKNVVSRADRLGRAVASVGINDAVKVAGLFEQENWNGRLQAPRQQLEAIAQYVEKHGWDNKAEKMRASIKWFITFSAKLQSKGPWNEFARKHGLKEDPHYWPHAEKNENRTAHSRLILSRLPGLRVLSVDLGHRYAAACAVWEALGSEAFKKDIEGKRIIRGDTDENALYCHTEHEANGKKHITIYRRIGADTLPDGAHHPAPWARLDRQFLIKLQGEDEQAREASNEEIWKVHQLENTLGRRTPLIDRLIAGGWGYTEKQKARLEVLTNLGWCPTNKTDNQEEGDEEETAILSKPSLLVDDLMFSAVRTLRLALKRHGDRARIAHYLITDEKTKPGGVKEKLDKNGRVELLLDALGLWHDLFSSPGWHDEKAKQLWNAYIAGLLPEGELQQAKSVTTSAALGGQQKKEKKEKLRAVAEALYLNSDLCHSLNEVWRKRWEEDDKQWRIYIRWFKDWIMPRGANAKSPAIRHVGGLSLTRLATLTEFRRKVQVGFFTRLHPDGTKTETREDFGQKTLDTLEHLREQRVKQLASRIVEAALGIGSEDKRHWDGKKRPRQRIADPRFVPCHAVVIENLTHYRPEETRTRRENRQIMEWASSKVKKYLSEICQLHGLHLREVSAAYTSHQDSRTGAPGIRCQDVSLIEFMKSPFWRKQVAQAEKKQKEGKGDAVERYLCELNQKWKGASEEEWRKAGFVRIPLRGGEIFVSAAGHDSPAAKGIHADLNAAANIGLRALLDPDWSGKWWYVPCNSSTMCPARDKVTGSAAVNPGQPLQVSAQLESDDAAKDTKKRKKKGDGKSKEIINLWRDISSYPLEDTRGGTWSNKTVYWNRVQSNVVHILQNQMKG

SEQ ID NO: 61932 - protein, 383 aa, Unknown
  Microbial Source - ORXB01007227.1_o | sediment metagenome genome assembly
METVKLCVKGVISPRDAGLRKLMREYVNYKKILIPKVQQAVRQVIKDRGISVYAQQKWMVDKKLSEYLKNLPLHPMPFHNQSVFIEHKDGRFRIHFKTKKEEAICRLSVPAKYHDLIKRACGKDNPVLGQVELMEDRKYGWVNCHIVLRLPRPEPYAPKWWMGVDVGWNKLATSILATANPHLTFSHPTVHGKDFKTRIIQLRHLLKDYARKGKAWKKWDFRLKNTIKYAVGTVAKEIVAKAERHRAGVVMENLTFKSQTKRWLIPRYKLMVAVKTLCKIRGIPFRLVAAKNTSISCPKCGCINAKNRSGERFNCKSCGYQADADITASMNIAKEAIDMGLAPMSTEAADLSAASGDVATPLSADEPMTFIKAGANPRKLKMR

SEQ ID NO: 61933 - protein, 681 aa, Unknown
  Microbial Source - OVXJ01001238.1_o | sediment metagenome genome assembly
LKLTKTILKLELKGDPTSLNSLNDLFNKYDQLVKIADSFIYNVYPIYVSAEQKSLKRLRLKDLVESLDKKAIRKNKRRKERNGIEGEDQQEQDKHKYTCSDLLKTLLHRFIKYADKYYGIDIKYAYLEMQSGLADLMHSNAENAYRFRTLPVLRKLSDTMPIRVSKRPLQENRKNNNDKYYQRTGEFIINGSNIIFRIGGKRNGLYFPIALSFNDAERLKMLSDAIQGNNGLTIGDPCYLVRKRVKGGNSYRYYIQVSVSKNVDKRTIEEAIKNKSVIRIVGVDLGLSKYIATLFCIEVDKANKTYKLIDALGIEGTKEYINAIRKYEEEKKRLQQGKMRGKANSAKISRYKDSEDYTIKNANGDSKRIDLRRQQIGYLCNQIIKFADKNKADIIVVEELKGLNRRLKDLKKIKKVLGKLYNDVNSNGIKSIDEYIKNEAKGKTKDILEILNKIKEYANNHNHNHNHNIRKVTKYILKQRDRIEKRIFLLSVFAYYQFKNELETEALWHDKLLYEVKPSYTSQQCLACRNIDKLNRLTQRQFRCIKCNFKMNADFNASANIALRYVEKLLKIELIPMRNNNDNNDNSSSSSSKQGKGSGTMTITSATTPLHASINASSKAGVVCNNTDGIVAHTMSNVTSTLQGNGEGRPLRVRGQTELPCSVRRLVTLDEFIYEKRGNGG

SEQ ID NO: 61934 - protein, 512 aa, Thermodesulfobacteria bacterium
MITLQTRLQIENKEDLEKLYNLMRRYCSAYRYAYNRLLEKKKETDIRKEIQNLFNINSQYAQSAIWEAKALIRSCKERGQNPKKVIFGGRLLFEKLSKKHLTGKRRRKLKEKWKEKRQKVLYTVGGKYKKGNTNLRLIKNDDNWYLRINVGKKEWIYAKIIRKVKREKDKWIDFIRNLETAENSKGSYAERYFPYTVRVLSKNGKLYAHISYEEKVPEKFKIIKENGIIGIDVNASPFHLALAISSKDGNLLDYKKISLHELINANKNKRKYLEWLIAHEVINYALENNKAIAIEKLEGLKNEKRGSGRAKFRKRLQQFCYRNILEKIKILAKREGIEIIEVNPFYTSVIGKLKYSPIYNIDKDTSAAFVIARRALGFREEIPKNYEKLINDEDYLSYAITELEEKVEEIKKKKNKEKNKYKRNAIKTELKKLKNELNLLKKHLENLKSGKCKPATNNLLIGRNRGVSFQACKAGKYFPQPSLSLTLKNSYKLIVFVGIFLPNQFQGTGGQI

SEQ ID NO: 61935 - protein, 907 aa, Unknown
  Microbial Source - UOVV01006324.1_o | compost metagenome genome assembly
VLGDALNFYYDNVMHPGYEMEYKSANERKKKKLEEEKQAFIQQDYLSIGQLQDALDKYIPEIDDSVDWKRNYTTSCIADYFKNHFNAEKKEGEEKEFTLPANISAKYSCVKGLLENYPKDRELYQDKKAIDNIKLFLDALLELLHFIKPLILRADIALEKDAAFYGQLEPWYDSLKELIPLYNKVRNYATQKPYSIEKFKLNFENSTLLDGWDVNKEKDNSGVLFIKDGHYYLGIMDKKHNKIFRDIPKATSERTYRKINYKLLPGASKMLPKVFFSDKNTSYFSPDEEIQRIRNHGTHTKNGDPQEGYEKLDFNLNDCHKMIDFFKSSIQKHKDWKNFGFRFSPTYTYDSIDAFYREVEAQGYNITFTEIDESIIDRFVEEGKLYLFRIHNKDFSPFSKGRPNLHTLYWKAIFSPENLKNVIYKLNGQAEVFYRRKSIQPEQMVIHKSGEAIDNKNPLTGKKQSTFHYDLIKDKRYTVDKFQFHVPITLNFKASESNIINYEVLQYLRTQPDVHIIGLDRGERNLIYLSLINQKGELLYQEPLNALKSDKFNVVTNYQELLARREKERDMARKSWGTIENIKELKEGYLSGVVNKIATLMVKHNAILVMEDLNTGFKRGRFKIERQVYQKLEKMLIDKLNYLVFKDKSEDEPGGLFKALQLTNKFKSFKEIGKQNGFIFYVPAWNTSKIDPTTGFVNLFYIHYENMEKARAFFGKFQSISYNHDKGYFEFAFDYNDFTTKAEGCRTNWTVCTHGDRIRAFRNPEKNHQWDYKTIHITEEFMALFRKYGIEFSGNKDLREIITGQKDAAFYKSLLDLFRLTLQMRNTNQDWDYLISPVLNENGEFYDSRKADNHLPQDADANGAFHIAKKGLMWLKQIQQFEGDNWKRLDLDKTNKGWLGFAQGYQF

SEQ ID NO: 61936 - protein, 852 aa, Unknown
  Microbial Source - UPSJ01002360.1_o | activated sludge metagenome genome assembly
LKENSHPVVDYFINHFKAKKKEETDKDFDLIANIDAKYSCIKGLLNTPYPEDKKLYQRSKEDNDIDNIKAFLDALMELLHFVKPLALSNDSTLEKYENFYSHFEPYYEQLELLIPLYNKVRNFAAKKPYSTEKFKLNFDNATLLNGWDKNKETDNTSVILRKDGLYFLAIMPQDNKNVFKDSPDLKANEICFEKMDYKQMALPMGFGAFVRKCFGTASQLGWNCPESCKNEEDKIIIKEDEVKNNRAEIIDCYKDFLNIYEKDGFQYKEYGFDFKESNKYESLREFFIDVEQQGYKITFQNISENYINQLVEDGKLYLFQIYNKDFSPYSKGKPNMHTLYWKALFDPENLKDVVYKLNGQAEVFYRKKSIEQKNIVTHKANEPIDNKNPKAKKKQSTFEYDLIKDKRYTVDKFQFHVPITLNFKATGNDYINQDVLTYLKNNPEVNIIGLDRGERHLIYLTLINQKGEILLQESLNTIVNKKYDIETPYHTLLQNKEDERAKARENWGVIENIKELKEGYISQVVHKIAKLMVEYNAIVVMEDLNTGFKRGRFKVEKQVYQKLEKMLIDKLNYLVFKDKDPSEVGGLYHALQLTNKFESFSKIGKQSGFLFYVPAWNTSKIDPTTGFVNLFNTKYESVPKAQEFFKKFKSIKFNSAENYFEFAFDYNDFTTRAEGTKTEWTVCTYGDRIKTFRNPDKVNQWDNQEVNLTEQFEDFFGKNNLIYGDGNCIKNQIILHDKKEFFEGLLHLLKLTLQMRNSITNSEVDYLISPVKNNKGEFYDSRKANNTLPKDADANGAYHIAKKGLVLLNRLKENEVEEFEKSKKVKDGKSQWLPNKDWLDFVQRNVEDMVVV

SEQ ID NO: 61937 - protein, 479 aa, Unknown
  Microbial Source -YNPsite07_CeleraDRAF_scf1119010704098 | GENOME_ACCESSION
MLEYKLAWKGGRLIVVPPQNTSRTCPCCGHVLSDNRQTQAWFECVACGYENHADRGSGPEAFRGSGPEAFRGSGPEAFRGSGPEAFRGSGPEAFRGSGPEAFRGSGPEAFRGSGPEAFRGSGPEAFRGSGPEAFLVGAINILARGIQLLRDEGQDTTDAAVGMRVGEPPVSARMACGSNCTGGRKQEPAETTAQGAIHAQRGRNLRPSGRGGCQHSLPSGSAQVRIKKQRSHPQAHFCLPVNPVRTLSATKAAFFSAYPRPINAVYRRVVEELLVELHLTTVNSTFVYDPFFALGLVTLYDGLMEAYHPPEQREAIFNALCKALHLKPEVLRKNARDLLELMGSGDPRQRLDLLCLKPEAEDVGGLKAILERMTQPPYAYSRVLAVGLYTAYEVVAKSLYEEPEERTRRFLENVVSKLPFSTERVRKDLELYRSSLDRMKQARAVVEEMVKAARRQQERRQSAASLPETSFGDPSKPGS

SEQ ID NO: 61938 - protein, 1108 aa, Unknown
  Microbial Source - Ga0065721_10050166 | GENOME_ACCESSION: BioRi_2199352012_$F_3300005286 GENOME_ID: 23829 CONTIG_ID: 14524
MAIRSIKLKLKTRTGPEAQNLRKGIWRTHRLLNEGVAYYMKMLLLFRQESTGGQTKKELQEELIRHIREQQQKNRADKNMQALPLDKALEALRQLYELLVPSSIGQSGDAQIISRKFLSPLVDPNSEGGKGTSKAGAKPTWQKKKEANDPTWEQDYEKWKKRREEDPTASVITTLEEYGIRPIFPLYTNTVADIAWLPLQSNQFVRTWDRDMLQQAIERLLSWESWNKRVQEEYSKLQEKMTQLNEQLEGGQEWISLLEQYEEQREQELIENMTAANDKYRITKRQMKGWNELYEQWSTVLPNASHEQYREALKRVQQRLRGRFGDAHFFQYLMKEEHHLIWKGNPQRIHYFVARNELKKRLEEAKQNATMTLPDARKHPLWVRFDARGGNLQDYYLTAEADNPRSRRFVTFSQLIWPNESGWMEKQDVEVELALSKQFYQQVTLQKNDKGKQEIEFKDKGSGSTFSGHLGGAKLQLERGDLEKEEKDFEGGEIGSVYLNIVIDFEPLQEVKNGRLQSPYGQVLQLVRRPNEFPKVTTYKSEELVEWMKASQNHSSGVESLESGFRVMSIDLGLRTAAATSIFSVEESNDANAAGFSYWIEGTPLVAVHKRSYMLKLPGEQVEKQVREKRDERQDQQRRVRFQIRILSQVIRMAKKQNRERADELDHLSQALEKQKSLLDQTDRTFWNGIVCDLTDALREKEGGWEQAVVQIHRKAEEHVGKVVQAWRKRFDADERKGIAGLSMWSIEELDSLRKLLISWSRRTRNPQEINRFEQGHTSHQRLLTHIQNVKEDRLKQLSHAIVMTALGYVYDEKKLEWFAKYPACQVILFENLSQYRSNMDRSTKENSTLMKWAHRSIPKYVHMQAEPYGIQVGDVRAEYSSRFHAKTGTPGIRCKMVKGQELQGKRFENLQKRLVNEQFLTEEQVKQLRPGDIVPDDSGEWFMTLSDGSEGKEVVFLQADINAAQNLQKRFWQRYNELFKVSCRVLIRGEEEYLIPKAKSVQAKLGKGLFVKKTDTVMKDVYVWDSQAKLKGKTTFTEESESPEQLEDFQEIIEEAEEAKGTYRTLFRDPSGVFFPEFVWNTQKDFWSEVKRRLYGKLRERFLMKTR

SEQ ID NO: 61939 - protein, 1355 aa, Unknown
  Microbial Source - Ga0255812_10583625 | GENOME_ACESSION: IMG_3300023203_$F_3300023203 GENOME_ID: 30040 CONTIG_ID: 32030
LTIQCAQGGRERIPSGALCRGKPRTPVTWRELVQCHSAEYNPARGGGKFFSDSEDINMATRSIKLKLALGKSKNEAEEARRAQLRSAVWTTHCLFNEGVAYYMNWLMLMRGEAFHKGQTEDELELIGISDGENYFFDKKQMNEEFLRRLKSQQKENGGDEENMPCSEKDPSKTLFADLYEIIVDMAGKKKAQDKKEEDKKAKDRGKKPQESSDTPPDNAENNEDETTEDARDEASLKKAASLAGTYLGFLTKKDSAAGERARIAVEKAPNWANALLANKKNEDRKRLVADWRNAILEWAGGKKDQSTSINGGGRTAAWPEAMKKWIERQNDPNAIEWKTALESKGWLTGYLNWLKGQKKHHDEFGPVGAKLRAAKLVPLFHKFTEHAKVDVKGNAEILDKSCFAEAIRRMGQFETNRIKMEKRKNELENKQKGRDQERNRIPQCLRDCLKEYEKERTRDLGRESLEPKEQYRIMPTGVRRFRQVVYAWNDCLSQNPAAPEDDLKRAAGNVHGRFRRRGFGDPKMFRTLAEAKFRPIWHFDEQNQFPPNWAQADKDTRRNLAQRQADALVKWAEANEADRDAQEARERPRLTIPDPINHPAWMRYEGAGGTNFSPVWFEQTGEGKDARTQLHLDLLEPLDPPKSDATWHVRRVASQSAGKKRKPQPNGSDTTIPIRNTEQIVLTKIGALKKDGKWAYQRLTLQDPSTREQFEGELKGSQLEFGAKGPRLNEENFIKQGFPPCFFSVVVNINTQKSESRPQSYADPIKNGPFKCKNMKPSEWNPDFLREGRRVLSLDLGIRHFAAYSVFRLTQTRPASNRQLFFMVWQRSDWYAVHEVSGCLKLEGEDETPDIIRRREALRNRRLELARAINLLHDLFSLGRLANSKEKQEELMELRNALSENNLPDKIRTMFPQDDLKALDDLAKEQNAPGWWKQEDDGPGECQGVCRIHRKWEETLGKEISEWRRERARFHHEIKEGKVPSGMGGLSFWRLEELDAERRLLLRWSLHSRKYGRRREDGTRPAIFVKSRARGIISGKQNVEWVDTDQRLLEHINNFKEDRRKVGANMIVMAALGYEFHDDRKGKKKDEAKWGQLRDECAHLPKPERARCDLILFENLGGYGFRKDRPRRENSKLMKWAHRSIPKEVMMQGQLFGLRVYDVLAQYSSRVYARNLSPGIRCHLVREVDLEPGSYYHAKWKEEINDTENQSVNKRTNLPKIGELVPEPLGEWFVTLAKDSNKIRICRVNADINAAWNLQRRFWTQEYINPFFQKNGRMFRDSSEIVVPHSEGENGWLPEEKFWEKANEIITDQLARQRATIYRCEQPSGDNCDPFEAEDLANSDGDMSSDDDATDQIRF

SEQ ID NO: 61940 - protein, 1089 aa, Unknown
  Microbial Source - Ga0265297_10015673 | GENOME_ACESSION: Munlanlwell13791_2_$F_3300029288 GENOME_ID: 280701 CONTIG_ID: 15672
MSVKSIELKLHIPYTEDGRKIVNAAGFTHYLHNKGVRYFMEKLLLLRQRDIYEDRGSNAPTRHMDDLKKGLLCYARARQLQNTGRHAGTDEEVLTLLQRMYEALIPAALREKGNTQSIAREWLNSLVSKDSNAGMGKSKSGRSPAYMKKGLTAERKALLKEKYENRQKEKIANEIRPSLKELGLLPFINTFRVDSCYTWLGEEKNGKVTPWDNSSVSCWERDMFQQALERLSTWESWNANADKEYEKAEAELSAWRQNNQDYLNNWQPKFTAYESKRKKEHDDVGFVSEQTFRINGRMLRGWDYIKDKWKNKLKSKPDMSQEDLLAIAKEYQAKRPRECGDMPLLEFLASIDMRGTWQGESDIVLRHLKHNTLIARFEIKHRYTIMTLPDPLKHPLWPRLDVPEGSNMNDYRLLPDGKKGWQVEFRLLFLRGNSQLVEQKLQLPVAPSGQLKFASLTAKPDAKGKHEDIRKISLIDQGTKEQFAAQFGGGRICLKRTLIENFRKAQDLFSKDVSPVYLNITLTVEDKQSISAKAFKWHRSNPAEPWYIVDIKDDTELVKPEYAGMGCLSVDLGVRQMAACSVFRLSKDRADEKRVSFSVVGAKDLYANSERSFLLALPGEKSDKAVKEARNSLWTKLRRLKYSLKLINQLIRLSGESTQKREEIYKGLVNAFTNPEENADPFLDKRLLINIESKISTPDEDWRNAVINIHMQWEVQFAKELAGWRKQFARDAKGRSRYKGIWGLSLDGIEYLESTRRLLISWTTHPRNAGEVKRLPKDKLFAVRLHRHIDGLKEDRIKKSADAIVMSTLGYTTGKEKKHEKCSLILFEDLSRYRFRTDRPRYENKRLMQWAHRAVVKETANQAGMYGIHVGLVGAGFSSRYYSRNMCPGIRCKALDKDDFASPGIAEILAEDKIDIKLLKPGNIVPWNGGELFAALDGKKPMLLHADINAAINLQRRFWTYYADQFRIVCGRLPQGTEVWFKPLRIGKRNERFFQKKSILQLPANTGSGLIGILRPFTAQKLQVIEENAVADLDGLNESEEDEAQASGHYIFFNDPSGNILPKERWYESKIFWTQVKQRLSAALLKKNS

SEQ ID NO: 61941 - protein, 1078 aa, Unknown
  Microbial Source - Ga0315280_10014676 | GENOME_ACESSION: YL17G06_40_MG_2_$F_3300031862 GENOME_ID: 281631 CONTIG_ID: 14675
MSVKSIAVKLVIPRSPGGVAIRRACAETHIIHNAGVRYFMENMLWLRQEDIYEDRDSVRPTRTRSFCQERLLRLAREVQRRNGFGKKASDPEILRLLRGVYEQIIPAAIGESSDNQAIARDWLGSLVSKASEAGLGKSARGRKPAWTELPDSDPRKSQRKHAYEERKKEQKSSQLRPRLKELGLLPLIPMFRSHSGYEWARVETKGKIQPWKDDNVSNWERDMFQQALERLSGWESWNKNAVERHRKAKETLTAWDRAHLQDSETWRPIFARYEASRRGELELGPLGLKRPFRIGRRMLRGWDRIREKWIDVLKKNHSISETDLLDFAKRWQQAHPREIGDMHFIAYLARPQNRAVWSGDHDYVVSQVHHNLLLIDSEEAHPWTILTLPHACIHPLWPRLDVPMGTNMNDYLIARGEDGGWHLTFSLLFPDGKRLTEKRLTLPVAHSGQLDYVRPVADSGRNLILRDPGTDEEFQGKWGGASVRRDRNLLQKLEDESAMRKAACGPVYISLTVDLMDRKGPSTKGFKKTPRGLAGEQFLIGIKEDSSANEILAIQNLGCLSIDLGLRQAAACSVFRMRTKPAQGRSSVPIAGLKRSMEHERSFLLALPGEQADEAVEDKRQKLWDELKKLSDSLGQLNRLIRLSGADGDSRSEGLAALEETETSIFDLKALAALKPKMDLGAVAWRGEVKRIHRCWEKDFAKALAGWRKSGTRDQKGRSRQFGIWGLSLEGIAYLERVRRLLIRWTTHPRKAEETNRLEKNRPFAARLQRHIDALKEDRIKKAADAVVMAALGYITEGEERKEKFEPCSIILVEDLERYRFRTDRPRQENSKLMQWAHRALFREIARQAGIFGIAVGKVGAGFTSRFHAATGAPGLRCAAVTKGLLRKPWFLKRLEEDGLDASSIQVGDIIPWERGKLFCTIDRAGKPVMIQADINAAQNLQKRFWANYDEPFRVVCAAGAADTFVPLPGKRLARFFASKMLAAVKPGDSPAYELVQAKVGRVEKQAVEEEGSMREEFPERLHEEDEAASARKTIFFRDPSGALLPAIRWYESKVFWSQVKQKVRQALLRPRKTAVTL

SEQ ID NO: 61942 - protein, 1127 aa, Unknown
  Microbial Source - Ga0206102_1000160 | GENOME_ACESSION: 1B1Ametagenome_2_$F_3300020149 GENOME_ID: 20785 CONTIG_ID: 159
MPVRSIKLKLMTHSGDNAAMLRKALWQTHKLHNEGVAYYMKLLIMLRQRDVYKQDLKEPAESFRLDLLAHVRQQQQRNGSAHIVIPEMELTAALRELYELLVPSHNGGKGDSQQLSRAFLSPLTDPNSQGLEGTAKAGAKPRWQKMQAEGHPDWEAEKERAEREKEADPARKIMKQLREWGLKPLFSLFTNEQTHIQWAPAKKDRDFVRTWDRDMFQQALERLLSWEQWNHKVIEERALVIARREAYESEHFASEAQQAWLQRMRGYELERAAKLAEQSLGLTGPFRIKSRQLRGWKRVHDLWRKLDKKGQRSLDHCWEAVAKIQGAQPKDFGDPELYRFLAEPANHDLWLEEPERLFHLVTYNALLEKEELSKQQTTLTLPDAVEHPLWVRFDPKGGNLHSYELQSEDDKSPQKHLSVTFARLIWPDSTGDGTPLWIESGPIQVGLATSAQFYRQFRLLPMGDDNRLGKALEVQDYSAADTKTTGLLGGAKLQFERPYVEKHWQTVSEGDIGRAYFNVTIDMEPIQPMKNDRLISGLGKAFKTFKRDFMEVTQYKPADLEAWMATQPAKTELTGTKALQEGLRVISVDLGQRTAAAVSVFEVVRGKPDADKLFYPIRDTESLYAVHRRSHLLQLPGEAVTPEAVSERQSRNRAMYGIRMQVRLLSGILRLYGKEEAASRRKSITRTMDMIRSTDNLSMDDKTRWSSVYQRLADAAELDVPLWQSTVITAHRELEAIVSQAFSTWRTSSRHRGRGVGGKSMWSLEELDQTRKLLISWSKRAREPHAINRLDRNERFAQRLLTHLQRLKADRLKETANLIIMAALGYKYDSPEKGWLPVFPACQLILFEDLSRYRFKMDRSRSENSKLMNWAHRSIPREVYMQGQVFGLMVGHVPSEFTSRFHARTGAPGIRCHVVTQADLDGRTAMLKLVDQDFLAEVRDELQPGDLLPFRGGEIFVSLNGSTEKERALNRLHADINAAQNLQRRFWSRYPQDPIRISAQRITADQEIAYEPKTTKMKESMGKGFFQEFEISKSHHVYKWNSSGKLGGKKRIADSKDMEETDDLAEEAAAAEELMDGYVTLFRDPSGYYRASDLWVPQVDFWGMVTRRLESLLKAAINERPGRALSR

SEQ ID NO: 61943 - protein, 1101 aa, Unknown
  Microbial Source - Ga0207869_1001742 | GENOME_ACESSION: HigsolAR5DSPAdes_$F_3300025517 GENOME_ID: 27181 CONTIG_ID: 1741
MSVKSIKLKLKTRSGTNSLSLRKGLWKTHELMNQGIAYYMEWLTLLRQEPVGSRSKEELRQELIGRLQEQRKRNGYSDSATELPDEVFLLLRELYECIVPSSVGESGDAQLLSRKYLSPLTDPDSEGGEGKSKAGRKPGWLLKKEAGDPTWEAEFLRAQKRKEADPTPRIMQALREFGIKPLFPLFTNLQSDITWLPPANKKQFVRTWDRDMFQQAIEKLLSWESWNRRVKDEREKLEQRKAKFEQEYLQDADGWLAPLQQFEKDREKELAEVAFAPGSVYLITPRQIRGWEKLYEKWEKLNTTTEADYIARIAEVQSSMPKEFGDPVVFRFLAKAENHHIWKGHKDRLFLLASYNQIKKQLQQAKEQAAFTLPDPVEHPLWIRFDARDGNLHDYVLWQESKRTRSRRTVTFSSLIMPSENGWCEQANVEVELALSRQFYRQIELCDNPKGKQEITFKDYSSGIPLKGHLGGAKIQFDRCHLEKNRDTLAEGNVGPVYLNVTVDIQPSQEIKNGRLQSPLGQALKVLAKDWPKVTEYKPSELESWILQSGQLQQTGIQSLTSGMRVMTVDMGIRTSAAVSIFEAVKEPPANSKKLCYKLPHCELYAVHRRSFLLNMPGERPDRRVKEQREKRTAERYAIRSQIRLLAQVNRLYAKETVFEQKQAIDEMVDAIQRNKNLAESVRNTWVKELGRLSACAGYQQDVWEKEVSEVYKRLEYITGEIVGKWRRSFGKGRKNLAGLSLWNIEELDSLRKLLISWSKRSRRPGEVNRLQENEKFAVELLEHIRQVKDNRLKQMANLIVMTALGYVYDETQREWIEKYPACQLILFENLQRYRFKQDRSRKENSQLMKWAHRSIPKTVWMQGEPFGLQVGDVNSEFSSRFHAKTGAPGIRCHMLTEPETRDSFLKEMIVKKGFLNEQEVELLKAGDIIPMQGGELFVTLKEKAGEELLIVHADINAAQNLQRRFWHQNAEVFRVVCQAGKTAKGEEVYIPKYKLAEKHLGKGLFRKQSETEDEHVYIWDNKAKIKGKTLSDDSLELEDEDEGLESLEEAKEARGEYKTLFRDPSGFFFPQDTWRPQVEFWSIVKSRLEKRLKMMILQKR

SEQ ID NO: 61944 - protein, 1129 aa, Unknown
  Microbial Source Ga0209347_1001125 | GENOME_ACESSION: AutmicBR23SPAdes_$F_3300027640 GENOME_ID: 23478 CONTIG_ID: 1124-
MTVRSIKLKMKTQTDPESLQLRKALWKTHQLLNEGVAYYMYWLILLRQDSYINEEGREYKKEEIQKELLEKVSGQQKRNDWQGDLGSLDILIPLRKLYELIVPSSIGEKGDSQISARKYLSPLVDPDSQGGKGTAKSGRKPRWQKMKEDGNPEWEEEYKKDMTKKESDPTTSILTELENYGLKPLIPLFTEEIKDIAWLPRKRGFVRTWDRDMFQQAIERLLSWESWNIRVKEEKQKIEQAIEDYRNKYLQDGEEWISKLREIEKIREAEITDVSYATKQGYLITRRELKGWEKVYEKWSKLIDAPLYDLKKVVTDVQNSMRREFSSAIFNILAEKKNRDIWVGQPNRLLHFAAYNVLLRKLQKAKDQATLTLPDPVNHPLWIRYDARGGNIHSYTIFQVDKMEVKVNLERMVWPNDSTWIEKEDITVHLAPSEQLYRQIAVQDNPSGKQEIDFIDYSSRVPLKGELIGSKIQFDRRYLENHTEELLAGNIGPVYLNLGVEVKHYQEMKNGRLRTPIGQSFTVKSLEWQKVIGFKAKELAEWMEQTAETNEKGIDSITEGLRIMSIDMGIRTSATVSVFEVVKNQPDNNKLFYKIQDTDLFAVHCRSILLNLPGEQVSKDIIKERDERYTERRFIKSQIRLLSKILQLNNQETQDGRKNILIGMIDTIESNKSLLNDQKQAWISKFNILAKNAYLDQVGWKQKLIEIHHEIEPVVGKLVSEWRRSFSKNQKNNKNRKNLAGLSMWNIDELEDTRRTLSSWSNRTRNPGEPKPIDPKFGINLLTHIQNLKDDRLKQMANLIVMTALGYKYDPGEKQKEERWKKAYPACHVILFEDLSRYRFNLDRTRLENSKLMKWGHRSIPKMVQMQGEIYGLLVGDVYSAFSSRFHAKTGAPGIRCHSLDEEDVNMLKNVSEIGGFDKLEDFKDLKREYYKLFGSVDKDYLAKMIERSDLIKSGTIIPKEGGELFITLAGHYKSNPKLSIIHADINAAQNLQRRFWQSNSEIFRVSCKLVKMSDGEYYIPKYSSKTFEKAMGKGRFIKNLDSEVYKWGNSSKMRIKTISTDKEIEFEEMEDFEQALEDAQEIQDGFKTMFRDPSGFFLATDKWLPQKEFWSMVKTVIHSRLRESSFSK

SEQ ID NO: 61945 - protein, 1147 aa, Alicyclobacillus kakegawensis
MAVKSIKVKLRLSECPDILAGMWQLHRATNAGVRYYTEWVSLMRQEILYSRGPDGGQQCYMTAEDCQRELLRRLRNRQLHNGRQDQPGTDADLLAISRRLYEILVLQSIGKRGDAQQIASSFLSPLVDPNSKGGRGEAKSGRKPAWQKMRDQGDPRWVAAREKYEQRKAVDPSKEILNSLDALGLRPLFAVFTETYRSGVDWKPLGKSQGVRTWDRDMFQQALERLMSWESWNRRVGEEYARLFQQKMKFEQEHFAEQSHLVKLARALEADMRAASQGFEAKRGTAHQITRRALRGADRVFEIWKSIPEEALFSQYDEVIRQVQAEKRRDFGSHDLFAKLAEPKYQPLWRADETFLTRYALYNGVLRDLEKARQFATFTLPDACVNPIWTRFESSQGSNLHKYEFLFDHLGPGRHAVRFQRLLVVESEGAKERDSVVVPVAPSGQLDKLVLREEEKSSVALHLHDTARPDGFMAEWAGAKLQYERSTLARKARRDKQGMRSWRRQPSMLMSAAQMLEDAKQAGDVYLNISVRVKSPSEVRGQRRPPYAALFRIDDKQRRVTVNYNKLSAYLEEHPDKQIPGAPGLLSGLRVMSVDLGLRTSASISVFRVAKKEEVEALGDGRPPHYYPIHGTDDLVAVHERSHLIQMPGETETKQLRKLREERQAVLRPLFAQLALLRLLVRCGAADERIRTRSWQRLTKQGREFTKRLTPSWREALELELTRLEAYCGRVPDDEWSRIVDRTVIALWRRMGKQVRDWRKQVKSGAKVKVKGYQLDVVGGNSLAQIDYLEQQYKFLRRWSFFARASGLVVRADRESHFAVALRQHIENAKRDRLKKLADRILMEALGYVYEASGPREGQWTAQHPPCQLIILEELSAYRFSDDRPPSENSKLMAWGHRGILEELVNQAQVHDVLVGTVYAAFSSRFDARTGAPGVRCRRVPARFVGATVDDSLPLWLTEFLDKHRLDKNLLRPDDVIPTGEGEFLVSPCGEEAARVRQVHADINAAQNLQRRLWQNFDITELRLRCDVKMGGEGTVLVPRVNNARAKQLFGKKVLVSQDGVTFFERSQTGGKPHSEKQTDLTDKELELIAEADEARAKSVVLFRDPSGHIGKGHWIRQREFWSLVKQRIESHTAERIRVRGVGSSLD

SEQ ID NO: 61946 - protein, 1115 aa, Alicyclobacillus hesperidum
VTVRSIRVKLAVGSPQYRDVRRGLWKTHEIMNQGVRYYCEWLVLMRQEPIYDEDEHGLTVVQRTREDIQAELLSRLRTLQSAHQHSGDMGTDEELLSLMRQLYEQLVPSSVDKNKSGDARMIARNFFNPLTNPNSQGGLGISNAGRKPKWLLKKLSGDPTWEEDYKKAMEQKQESSVSFLLLELRRFGLHPIFLPYTDTVLEVSWAPKKARQWVRKWDYDLFQQSIERMLSWESWTRRVKERFEKLVESEKKFYDENFATDPEFIKLAETLEGELQASSQGFVAVDEHAFQIRPRSMRGFDRVADEWCKLADDAPIEEYEAAIKRVQARLGRNFGSYVLFAHLAKPEYWSLWRSDPTKILRFARLRALQRAVARAKRHARLTLPDAIHHPIWIRYDAKGKNIYSYRLLIPEKRSKRYYVEFSSLIMPDGENRWAEHRNIRVPLAFSRQWERLHFSIMEDGSLCVQYRDPGVDEPLRAELGGAKIQFDRRYLIRRSSTLSAGECGPVYLNVSVDVNPAHRPDVQVLQSAKLVSVSRDTNRIYLRPENLSAYWKSQGDGTLPLRVMSVDLGVRSSAAVVICRLEHRDSVVSSGRRTATIYRIAGTDEFVAVQERAFLLRLPGEGKGTNEDAPLRDVYAQLGTIRQGIQILRSLLRLCDTKTPDERQEALHGLAQSLEPSGAWKDELHPHLVMLQGVVHDSVDNWKQKVISVHRQMERILGHAVREWKVARKNAGKPPIRRGAGGLSLRRIRQLEQERRTLVAWSNHAREPGQVVRIKRGTQVAQWLVERVNHLKEDRLKKLADLLIMTALGYVYDETKPSGHKWDKRYPPCQIILMEDLSRYRFQSDRPPSENSQLMAWSHRRLLEILKLQADLHKLIVGTVFPAFSSRFDAQSGAPGVRCRSVKKQDIENAAQGKGWLARELQRLNWTLEWLQPNDLIPTGDGELFVTPACCDRQKGIKIVHADLNAAQNLQRRFWGGHAESLCRVTCDVVERDGRRYAVPRISNAFADSFYKVFGQGVFVSTDEEDVYRWMVGEKISSRGRSRGRTSDEEAEAETWIDEAREQQGKVIALFRDASGQIHGGDWLVAKVFWGWVERLVTARLLSRMSEREAAAHKE

SEQ ID NO: 61947 - protein, 1463 aa, Unknown
  Microbial Source - GENOME_ACESSION: OQOO01.1 GENOME_ID: 9995 CONTIG_ID: 420
MPKQDKPSVTQRAYTLRLRGADPSDTSWRDALWRTHEAVNKSAKAFGDWLLTLRGGLDHTLADARVKGGKGKPDRDPADAERKARRILLALSWLSVESKLGAPEGYIVASGEEAPENRNGKVVAALEEILKNRNLADNEIGEWKKDCSSSLSAAIRGDAVWVNRSKAFDEAVKSIGCSLTRDEVWDMLERFFGSRDAYLAPAKGSEDESSETEQGNKAKDLVQKAGQWLSSRFGTGKGADFCRMADVYGKIAAWAGANKSNGSATVDDLAKELQKELQIEESKATDGLDWIIKLSSYPGHSPNPVHELLRQNPKLARSNLDDLEKTANTRAESCRSKIGSKGQRPYSDAVLKDVEAVCEFTYLQKDGPARHSEFTVILDHAARRVSLAHTWIKRAEKERSKFEEDAKKIGQVPKAAKDWLHKFCTERSQASGALEPYRIRRRAVDGWKEVVAAWSERSCNTSADRIAAARALQDDPEIDKFGDIQLFEALAEDDAACVWHKDGDAAKAPDPQPLIDYALAAEAEFRKRHFKVPAYRHPDALLHPVFTDFGESRWKICFDVHENLETASPHALSLKLWTGSEVVPVPLRWQSKRLARDLALGQDAQKDGALEVARADRLGRAASNVTKSDEVKISGLFEQADWNGRLQAPRRQLEAIAVVRDNLSLSDQERERRMSGMMDRIRWLVTFSAKLQPQGPWYEFAKTNQLRIDLQDWPHADSNKTRKGHARLILSRLPGLRVLSVDLGHRYAAACAVWEAVNAEQVEEACKDAGHEAPNANDLYLHLKRKATKKQKKDKKIEVEKTTIYRRIGADTLPNGTPHPAPWARLDRQFLIKLQGEKEGVREASNEEVWKVHQLETELGRTTPLIDRLVASRWGGSDKQIARLEELKKLGWNSAEKSDPNGESDEGESRRPSLSVDELMSSAVRTMRLALKRHGDRARIAHYLITDEKTKPGGTKEKLDESGRVDLLQDALVMWHDLFSSHGWEDKAAGQLWGEHVAKLSEYKAPEEIDEGSSVIERKKKQKENREKLYDVAEALAQDETLRKALHDAWKKRWEEDDEQWKKRLRWFKDWILPRGKAANDPAIRKVGGLSLPRLATLTEFRRKVQVGFFTRLHPDGTRAEAKEQFGQKTLDALEHLREQRVKQLASRITEAALGIGSEGGKGWDGGKRPRQRIDDPRFAPCHAIVIEDLTRYRPEETRTRRENRQLMSWSSSKVKKYLAEACQLHGLHLREVSASYTSRQDSRTGAPGIRCQDVPVDEFMRSPFWRHQIAQAEKKQSGGKGDARERFLCDLNARWKDKSEADWKKAGAVRVPLKGGEIFVSADPASLAAKGLQADLNAAANIGLRALIDPDWPGKWWYVPCDPVSFRPIKDKVAGSAAVKLDQALRQPAQAQSGDAKAKKKREKKDAGKPQEVVNLWRDISSSPLGESGEWKEYAAYRNQVQVRVVDILRRAVCSKNNREKQ

SEQ ID NO: 61948 - protein, 1122 aa, Unknown
  Microbial Source - GENOME_ACCESSION: OWPA01.1 GENOME_ID: 12159 CONTIG_ID: 246
MTNSDSVELRKGLWATHELLNKGVAYYMEWLILLRQDTIKMPEGVIKPKEAIQSELLQRVKAQQLLNNHQDKAEEESEVLAVLRQLYELIVPSSVGGTGDAQMLARKFLSPLVDPNSEGGKGTSKAGRKPRWKILKEQGDPRWEEEYEKDCARKEADETSKVLFKLEELGLKPLFPLFTDTRKDINWLPKANRQFVRNWDRDMFQQAVERLLSWESWNRRVADAKSKLEEKATEYYDKYLSSVTETVQKLKRYERERAVELEQTTGNKSDSYRISIRSVRGWDRIYPLWLKRSVNATPTELRDILKSVQREMSEGFGDPQLFIYLAQPENRDIWYGSNEKARILNHYAIYNGILTKLEQAKEQATFTMPDPIDHPLWVRFDARGGNLYTYILEEDEGWRVQFERLLWPNERGWEEREKVNVKVAPSKQLVRKAKNGYQKIIELVNNPKGKQEVIYRDYSTMLPFDGVLGGAKIQLNRYYLEKSKEKIARGQIGSVYLNISLEVTPIQEVKNGRLQTPLGKALTIVKSDWPKIVDFKSEQLQQMLTEQNSNKGDLKGVRSLAEGLRVMTIDLGQRASAAVSIFEVTAERPSDEKTKLFFAIPDTPLYAVHRRSLLLNLPGESPDKETEQRRKDRYSSYRAIRFQVRMLAQILKLHTKETSEERLTELQSFLKAVTEYELWDDEIKSLWKQELNKLRKSVNQSNEEWVQEIVLTHRSLESRVAKNISNWRKSLSNKRGGFLANSRYKIAGLSLWNVDDLTRNRRLLLSWSKRSRIPGKMNHLQHEERFGLHQLVHLQNVKNDRLKQLANLIVMTALGYTYDQERKVWLETYPACQVILFEDLSRYRFKLDRPRRENSQLMKWAHRSIPKTVAMQGEIYGLQVGDVYAAFSSRFHARTGTPGIRCKQLKECDLNDSFIKEALIRDKFITEEKWSSLKAGDIVPWKGGELFATLEKNASDKNGSKLLLIHADINAAQNLQRRFWNHRSELFRIACRRTKINDGEVYVPTSQSERWKKQMGKGYFVKDNNYSGRDNELEKVEAYEWNNMERIRQEVVSIDETIELEDMEEINQAIEEELESKGDYVTLFRDPSGVIFPDYLWIPQVQFWSVVKNKIQKELHKRIFGN

SEQ ID NO: 61949 - protein, 1112 aa, Bacillus sp.
MAIRSIKLKMKTNSGTDSIYLRKALWRTHQLINEGIAYYMNLLTLYRQEAIGDKTKEAYQAELINIIRNQQRNNGSSEEHGSDQEILALLRQLYELIIPSSIGESGDANQLGNKFLYPLVDPNSQSGKGTSNAGRKPRWKRLKEEGNPDWELEKKKDEERKAKDPTVKIFDNLNKYGLLPLFPLFTNIQKDIEWLPLGKRQSVRKWDKDMFIQAIERLLSWESWNRRVADEYKQLKEKTESYYKEHLTGGEEWIEKIRKFEKERNMELEKNAFAPNDGYFITSRQIRGWDRVYEKWSKLPESASPEELWKVVAEQQNKMSEGFGDPKVFSFLANRENRDIWRGHSERIYHIAAYNGLQKKLSRTKEQATFTLPDAIEHPLWIRYESPGGTNLNLFKLEEKQKKNYYVTLSKIIWPSEEKWIEKENIEIPLAPSIQFNRQIKLKQHVKGKQEISFSDYSSRISLDGVLGGSRIQFNRKYIKNHKELLGEGDIGPVFFNLVVDVAPLQETRNGRLQSPIGKALKVISSDFSKVIDYKPKELMDWMNTGSASNSFGVASLLEGMRVMSIDMGQRTSASVSIFEVVKELPKDQEQKLFYSINDTELFAIHKRSFLLNLPGEVVTKNNKQQRQERRKKRQFVRSQIRMLANVLRLETKKTPDERKKAIHKLMEIVQSYDSWTASQKEVWEKELNLLTNMAAFNDEIWKESLVELHHRIEPYVGQIVSKWRKGLSEGRKNLAGISMWNIDELEDTRRLLISWSKRSRTPGEANRIETDEPFGSSLLQHIQNVKDDRLKQMANLIIMTALGFKYDKEEKDRYKRWKETYPACQIILFENLNRYLFNLDRSRRENSRLMKWAHRSIPRTVSMQGEMFGLQVGDVRSEYSSRFHAKTGAPGIRCHALTEEDLKAGSNTLKRLIEDGFINESELAYLKKGDIIPSQGGELFVTLSKRYKKDSDNNELTVIHADINAAQNLQKRFWQQNSEVYRVPCQLARMGEDKLYIPKSQTETIKKYFGKGSFVKNNTEQEVYKWEKSEKMKIKTDTTFDLQDLDGFEDISKTIELAQEQQKKYLTMFRDPSGYFFNNETWRPQKEYWSIVNNIIKSCLKKKILSNKVEL

SEQ ID NO: 61950 - protein, 1108 aa, Brevibacillus agri
MAIRSIKLKLKTHTGPEAQNLRKGIWRTHRLLNEGVAYYMKMLLLFRQESTGERPKEELQEELICHIREQQQRNQADKNTQALPLDKALEALRQLYELLVPSSVGQSGDAQIISRKFLSPLVDPNSEGGKGTSKAGAKPTWQKKKEANDPTWEQDYEKWKKRREEDPTASVITTLEEYGIRPIFPLYTNTVTDIAWLPLQSNQFVRTWDRDMLQQAIERLLSWESWNKRVQEEYAKLKEKMAQLNEQLEGGQEWISLLEQYEENRERELRENMTAANDKYRITKRQMKGWNELYELWSTFPASASHEQYKEALKRVQQRLRGRFGDAHFFQYLMEEKNRLIWKGNPQRIHYFVARNELTKRLEEAKQSATMTLPNARKHPLWVRFDARGGNLQDYYLTAEADKPRSRRFVTFSQLIWPSESGWMEKKDVEVELALSRQFYQQVKLLKNDKGKQKIEFKDKGSGSTFNGHLGGAKLQLERGDLEKEEKNFEDGEIGSVYLNVVIDFEPLQEVKNGRVQAPYGQVLQLIRRPNEFPKVTTYKSEQLVEWIKASPQHSAGVESLASGFRVMSIDLGLRAAAATSIFSVEESSDKNAADFSYWIEGTPLVAVHQRSYMLRLPGEQVEKQVMEKRDERFQLHQRVKFQIRVLAQIMRMANKQYGDRWDELDSLKQAVEQKKSPLDQTDRTFWEGIVCDLTKVLPRNEADWEQAVVQIHRKAEEYVGKAVQAWRKRFAADERKGIAGLSMWNIEELEGLRKLLISWSRRTRNPQEVNRFERGHTSHQRLLTHIQNVKEDRLKQLSHAIVMTALGYVYDERKQEWCAEYPACQVILFENLSQYRSNLDRSTKENSTLMKWAHRSIPKYVHMQAEPYGIQIGDVRAEYSSRFYAKTGTPGIRCKKVRGQDLQGRRFENLQKRLVNEQFLTEEQVKQLRPGDIVPDDSGELFMTLTDGSGSKEVVFLQADINAAHNLQKRFWQRYNELFKVSCRVIVRDEEEYLVPKTKSVQAKLGKGLFVKKSDTAWKDVYVWDSQAKLKGKTTFTEESESPEQLEDFQEIIEEAEEAKGTYRTLFRDPSGVFFPESVWYPQKDFWGEVKRKLYGKLRERFLTKAR

SEQ ID NO: 61951 - protein, 1108 aa, Brevibacillus gelatini
MAIRSIKLKLKTNTGPEAQNLRKGIWRTHRLLNEGVAYYMNMLLLFRQESTDKKTKQEIHEELIRHIRAQQQRNHADEKTQALPLEKALEALRKLYELLVPSSVGQSGDSQIISRKFLSPLVDPNSEGGKGTSKAGAKPAWQKKKEANDPTWKQDYEKWKKRREEDPTASVITTLEEYGIRPLFPLYTNTVAEIAWLPLKSGQFVRTWDRDMFQQAIEGMLSWESWNRRVQEEYAKLEGKMAQLNEQLEGGEEWIRLLEQYEEKREQELRENMTAANDKFRITKRQMKGWKELYEVWSTFLPSASQEQYKEAIKRVQQRLRGKFGDFHFFQYLSEEENRLIWKGNPQRIHYFVARNELTKKLEKAKQSARRTLPDANKHPLWVRYDARGGNLQDYYLTAESDKPRSRRFVTFSQLIWPSESGWLEKKDVQAELALSRQFYQQVTFLKNDKGKQEIEFKDKGSGTTFSGHLGGAKLQLERSVLENKERKFEEGEIGKAYLNVAIDFKPLQEVKNGRVQAPYGQVLQLIRLPNAFPKVRTYKSEELVEWIKASPQHLSGVESLASGFRVMSIDLGLRAAAATSIFSVEESSDKNATKLAYWIEGTPLVAVHQRSYMLRLPGEQVEQHVWEKRDERGDQHKRVRFQIRRLAEIIRLANKQYGDRWDELNRLDEAVSKEKSPLDQADRTFWEGIVSDLTTALPLNDADWTEAVVQIHRKAELYVGKVVQAWRKRFNADERKGIAGLSMWSIEELDGLRKLLISWSRRTRNPQEVNRFEPEHTGHKRLLTHIQNVKKDRLKQVSHAIVMTALGYIYDEKKQKWCAKYPACQVILFENLSQYRSNLDRSAKENSTLMKWAHRSIPKYVHMQAEPYGIQIGDVRAEYSSRYYAKTGTPGIRCKKLREHDVKGWRLDHLKKRLVNEQFLTEAQVEQLKAGDIIPDDSGELFMTMTDGSGGKEIVFLQADINAAQNLQKRFWQRNSELFKVSCRVIVRDEAEYLVPQAKKVQEKLGKGVFVKKSDTAWKEVYVWDSQAKLKGKTTFTEESESPEQLEDLQEMIEEAEEAKGTYRTLFRDPSGVFFPDFVWNTPKDFWGEVKRKLYGKLRERLLTKVR

SEQ ID NO: 61952 - protein, 1129 aa, Unknown; identical to SEQ ID NO: 61900
  AacCas12b

SEQ ID NO: 61953 - protein, 1129 aa, Unknown
  AapCas12b
MAVKSMKVKLRLDNMPEIRAGLWKLHTEVNAGVRYYTEWLSLLRQENLYRRSPNGDGEQECYKTAEECKAELLERLRARQVENGHCGPAGSDDELLQLARQLYELLVPQAIGAKGDAQQIARKFLSPLADKDAVGGLGIAKAGNKPRWVRMREAGEPGWEEEKAKAEARKSTDRTADVLRALADFGLKPLMRVYTDSDMSSVQWKPLRKGQAVRTWDRDMFQQAIERMMSWESWNQRVGEAYAKLVEQKSRFEQKNFVGQEHLVQLVNQLQQDMKEASHGLESKEQTAHYLTGRALRGSDKVFEKWEKLDPDAPFDLYDTEIKNVQRRNTRRFGSHDLFAKLAEPKYQALWREDASFLTRYAVYNSIVRKLNHAKMFATFTLPDATAHPIWTRFDKLGGNLHQYTFLFNEFGEGRHAIRFQKLLTVEDGVAKEVDDVTVPISMSAQLDDLLPRDPHELVALYFQDYGAEQHLAGEFGGAKIQYRRDQLNHLHARRGARDVYLNLSVRVQSQSEARGERRPPYAAVFRLVGDNHRAFVHFDKLSDYLAEHPDDGKLGSEGLLSGLRVMSVDLGLRTSASISVFRVARKDELKPNSEGRVPFCFPIEGNENLVAVHERSQLLKLPGETESKDLRAIREERQRTLRQLRTQLAYLRLLVRCGSEDVGRRERSWAKLIEQPMDANQMTPDWREAFEDELQKLKSLYGICGDREWTEAVYESVRRVWRHMGKQVRDWRKDVRSGERPKIRGYQKDVVGGNSIEQIEYLERQYKFLKSWSFFGKVSGQVIRAEKGSRFAITLREHIDHAKEDRLKKLADRIIMEALGYVYALDDERGKGKWVAKYPPCQLILLEELSEYQFNNDRPPSENNQLMQWSHRGVFQELLNQAQVHDLLVGTMYAAFSSRFDARTGAPGIRCRRVPARCAREQNPEPFPWWLNKFVAEHKLDGCPLRADDLIPTGEGEFFVSPFSAEEGDFHQIHADLNAAQNLQRRLWSDFDISQIRLRCDWGEVDGEPVLIPRTTGKRTADSYGNKVFYTKTGVTYYERERGKKRRKVFAQEELSEEEAELLVEADEAREKSVVLMRDPSGIINRGDWTRQKEFWSMVNQRIEGYLVKQIRSRVRLQESACENTGDI

SEQ ID NO: 61954 - protein, 1090 aa, Unknown
  BrCas12b
MPVRSFKVKLVTRSGDAEHMLQLRRGLWKTHEIVNQGIAYYMNKLALMRQEPYAGKSREVVRLELLHSLRAQQKRNNWTGDAGTDDEILNLSRRLYELLVPSAIGEKGDAQMLSRKFLSPLVDPNSEGGKGTAKSGRKPRWMKMREEGHPDWEAEREKDRAKKAADPTASILNDLEAFGLRPLFPLFTDEQKGIQWLPKQKRQFVRTFDRDMFQQALERMLSWESWNRRVAEEYQKLQAQRDELYAKYLADGGAWLEALQSFEKQREVELAEESFAAKSEYLITRRQIRGWKQVYEKWSQLPEHAAQEQFWQVVADVQTSLPGAFGDPKVYQFLSQPEHHHIWRGYPNRLFHYSDYNGVRKKLQRARHDATFTLPDPVEHPLWIRFDARGGNIHDYEISQNGKQYQVTFSRLLWPENETWVERENVTVAIGASQQLKRQIRLDGYADKKQKVRYRDYSSGIELTGVLGGAKIQFDRRHLRKASNRLADGETGPVYLNVVVDIEPFLAMRNGRLQTPIGQVLQVNTKDWPKVTGYKPAELISWIQNSPLAVGTGVNTIEAGMRVMSVDLGQRSAAAVSIFEVMRQKPAEQETKLFYPIAVTGLYAVHRRSLLLRLPGEKISDEIEQQRKIRAHARSLVRYQIRLLADVLRLHTRGTAEQRRAKLDELLATLQTKQELDQKLWQTELEKLFDYIHEPAERWQQALVAAHRTLEPVIGQAVRHWRKSLRIDRKGLAGMSMWNIEELEETRKLLIAWSKHSRVPGEPNRLDKEETFAPQQLQHIQNVKDDRLKQMANLLVMTALGYKYDEAEKQWKEAYPACQMILFEDLSRYRFALDRPRRENNRLMKWAHRSIPRLVYLQGELFGIQVGDVYSAYTSRFHAKTGAPGIRCHALKEEDLQPNSYVVKQLIKDGFIREDQTGSLKPGQIVPWSGGELFVTLADRSGSRLAVIHADINAAQNLQKRFWQQNTEIFRVPCKVTTSGLIPAYDKMKKLFGKGYFAKINQTDTSEVYVWEHSAKMKGKTTPADPAEEGVFDESLTDEMEELEDSQEGYKTLFRDPSGFFWSSDRWLPQKEFWFWVKRRIEKKLREQLQ

SEQ ID NO: 61955 - protein, 318 aa, Unknown
  Microbial Source - Accession No. GA0272445_1000517
MLRRCEEEVVKFLNLSRLELQKMLYHKMKDAGVETSAYTLALLVQRFTGSLGEKAVIPFDTSYNAKFVSEDGVWFVEVQLLKGRGRRVRIPVAKTELPYYEALEELKDLPFIIVRENKDWFAYVSIPVQNSVNGEIVGVDFNLRRWVASPFEGPPLFFDAGEYMRGIDRLQRLRSRYQRRGEEDKWNECYREMRGIVKLAHGNFLARIREKYGVCTLAVEEVEVMYKLIRKDNKMINNWLYSKTALRQFTLRAMAKGFNVVEVDPKDTTKLCHKCGGQVKIYGKHDRLITCEKCGYKDYNRDLNSARNIAKKAQYVKE

SEQ ID NO: 61956 - protein, 1129 aa, Alicyclobacillus sp.; identical to SEQ ID NO: 61953

SEQ ID NO: 61957 - DNA, 91 bp, Artificial Sequence
  Synthetic
gtctagaggacagaatttttcaacgggtgtgccaatggccactttccaggtggcaaagcccgttgagcttctcaaatctgagaagtggcac

SEQ ID NO: 61958 - DNA, 91 bp, Artificial Sequence
  Synthetic
gtctaaaggacagaatttttcaacgggtgtgccaatggccactttccaggtggcaaagcccgttgaacttctcaaatctgagaagtggcac

SEQ ID NO: 61959 - DNA, 91 bp, Artificial Sequence
  Synthetic
gtctagaggacagaatttttcaacgggtgtgccaatggccactttccaggtggcaaagcccgttgaacttctcaaatctgagaagtggcac

SEQ ID NO: 61960 - DNA, 91 bp, Artificial Sequence
  Synthetic
gtctaaaggacagaatttttcaacgggtgtgccaatggccactttccaggtggcaaagcccgttgagcttctcaaatctgagaagtggcac

SEQ ID NO: 61961 - DNA, 91 bp, Artificial Sequence
  Synthetic
gtctagaggacagaatttttcaacgggtgtgccaatggccactttccaggtggcaaagcccgttgaacttctcaaatctgcgaagtggcac

SEQ ID NO: 61962 - DNA, 91 bp, Artificial Sequence; identical to SEQ ID NO: 61957
  Synthetic

SEQ ID NO: 61963 - protein, 1090 aa, Artificial Sequence; identical to SEQ ID NO: 61954
  Alicyclobacillus sp.

SEQ ID NO: 61964 - DNA, 125 bp, Artificial Sequence
  Synthetic
tgcaggttagtggaaatatagatagccgttgtgactgagtgacgtgttaggtcaccgtagcacatgacacaactgcactggtcagcctgtagctaaccaccttcattatatctagtttttccaac

SEQ ID NO: 61965 - DNA, 98 bp, Artificial Sequenc
  Synthetic
gttgtgactgagtgacgtgttaggtcaccgtagcacatgacacaactgcactggtcagcctgtagctaaccaccttcattatatctagtttttccaac

SEQ ID NO: 61966 - DNA, 61 bp, Artificial Sequence
  Synthetic
tgacacaactgcactggtcagcctgtagctaaccaccttcattatatctagtttttccaac

SEQ ID NO: 61967 - DNA, 99 bp, Artificial Sequence
  Synthetic
gaaggtggttagctacaggctgaccagtgcagttgtgtcatgtgctacggtgacctaacacgtcactcagtcacaacggctatctatatttccactaac

SEQ ID NO: 61968 - DNA, 120 bp, Artificial Sequence
  Synthetic
gttggaaaaactagatataatgaaggtggttagctacaggctgaccagtgcagttgtgtcatgtgctacggtgacctaacacgtcactcagtcacaacggctatctatatttccactaac

SEQ ID NO: 61969 - DNA, 73 bp, Artificial Sequence
  Synthetic
gtgcagttgtgtcatgtgctacggtgacctaacacgtcactcagtcacaacggctatctatatttccactaac

SEQ ID NO: 61970 - DNA, 63 bp, Artificial Sequence
  Synthetic
  misc_feature (37)..(63): n = any nucleotide
gtccgtttcgttagtggaaatgtagatggttagcacnnnnnnnnnnnnnnnnnnnnnnnnnnn

SEQ ID NO: 61971 - DNA, 52 bp, Artificial Sequence
  Synthetic
  misc_feature (26)..(52): any n = any nucleotide
tagtggaaatgtagatggttagcacnnnnnnnnnnnnnnnnnnnnnnnnnnn

SEQ ID NO: 61972 - DNA, 54 bp, Artificial Sequence
  Synthetic
  misc_feature (28)..(54): Any n = any nucleotide
gttagtggaaatctagatggttagcacnnnnnnnnnnnnnnnnnnnnnnnnnnn

SEQ ID NO: 61973 - RNA, 25 nt, Artificial Sequence
  Synthetic
gggaacaaagcugaaguacuuaccc

SEQ ID NO: 61974 - DNA, 18 bp, Artificial Sequence
  Synthetic
gggtagggcgggttggga

SEQ ID NO: 61975 - RNA, 12 nt, Artificial Sequence
  Synthetic
  misc_feature (1)..(1): Biotin tag = /5Biosg/
  misc_feature (12)..(12): Iowa black quencher = /3IAbRQSp/
ucucguacguuc

SEQ ID NO: 61976 - RNA, 24 nt, Artificial Sequence
  Synthetic
  misc_feature (1)..(1): biotin tag = /5Biosg/
  misc_feature (24)..(24): Iowa black quencher = 3IAbRQSp
ucucguacguucucucguacguuc

SEQ ID NO: 61977 - DNA, 55 bp, Artificial Sequence
  Synthetic
gaaattaatacgactcactatagggaggtttcaaactttacttgctttacataga

SEQ ID NO: 61978 - DNA, 30 bp, Artificial Sequence
  Synthetic
tcctaggttgaagataacccacataataag

SEQ ID NO: 61979 - RNA, 64 nt, Artificial Sequence
  Synthetic
gauuuagacuaccccaaaaacgaaggggacuaaaacgcagcaccagcuguccaaccugaagaag

SEQ ID NO: 61980 - DNA, 55 bp, Artificial Sequence
  Synthetic
gaaattaatacgactcactatagggcgaagttgtaggagacattatacttaaacc

SEQ ID NO: 61981 - DNA, 31 bp, Artificial Sequence
  Synthetic
tagtaagactagaattgtctacataagcagc

SEQ ID NO: 61982 - RNA, 64 nt, Artificial Sequence
  Synthetic
gauuuagacuaccccaaaaacgaaggggacuaaaacccaaccucuucuguaauuuuuaaacuau

SEQ ID NO: 61983 - DNA, 18 bp, Artificial Sequence
  Synthetic
gctgctgaggcttctaag

SEQ ID NO: 61984 - DNA, 21 bp, Artificial Sequence
  Synthetic
gcgtcaatatgcttattcagc

SEQ ID NO: 61985 - DNA, 40 bp, Artificial Sequence
  Synthetic
gcggccaatgtttgtaatcagtagacgtggtccagaacaa

SEQ ID NO: 61986 - DNA, 39 bp, Artificial Sequence
  Synthetic
tcagcgttcttcggaatgtcgctgtgtaggtcaaccacg

SEQ ID NO: 61987 - DNA, 22 bp, Artificial Sequence
  Synthetic
ccttgtctgattagttcctggt

SEQ ID NO: 61988 - DNA, 18 bp, Artificial Sequence
  Synthetic
tggcatggaagtcacacc

SEQ ID NO: 61989 - RNA, 111 nt, Artificial Sequence
  Synthetic
gucuagaggacagaauuuuucaacgggugugccaauggccacuuuccagguggcaaagcccguugagcuucucaaaucugagaaguggcaccgaagaacgcugaagcgcug

SEQ ID NO: 61990 - protein, 1129 aa, Alicyclobacillus acidiphilus; identical to SEQ ID NO: 61953

SEQ ID NO: 61991 - protein, 7 aa, Simian virus 40
PKKKRKV

SEQ ID NO: 61992 - protein, 16 aa, Simian virus 40
KRPAATKKAGQAKKKK

SEQ ID NO: 61993 - protein, 9 aa, Homo sapiens
PAAKRVKLD

SEQ ID NO: 61994 - protein, 11 aa, Homo sapiens
RQRRNELKRSP

SEQ ID NO: 61995 - protein, 38 aa, Homo sapiens
NQSSNFGPMKGGNFGGRSSGPYGGGGQYFAKPRNQGGY

SEQ ID NO: 61996 - protein, 42 aa, Homo sapiens
RMRIZFKNKGKDTAELRRRRVEVSVELRKAKKDEQILKRRNV

SEQ ID NO: 61997 - protein, 8 aa, Homo sapiens
VSRKRPRP

SEQ ID NO: 61998 - protein, 8 aa, Homo sapiens
PPKKARED

SEQ ID NO: 61999 - protein, 8 aa, Homo sapiens
PQPKKKPL

SEQ ID NO: 62000 - protein, 12 aa, Mus sp.
SALIKKKKKMAP

SEQ ID NO: 62001 - protein, 5 aa, Influenza virus
DRLRR

SEQ ID NO: 62002 - protein, 7 aa, Influenza virus
PKQKKRK

SEQ ID NO: 62003 - protein, 10 aa, Hepatitis virus
RKLKKKIKKL

SEQ ID NO: 62004 - protein, 10 aa, Mus sp.
REKKKFLKRR

SEQ ID NO: 62005 - protein, 20 aa, Homo sapiens
KRKGDEVDGVDEVAKKKSKK

SEQ ID NO: 62006 - protein, 17 aa, Homo sapiens
RKCLQAGMNLEARKTKK

SEQ ID NO: 62007 - protein, 4 aa, Artificial Sequence
  Synthetic
GGGS

SEQ ID NO: 62008 - protein, 12 aa, Artificial Sequence
  Synthetic
GGGSGGGSGGGS

SEQ ID NO: 62009 - protein, 7 aa, Artificial Sequence
  Synthetic
AEAAAKA

SEQ ID NO: 62010 - protein, 15 aa, Artificial Sequence
  Synthetic
GGGGSGGGGSGGGGS

SEQ ID NO: 62011 - protein, 30 aa, Artificial Sequence
  Synthetic
GGGGSGGGGSGGGGSGGGGSGGGGSGGGGS

SEQ ID NO: 62012 - protein, 45 aa, Artificial Sequence
  Synthetic
GGGGSGGGGSGGGGSGGGGSGGGGSGGGGSGGGGSGGGGSGGGGS

SEQ ID NO: 62013 - protein, 60 aa, Artificial Sequence
  Synthetic
GGGGSGGGGSGGGGSGGGGSGGGGSGGGGSGGGGSGGGGSGGGGSGGGGSGGGGSGGGGS

SEQ ID NO: 62014 - protein, 5 aa, Artificial Sequence
  Synthetic
GGGGS

SEQ ID NO: 62015 - protein, 10 aa, Artificial Sequence
  Synthetic
GGGGSGGGGS

SEQ ID NO: 62016 - protein, 20 aa, Artificial Sequence
  Synthetic
GGGGSGGGGSGGGGSGGGGS

SEQ ID NO: 62017 - protein, 25 aa, Artificial Sequence
  Synthetic
GGGGSGGGGSGGGGSGGGGSGGGGS

SEQ ID NO: 62018 - protein, 35 aa, Artificial Sequence
  Synthetic
GGGGSGGGGSGGGGSGGGGSGGGGSGGGGSGGGGS

SEQ ID NO: 62019 - protein, 40 aa, Artificial Sequence
  Synthetic
GGGGSGGGGSGGGGSGGGGSGGGGSGGGGSGGGGSGGGGS

SEQ ID NO: 62020 - protein, 50 aa, Artificial Sequence
  Synthetic
GGGGSGGGGSGGGGSGGGGSGGGGSGGGGSGGGGSGGGGSGGGGSGGGGS

SEQ ID NO: 62021 - protein, 55 aa, Artificial Sequence
  Synthetic
GGGGSGGGGSGGGGSGGGGSGGGGSGGGGSGGGGSGGGGSGGGGSGGGGSGGGGS

SEQ ID NO: 62022 - protein, 65 aa, Artificial Sequence
  Synthetic
GGGGSGGGGSGGGGSGGGGSGGGGSGGGGSGGGGSGGGGSGGGGSGGGGSGGGGSGGGGSGGGGS

SEQ ID NO: 62023 - protein, 70 aa, Artificial Sequence
  Synthetic
GGGGSGGGGSGGGGSGGGGSGGGGSGGGGSGGGGSGGGGSGGGGSGGGGSGGGGSGGGGSGGGGSGGGGS

SEQ ID NO: 62024 - protein, 75 aa, Artificial Sequence
  Synthetic
GGGGSGGGGSGGGGSGGGGSGGGGSGGGGSGGGGSGGGGSGGGGSGGGGSGGGGSGGGGSGGGGSGGGGSGGGGS

SEQ ID NO: 62025 - protein, 9 aa, Artificial Sequence
  Synthetic
GGSGGSGGS

SEQ ID NO: 62026 - protein, 32 aa, Artificial Sequence
  Synthetic
LEPGEKPYKCPECGKSFSQSGALTRHQRTHTR

SEQ ID NO: 62027 - protein, 20 aa, Artificial Sequence
  Synthetic
PKKKRKVEASSPKKRKVEAS

SEQ ID NO: 62028 - DNA, 27 bp, Artificial Sequence
  Synthetic
ggtggtagtggagggagcggcggttca

SEQ ID NO: 62029 - DNA, 72 bp, Artificial Sequence
  Synthetic
ggtggaggaggctctggtggaggcggtagcggaggcggagggtcgggtggtagtggagggagcggcggttca

SEQ ID NO: 62030 - DNA, 48 bp, Artificial Sequence
  Synthetic
tcgggatctgagacgcctgggacctcggaatcggctacgcccgaaagt

SEQ ID NO: 62031 - DNA, 192 bp, Artificial Sequence
  Synthetic
gtggataacaaatttaacaaagaaatgtgggcggcgtgggaagaaattcgtaacctgccgaacctgaacggctggcagatgaccgcgtttattgcgagcctggtggatgatccgagccagagcgcgaacctgctggcggaagcgaaaaaactgaacgatgcgcaggcgccgaaaaccggcggtggttctggt

SEQ ID NO: 62032 - DNA, 108 bp, Artificial Sequence
  Synthetic
ggtggttctgccggtggctccggttctggctccagcggtggcagctctggtgcgtccggcacgggtactgcgggtggcactggcagcggttccggtactggctctggc
